United States Patent 12,376,589 (CHRYSEOBACTERIUM INSECT INHIBITORY MICROBIAL COMPOSITIONS AND METHODS OF MAKING AND USING) - sequence listing, part 4

SEQ ID NO: 77 - DNA, 4653412 bp, Chryseobacterium sp. (residues 3,102,277-4,653,412 of 4,653,412)
aggattttatcgcagatgaaattgcatacctttaaatggagtatacttgctgaaaatcaaagattttcatacgtcttaaatgaatgatcatttcataaatctttgcctctctgcgtttccaataaaatatagttatttttcaatctgtggaatctcaatggccataagctgaagttgatattcttgtagctggtgattgataacagataatccgtttctgaagtatgaagaatttttaaaaagctcctgataatattctatcccttcgagtacattttttctgaaagtattccactttttggtttgcgaatgggtgatctgtactggtgaatctgtaatgtcctttctcagataatcaacgtacattttcagttcgctaataaacatattcggacgttggttattggaaagaatattcttatttccgtaaatatgttttaccatatctgaaagggaaacctccttgtcaaaaaaggcaatattgggtccgggacatatcacaacgccttgtttttcacctttgatttcaagattttgttccatataagcggcgtttaccaagcctacacagagacacgccttatcggtgattgcagcctttcttttttcaaattctgcctctgtcagtgtttctttttcagcataaagttcttttagtttgatatcctgatattttctggaggctgtacaggttccttccggagaaaattctttactcaaagcgagcagctttttaggacatgagcttccgtatttaccttttgcttctttttcgtatttcagtttttcattggaagttccttttaccgtgttgaaagggactcccaatggagaaatattgctcagatagaaatcctgttcttttgattgtacaagcagattacgggtttcagcatctacagaagtagcttcaggtaccagtaaaaaaggtgatccccaacctacgctgtctacattataattcgccaataaaaactcgtgttcttctgcggttcctactccaccctgaaccgtaattttcatttctaaaggcccagatattacaggcttccctttttgttctaaagcagtgatcattaaggaatgggcagattgtatcagatcattttttttctgcttgaattcttccataatcggtccgagaagcattccttcggtagcaaaggcatggcctccgcaattcaatccggattctatcctgtattctgaaacccacaatccttttttggccaggaaatttccctggatcatggcagaacggaagtcacttactttaaggatgattttctttttgatctttccgttttcatccggaaaaaaatcttcaaattcttccatatagctgtatagacggggattcattccagcagaaagtacgaccgatgatgaaagcttgcttttggcaaatccccgaagtgaagcgtgagcgtcgttatacatgaccggaagctgttcattctgatgataattatccttatctactttcgtcatgatattgacgtcaatacttccgggatttaaattggattcaatgaaacttttaatctgggaactccagttgtctttctgatggataaggctttgaaggctgtttttgaggtctgaagtattgggaagcatagccataaagtctttcaaagcctctttatttctgctgatttcctgtttgaaagattcaaatttttcattcacgatatcatctaccatatccagataggctgtaattcttctggctctgtaatcctcagtttttgtagagataccgaaataatcaagattgaactttttattgtaaaagttcttcatcttctcaaggatttcatcatcaatgatggagatcacagaagatattccatactgcgcaacacgaatcgggctgtctatcgtataagccagtcccattaccggaatatggaaattgtgcaaaggtttttttgtcataaagttttgataaaaattctttttatttatctaaaaatcctttacaactattcactgccataaaaatattattttaaaatgaattatgcgttaaataacattttgtaatataagaaacatgtcaaatgtcattttttaagagaataaagaactgcgactttgtcactgaaattttataaaacaaaaagaccaatctttcgattgatcttttgttaatggtataatattatttaaagctattccgctttgtttttaagcatcatcagaaggctgtaagctcctttctgtacaattttcttatcctttaaaacatcagcttttaagatttccgtaaactgatcatctgaaattccgaccgctacaggaatcattttataaccggattttccaaggtcttcaaaaacataatttttgttttcaaaagaaaccacggcctcgttaggaagtcccgttgtgtagcggctgctgatgtttacttcggcattcacgtacattccttttacaaattcagtatttacagatgataatctggctactgcagttgcagaacctccgttttcaatgcttggaacaactctgataatcttagcacttgatttcacatccggtttctgattgttgtagaccagaatttcctgcccgactttcacatcatttacatcattttcaaaaacctttaattccaacaataatccggatggattaatcagctcaaataaagtatctgccggattgatatattgtccgttactgacaaggattttgcttacaaaaccagtaaacggagcgtagatatcaatcttacttctgatatttcccgtacttagtcctttggcattaattccaataattctgagcttttcctcgaggccttttaacgtagcattcagagtggaatattctgcctgagcggtttgcatggtcttatcgctgctggctttgctggtattcagatctttctgacggttgaagttcagtcttgcggcttccagttgggcttttgtcaccagataatcctgctgcagctgtataaattgcggatcttctactacagcaagtacctgtcctttgctgaaatggcttccgttaatcacattaatagacttgatgtgtccgcccatgatgctggaaaccagactgatgtgagacggcgcaatttctgctttcccgttcagtttcataagcttttccatatttctgtcctgaactgtggtggttgtcaatcctacagactgaatctgtttttcagtcagatgaactgtattttcattgttcctggtaaattttgtgttttcgtaaaccgttttttcttcctctttctttgaacatgaagttacagtgagaattagagcaaggatgtatagagatatattcttgaaatgcatgacgtcgttattttgaaattaagaattgaagttctgctcctgtctgattgagcttttccagctggtcaatataatctgctttggtttttacggcctggttcacgaggattacccaatccagataatcaatttcccccacttccatctgtttttgtgctgtttttaaaattgtttcagattttggaagctgtttttgttcatagttttcaatgatccgctgttgattcatataattagccagctgctggtttaacctatttttaagttcaatttcttttctttggtactgattttcggagatggcaatttttgcctgtgctgcttttgccaaagctctttgtccttttgtaaataagggaattcctacacccacctgtaccgagttgaaacggttattattaatgtttttcatactctgattggtatatcccaccaggagatccggaagcagtctgcttttttccagctgtacttctgcttctcctactttgatctgttgctgcagatattgaagttcaggatgctgctttaccatttcttcagagatctgaagacccaaattgatcgttggttggtcagctatgggttggtaaggaacctctgactgaagtaatagctgaagctgaagttttgcgatgctcaggtcattttcaagagtattcagctgaacttttacctgctctttttgaatttctgctgtggattcctccagaatgttggcttcccctttttttaatcttaatccggctttctcagcaaaattattgtacagctggctgatgtattccagcacttttttcttttcctgaaggaccaatattctatagaaaatatctgtcacttctttggttagctgtgtctttgtcagattctgactgataatactggcagaccattcggcatccagcatctgcttcctttttgaatatactgtcggaaagctgaatcgctgagaaattccgaatgaattatcggtttcctcaccctgaatctgcccaaaccctccggtaacttccatctggggaatattcaggtagctggctttcagtttttcctgataatcggatactaattttgaatttttaagagtaccattttgctggtatgctttttccagagcctggtcataagtaatattttcctgagcctgatagcttccaaaggagatcatcagtacgaaaacagacagttttttatagttgggttttttagagaatttcattttatctttattaatatgttcaaaaaggacgtacagaataggaagtacaaacaaggttaaaagggttgccagcattaaaccgccgattactacagttgccaaaggtctctgtacttccgctcctgcgccattgctgatggccataggaaggaaccctaaagaagctacaaaagctgtcattaaaaccgggcgaagcctgatttttgttcctatcagtacaattctgctggtattggttattccgttctttttcaatcggttaaactctgatatcaaaacgattccattaagtactgcaacaccgaataatgctataaaccctacgcctgcactgatactgaatggcatccctctcaacgccagaaaataaacccctccaatagcagataaaggaatggcagtgtagatcagcaagctgtgttttacagaaccgaaagcaaagaataacaataggaaaatcattactaatgaaattggaacggcaactccaagtctggctttagcttcattcagattttcaaaagcaccgccgtacgaaaccgtatatcccggtgagagtttaaggcttttaccggctttttgctgaagttcttccacaatactctgaacatctcttcctcttacgttgaaacctacaatgattctccttttcgtatcttccctctggatctggttcggactgtttttaagctctactttagccagctgtgacaacggaatctgttctcccgaagtggtaggaaccagaagattttgaatgcttgtaatatcttttttatgttcattatccatccggacaacgatgtcaaatttcttttcaccttcatataaggcgcctgcggtctgacctgcaaaagccatgttgatcaccctgttgatatctgctactgaaatattataacgggacagttcagaacgattataatcaataaccacctgcggagcacctaccacaggctcaatataaagatcctgggcaccttttacggtattgatgatgcttcccatcttttttgcatatgaagcaaggctgtccaggtcttcaccataaattttgcaaaccacatcctgtcttgctcccgtcatcagctcattgaaacgcatttgtacaggaaactggaagctggttgtcaatcccggaataacgcttaatgccttactcattttatcggaaagctcctgaaatgttttggcagatgtccattcttttttaggctttaaaacaatgataatatcccctgcatccataggcatgggttctgtaggaatttcagcactaccgattttggtcactactttttctacttcgggaaactgcgttaaaagaatatgcccggcctgcgtagttgctttttttgtttcgttgatgttgcttccttggaggattctcatttcaacggcaaagtcaccttcttccaaagacggaataaactctcctcccattctggaaagggtaaaaacagcacctgcaaaaaggatcaacacactcaggattattgtttttctgtatttaagagctttcatcaggagcttctggtgccctgtttccactttatccatgacacggtctgagatgttttctttttctttcttttttctgcttaataccagagaactcatcatcggaatataggtcagagaaagaataaatgcaccgatcagcgcaaaagcaaccgtctgtgccataggcttgaacatctttccttcaatcccctgaagtgtaaaaatcgggagatatacaattaaaataatgatctgtccgaaaacagcactgttaaccatcttggtagccgagcccgaaacctgatcatccatttcccttttgctgagcatattgtctttcccaaagtgttttttatgggcgagctggtgcagtaccgcttctacgatgataacggctccgtctacaataagtccgaaatcaagggcaccaaggctcatcaggttccctcctataccaaagatattcatcatgatgatggcaaaaagcatagctaaaggaattacagaagcaaccagtaatcctgctctgaagtttcctaaaaataaaacaagaatgaaaacgacaatcagcgcaccttccatcaggtttgtttttactgtgctgatcgtattgtttaccattttagcacggtcaaggaaaggttcaattacgactccttccggtagtgattcctgaatcttttccagtctttctttaatattcccgatcacgacattggcattctctcctttcagcatcaggacgatagctccggagacttctcctgtgtcattataagtcatagcgccataccttgtcgcataaccgatctttacggaggctacatctttgatatgcactggaatgccttcctgggtttctgctacctgaatttttccgatatcttcagtgcttcccaaaagcccttcactccggataaacaaaacagtttccttcttttcgatataagcgcctcccgtattctgattgtttttctccagcgcagcaaaaacatcattgatattgatattaaatgcctgaagctgattgggattaatggcaatttcgtattgtttcagctttcctccgaaactgctgacatccgccactccttttgttcccagcagctgtcttctaactacccagtcctggattgtcctaagttccgtttcatcatatacattttcatagccttttttggctcttaccacatactggaaaatttcccccaatcctgttgaaatgggtcctaattccggcttgccaattccggctggtatattgtcctgtacgagctgtaaacgttcctgaacctgctgacgtgcccaatacacatcggtattatcatcaaaaactacagtcactaatgaaagtccgaaacgtgaaaagcttcttaattctgtaattccactgatgttgctggtagcctgttcaataggaaacgtaacaagccgttctatatctgccgcaccgtaagaaggcgccgttgtaatgatctgaacctgattattggtgatatccggctgagcatctatgggaagtttagtggtttcatagactccaaaaagtacaagtcccactgtaaacagagcaatgatgagtttattctttacagaaaactcaataattttatttaacatgaaaaaactattaatggataacccggcagcaaaacgtttctgaatggagtctttatttattcacagacagcgactgaaagccttctggctttatcagcatatcttagaaaataaagtcagtaatacatcataaacaacgttatcatgcacaacaggttaaattgatatgtaataataattggactgctttaagactaaagcagtttcagtatagaactaattaagaaagccgcggaggctggaaaatctgagaaaggtactgatgggaaaaatctttttccttgtagatactggttttctttgaaaccgtaatttctttaggtttttttatttcgaatgtcagttccggaagctgggcatgtacagtcagtacaataggtggattgataaaaggcagtttctgatctgtatcccagtcagaatcctgtttgtggttatcataatgctccattacaaattctgaaagacttccctggtattccatgaagtgttcaacaaacataggcaccttcagtacttcccccgcattggtggtagccagtacatacatcatcgaacataatatggaaaaccattttaacatcagtgcaaatatagggcttaaatttttcctgaaaaggctctagtattaaatttttgagaattttctccggtttaaaaatggtttaaataaataagaaataatgttagatttaccaaacaaacattaaagtcttgatttcagcctgcttaaagtttcctgcgaaatattaagataggaagccaccattttattagaaagccggcgtacaataatcgggttttcttccagtaattgtttgtacttttcaagagcatcctgcaccataaaagacatcagccttttggtgttggcaatgcaggcaatttcaatataaattctgtaaaatttttcccactggggaataatgtccaataaatgataaaaatcctgatgggtaatataatagacttccgaatcttctacagcctggagaagttcatcagaaggttccgaagtaataaaggtatgaagtgctgtggcaaactgattttcaaaagcaaaatatcttgtagaatcctgtccctccttattaatataaaatatccgtaaacagccttttacaacaaagaatgttttcttaggagcgtgaacattggtaacgagaagctcgttcttttttaatttgacaggtttgaaataagaaagaataactttcaactcttcatctgttattgatattttgcttttaatatatgaaactaatacgtcttccatttatttaaatcagtcacagcaaatttagcaataaatatgttaaaaaacttactgctattacagcttcttaagtgctttcagatgattttccttctgcttgcccagctctccaataggaagaggcatacatcgcatgagtgtcccatttcaggtttgttttaaaatgggtgcgaagctcctgcactgttgtatattctgctgcgatatacacatattctttcagggctccggatggaaaccgaacagatttaactttttctgaaagctgacttccgttttcaggatgaggattgtgaagccactccaccgtaatatctgcggcagaacacagaataagctcatcttccctgcctgcaacttccaatatgatttttgctgttacgtaagaaggaagctgctctgctatggcacagatgaccggtaatgctgtagcatccccggccatgagataaaaatcagcatcgggaactaaaggtcttgtactttctttcatccctatttccagtatatcacccggattggctttcagtgcccaggcagaagccggtccgttatcaccatgcgctacaaaatctataatcagttcgagattttccagatcaatctttctgttggtatatgttctgataaagggagcatttccctcttcagccggtataaatattttgttatttgaaccggagcgtacattaaccaataattcagcctgattatcatttattttaaataccacacggataagatgaggcgtaagatattgtttgtttttaacgataaatgcagagcgtattttctttgttttgtcttcctgagcaattacagaattttccattcttattttttattaattaatagaattacgatagacactatacagctgatgcctccgaaaaggtacaccgtctggtaatcaaaccagcctgcgattaaccctgcaataggtcctgccagtcctaatgaaaggtcgacgaaagccacatatgctcccaatgctgttcctctcatctgaggttttactttttgtatggcaagaactccgagcgcaggaaaaaccaatgaaaatccaacacctgttaatccacatccggtaatggccaatgttttggatgcagcggtccagatcagcagctgtcctgccacttcaatgatcagagaaagtaaagcaatcgtaaaacctccgtatttatccggaaaggaagcaaataaaattctggtcagcacatagcatgccccgaagaccataaaggcaagtgaagcatcaccccagtttttctgtgagaaaaataaagcaataaaagaagcaatacatccaaaagccattgatgaaaaagcaagactaagtccctgtccggatatggcaccgattaccttgtagaaaggggttcgtatatgttctttatctacaggaatagagggaagattggcggtggaaagccagcttatcaccggaagtaaggcaataaggacaaaagcaggcaggatatcatattctttgcttaacaagatgctgataggcgctccgattgcaattcctgcatacatggcaataccattccacgtcattacttttcctgagctggaatgtcccacaagtcctattccccaggttaatgctcctgtaaccaggaaactttcacctaccccatgaataattcttgccagtaaaagaaagacaagtgccagcagcggatgagcctgaaataataccgccagtacataaataattccggcaatgacagccagtattacacccgacattttacttttcttagcgccttttgtatcggtgattttgccggaataggcccgggttaagagtgttgacagagactgaaggccaatgacaagtcccaccattatactgtcaaaacctaagctgctctgaacaaacctgggaagcacccccaaagcaattcctatcgtcaggtaaactccgaataccgaaataataatcggagcggttgcctggtagaaattaatagtctgtcccttttctaatgttgtactcataaattttgtttaaaatattcgggtgcaaaggtccccgaacagataacacaaaactttgatctagatcaaaaaaggtacagaggtttttaatcaaaatctaaaaaactatcagttagttgtttccattgtattttggcaactccgaacattccgggaatggcaatgaaaagatttcttattacatcaaagaatttcgcattaaaattaggcttttcattccgtccgtatactgctgctttcagatgatcaggactcctggatatcatgaaggtagaagtagctgtggaaccataaaaatgggcaatatgacggttttttttatcctgaggatttatggaaggcctgcaggtcatggatatactttcagaaaagctgtcctggtagaaacaaatatctgtaacttctacccagtcatatcctttggcgtcaggttctcccggccccggaatgtcaatccggataaaatcacctttctgaggctcccggttaaccgcattaccatcggaatcgtataatttaaatgctgcaaacgctttaccgctataactttcccattgattcactgagaaaaatctttcttttaatatggtaaatttcagcggaatcaaatcctgcctgtatacttttctgctttccgtatcatggaaacctccggacttttgtgcaggaacgcctttgaatatctttggactcatgtgataaggtttttaagcaatttaatgcaaaaactatccggaattttatgagcagggtcacaaaaaaggtaaacatttgtttgattattggcttacataagcggtttttcaggtaacaatctcattcaattatttcttattctttatagaaaaccggcctacaattcatataacggcgaattacattttactggatatgtttttatagtattaattcaggaatcttaaagaaattaaaaaagaattaaggaataattattttcatataaaataaataatttttaaaaaaaatgcacttacaatgttttgcataatataatttttacttatatttgtgaatcgaaataattttttttcatcatttgtgtttttttaaggtctccattcgtggagacctttttattttcaattgcatcataattgaatattatctattgaagtggaaaaataattggaatgtgaaatatttctttttttaatacaggtaatttcttttaaataaaggaatgcgtgaagttttgcaatgttaataattccctttttactgaatattgatgcttttataaaataggaactattgaatggtcttaataaaatctgttggcctgaactgcatcacggcctgaaaacttctggtgaatgcctgaacactcttataccctacttcataggctgtttctgaaattgtaagcgttcccgaacttaacaattccagacttttaatgatacgaagcatctgctggtatttgcttaaagtaagtcctgtttcttttttgaaaattcgttccagggtacgaaaggaaagaaaagcggcatcactgagatcttccatcttgatttcattccggtaatggctgtgaagatgttctatgactttggtaaggcgcttgtctttcggaagactaatgtgaagggtcagcgaatgttttacaaactgagggagttcattaaacaatgctttcagaaaaagggtttcattatgatctgaaatcatcagctttgaccatttctcggaatatttaatcatttcttttaaaaccggaggaacggaaaatacactgatctcatgataaaaaggattgtccgtactgatatctgcaaacattatcatcagcttaattttttcagaatgggaattcgttttgtgaacagcattcgggggaatccatacagcgtgattctgcggaagaagataaattttttcttcaatagtgatatactggaagccgctttccacatagaccagctgtcctttctgatggtgatgaaaaacatcatcatgaacccagttttcttcaaaccagacgaaataaggcttcttcagctcatcaatttttatactgtcgttggttttcatgtcgtttcaggttaaaactttggcaaaattaaacaaaattactaagttaattttgcacaaaagttttaattatgatgaagaatgaagtaaaaaagaatgcttcgtatgttttattgatcattaatgttctggtagttatattgatttccagcaatctccgctccccaattgtggcagttgcgcctgtgttgggagaagtaagagatgccttgcatctggacaattttcaggtgagtttactgacttctattccactgtttatgtttgctgcctgttctgtacttgtcagtagattttccaataaattcggaatcagtaaactgctgatgtattctctgattattttaagctttggtttatttttaagaataagcggatctctttggcttttacttttaggttctctattcattggcttgggaatatgcattggaaatgtagttactcccggatatgttaaaaacaatttcccgaagcagattggtctcatgacaggtatttttgctgtatcgatgaatcttacagcagctctggcttcaggatttagtgtgaaaatcggagaatggacaggattcggatggaaaggttccctgggaatatggctggtgattgcggcattgggttttatggttttatcattggaattcatattcaataaaagaaatcctgatcagcccaaaacggcgctcagcacatcagattttaatatgttcagatctgctcaggcttggaatatcagtatttttatgggactgcagtctttattttattactgtctggtagcctggctgccttcatttcttgctgattttcatatgcagggcgaaagttcaggctgggtgttttttgtgattcagattacgatgattcctgttacgttctgttgtccgattattgccagtaaaatgaaagaccagagagctatgatcctttttatatgtactctgatgttcggaagtacgatgatgtttgtcttcctgaagtctcaatggatttacgtaaatgccgtgatcatagggatttccaatggattgtctttcagtttatccattctgttcttttctacgagaacgaaaagcagcaccaatgcggttaaaatatcagggatggcacagtcggtaggatatctgattgctgcttttgggcctccattatttggcaagcttcatgactgggatatttcctggaatagttcgttttatttattgagttcggcagtattgttaatgctctattttgggatgaaggctgcgagaaataaatatgtagaagattaagacataagtttaaaggatagaaattaattaatcattgccttctatcctttatttttttgcttctttaaacagttttattaattaaaattttaattcagcttcttcaccgtcatcaagtacaaaacatctcttctctagtctgttttcattgattttctctttaataaattttctgttttccctgcaatgacttaaagtttccagatgcgttacccaaacagtagactgcggcgcatattcacagacttttaagatatcttcactggtcataataataggatctcctatggaaaaagtagcggcgcctcctgctacaatgatgtgttgtggctggtgcttatcaatttcctgagcaatttcatcgtaccaaatagtatctcctgcgatgtatactgatttattgtctgttttaaatacaaaaccattcacgattcccattttttctccgatttctccggttccatgctgtcctttggtggttgatatctcaatatttttgaattgaaccggatcattacttacagcaataatgtttgtgaatccttgttctgcaatctgttttgaaataacatccgggcagataaccggaatatttttatcaagaagttcaatagcagcagcgtcccaatgatcaggatgaagatgggttacggcaaccgcatctacgctttctaattttttaattaattcttctttattaaaaggcaggtttaccagagggttcagtaattcgctctctgtcattggcatttttcctctggagcctttatctccgagcatggaatctacaaggatggaaactccatcaatattcagtagcaatgttgcattgcgccataattgtaatttcattttgggtatttttgttgaacaaaggtattacctgatcacggtaaaacaatcgaaggttaccaaaaggttaactataaatattcaattgacttatgaattttgaagaatttaaaaactgtggattaagacgaagcctggatgtcctttcgggtaaatggaaaccgctgattctgcaaaacctctttgaggaagatcaggtacgttttgtagagctttggcggaatatgcccagagtttccaagaaagtactggcagaacagttaaaacagctggaaaaagatcttattattgaacgaacagaagtgtataattttccaccggaagtttattataaactgacagaaaaaggtcaaaagctggggcctattctttctgaacttcattcatggggagacggattgggataaagctgtttattgcattgttaacttatatgtgatctgaaactaaacggtattccgtcagaagaaatgacaagatactgaatgagtttctttatagtaaagctttgtttttttgataaaaaaaatcgcgataagtaatacttaccgcgaaataatataaagatttagaaaataaaatcacatgtattgatgtctttgtgatggttagttcattcctataaatttgaatttgaacagttgacatgaggtgccataataatcccaaagctgtaagttagaattaccgtccatcgtacagttctgaatatcccagccacgggtagcatcaacttttgacaggattttgtaataaccattggagacagccactacctgccacgcctgcgcatcattgccatagttctgccaaagcctgattgatgtccccaatgtattgctgttacttgtcaggtcaatacaacggttagatgcactcgctttggatacaaaacgccagtaaccatttcccgcatcaatagcaacccatcgctgtgcgttggcaccatttcttgtccatggtcttagcactgcgccgttggcatcctcacctgactttaaatcaagtactttgttcgcatcggtctgaaattcaatctcataaatgccattattgaccaaactgctggttgtgttacagtttccaacaggataattggaagatgcatattgctgaaaccactgtttgcttggggcggcacacgcctcccagtcgttattgaaggctgttccggcattaggatctcctttgtgaagcagatcatcaggggcaaggaggttccagctcacattgcccgactgatccacaatatattttaagtttgcgccaaatccgcttccacctgcagtaccggttgtagcaacaccgaaggtaccatatccctgaggtgcccagtcggtttctgtaatggcgatcggtgcaatgtcagcgattggtttaacattgatattccatgcattttgaaaggattgatagttgttgacaccaccccagtaacccggataaatgtgaacagcatagccaatatttcctcctgtgatctgattattgacataaccctgataatgcgattgccatcctgtacccggtatccagcaaacattattggctccgttgttacggataatattcactaaaggctggaagaagtttttgagcgctgcaaagtgctcgtttcctgtagatccccatgtgccgtttgttccaaggatctcaacaggctcattggctaattcgaacatcacgttgtcagcattctttaagcccggatgctgtgacaaaaaggtccacacagttttaagatagctgtgatacgcatcattcacggcaatacggttcgggcatacacccggtggacgcaggataacatacatccccaggctgcgggcatggttgatcaatggaataatcacctgatctgtatacgtaaccaggcggttataattgaatcttgagatatcgttctctgggatagccggtccgggatcattggtccaatacggatcaatgtgaaggcggatgtagttgagataccagccatcagcagcattactgagcttggtcatgacagctttgttatagttcagagctccctggacattgtaattgtcccaggtacaataacctgaattggcaccgtactgacatccgttaaaccacgggctgggtgttatggcaacaccatgtaaaagaacattattgccacacggatcctggaggtatctgcctcccacatgcagcatgggtgtggccgcgaatgctcttgcagtagcacttagattagcttcagtttcttcgagtaaatttttttcatccatcgtagaacagctggaaagaatgattaacagaaaggccagtagccacattttgtttgttttcatagtttaaatattaatattaaaggtgatttctcagttttacttttagccatcaattttccgactcgctattttacgtaggagtttcagatgtttggatagtaaagtaatgttgcaataatgtaactctgctcaacagaattatgagttggtcttcgttactttgttttgctttcagattcagcagaaaaatggaaccgtttctattccgtttcagactgaaagactttcttctttttccggattttccacatgtataggtgtgatattatgaaaatccaaattatcgttgattacgattgttagtttatgataaaaataatcatattattaaatataaagcaattttttaatgaaatttatagcaaaaaatcaatatcataaataaaataattaacaaatggtcataatgtttttataataaagaaaataaaaagaaccttatcataaattttcgtttagatacttatgagaaaaagaagaaagtgattgtttttatactgaaattttccattttaagctcaaaaagttctcacaaaaaacgggatttattgatgctgaatattaaagttgtaacaaaaatatattttaaacagaatttggatttcaataaaggtgacaggaagacttatagtagatttaatatgtcaataactcttgtcctttaatacattaaaaccttataggtttgaaaacctataaggtacatttaaaaaaattaaaaataattattaccggaaggtaccgcttattgtttaaactgatccagaacttccgtaatattctgatagacaaattccaattcttcggaggtaatacaatatgggggaaccagataaatgacgtttcccaacggcctcataataatccctctctgtaagaattcattgtaaagcttcttccctatttcattgaaataggaagtcctattcccggttttgaaatcgaacgctaaaatagtcccgatctgtctaaccttttctgcacaaggatgtaaagcaagtgctttcacaaactctgaatgttgatgagtgatgcggttgatattcatttgagtttcatttgtaagtagcaattccatactggcaagagccgctgtgcaggctaaaggattggctgtaaacgaatgcccgtgaaataaggttttataacggtcttcagaaagaaatgcctcatagatgtcattagaacaggtagtgattcccataggcatcgttccgccggtaagcccttttgaaaagcacatgatatccggtttttctgtaagataatctgctgcgaaaagttttcctgtccttccgaatcctgtaaaaacttcatcctgaatcatcagaataccttcttctctgcagaatttcatcatctggctgagatcttcagctttatacatcaacattccggctgccccttgaaccaatggttcataaataaaacatgctacttcatcggccaactctttaatttgtgatcgaagactttcaagattttcagcattgggtgtatccataaaaacaacttcaaacagcatgctttcaaaaggtcttgtccagaaactttttccgcttacagacatggctccgaaggtatctccgtgataagcatttttaaaagctaaaatctttgttttcttttgtcctttattatatgcatattgaatacacattttcaaggctacttctaccgctgtagatccgttatcagaataaaaaactttttcctgaccggatggaagaagcttcagtaagttttctgaaagcttcactgccggttcatgagtaaagcctgcaaaaataacctgctccagtgtatttaactgttcaaatacacgttgggcaatataaggatgcgaatgcccatgcagtgttacccaccaggatgaaacaatatccatgtatttatttccttcgttatcataaagataaatccctttcccttttacaataggaatggcatcttcagccgttttcatctgagtataagggtgccagttgaccgctttatctctctcttgcaggctgatttcttttgttattgtattcatatattgattgtaatgagtaatggagatggatttaacaataatttagttgaatatgtggtcgtaaatgttggattaatcgcaaagacgcaaatttatgatcgattactattattttaaggacgcaagaaaatcaaagattttcagcaagtacaacgcttgttagtcattgagacgtatcatttgtacataatcaattttatcgtagataaaatccttgcgtcttaaagtattatttactacagaagcttttgcgcctttgcgttttccaacttgtatagcattttataaaaattctaaaaccaagtttgcaataaaagcgataatactaatgatccaactcatcactcatcatttataattcataattatctaacagcatgtttcttttttcatcataggtttcagtcctaaggtctgcagcatttgcatatcttcagatacgccgggattaggcgttaccagtagtgtttctctttctcctgtgaaaatggaattggctccagccataaagcaccatgcctgttctgtttctgacatttctatacgcccggcacttagtcttaccatagaagatggcattacgattcttgcagtagcaatcattcttaccatttcccaggtatctactttttcattgtcagccaatggtgttccttctactctggctaaagcattaatgggaacagattccgggtgttttggcattgttgccaacgttaaaagcattgaaattctgtctctgtgagtctccccaagcccgataattcctccggagcatactgtgattcctgcttttcttacattgttgatcgtattgattctgttgtcaaaagttctggtagagatgatctcctcataatactgctcagaagtatcaaggttgtgattgtaagcgtacaatccggcttcctgaagtcttaccgcctgttcttccgtaagcatccctaacgtacagcagacttcaagaccaaggtcatttactcctttcaccatgtcaattactctgtcaaaatcacggttattacgaacttcacgccatgctgccgccatacagaatctggaagatccggaatcttttgctttttgtgcatgggcaattacggtttctgtgggcagtaaagcctgtactttgatattggtgtgataacgtgctgcctgtccacagtaggaacagtcttcggggcatccgccggttttgatagataataatgtggaaatctgcacttcagaaggatcatgccattcgcggtgtacggtggctgctttatagatcagttccatcagaggtaaatggtaaatttcctcaatttcttctttagtccagttgtttctcaatgttgtttttgtatccattatcctatttttgttattgttaattgctttgcagcaaggtgtatagattccttatctgtattcatgatttccggaatctttataatttttgtttctttttcgataaaactacagatcactctttctgtatcttccgggaaatttccgttaagaattagatactccaacggtatttctctctgtcgtaaagctaagattgagagtaaactgtgattgatgcagccaagatagttccttacaaccaatgctgccggaaggcttaattcctcaatcagatcgatcataaaggtcgtgtctgaaatgggtaccataagacctccggctccttctacaatcagtgggttggctgttttggggagttgaaaatcattcagactgatggtgatattttcttctcttgccgattgatgtggtgatgcagccagctgtaaccggtaagtttccggatggcagacgttcgtatctgtccatgcttcaattttatgactgtctgtataatgcagatctccggactgtatgggtttccagtattctgttttaaaatgctgtaccaaaacggctgagcagactgtttttcctatttcggttcctattcctgttataaataatttcatgtttttcgtgatgcggggttcgggattcgtgatccgggtgttgaaagttttaaataaattctttaataattcctgtcagttttataatttcttcttcagtgttaaagctgtgaagacatattcttaagcgttcgcttccttcttttactgtggggctgtagatggcataggttaaaaatccttcttcagataaagtgttctgtaatgctttcagtctttgattgtccgggatcacaatagcctgaacaggacttgtttctgcggatggagactgtaaatttctgcttcggaaaactttgacattattcttaagcttttcagccagttcatggttttgatctaaaaattcatatccggttttgatactcatccactggaaatcctgtgctgacgtggtataaatgaaaggacttgcaaaattgatcaggtaagatttcactgtttcattgcaaagaatggcagctccgtggcttccaagagcttttccgtaagtgataaccgctgctggaacctgattctgtaattggaatttttcaatcaagccatatccaaaaactccgaatgcatgggcttcatctacaattaaagaggctttatatttactggcgattgaagtgatttcctgaagaagagcaaaatctccttccatagagtaaaggctttctatggcgatataacaatgaccttcctgtcttcttaaaatattttcaagatcttcagtatcattatgcttaaacttcagttttttagcattcgaaagcttacacgcatcatgtaccgaccgatgaatctgttcatccacaattactgtatcatgacggctgggaagcgttgaaaacaaagcaaggttggcattatatcctgacggaaaaagcaatgccgattcaaaatgatgtttccgagcaatctcattttccacggaaactgcaatatcactgtttccgctaattaaccttgaacctgtgcttcctgaaagcagttgaggattttccataattttctccagcaggatgttttgaagctgtttgtttcgagcaaatcccagataatcattggaataaaaatcaattccgtcagaacgaagtcttaaatgtcttaatgttccttcctcttttcgtttgtcaagggattccttaaaacgggaagtattgctaggcataatgtaattgggctacttcttctgtaatcgcattaatccaatctttatgcagttctttttctatggtcagaatatggtctgcatgatgcttccagtctggcgaaaattcattcagctgatgaatcatttcttccagatgtccttcttcttcaaggataatagattttaccataattttagaagatgcttcggtaagtgcttgttgataaaccggataaagttcatctgcccgaacttcgatcgcgtaggttacaaaaagataagcagcatatttaatatctgttttattaagttggaaagcttcctgaagataacggcaggctttaatatctaatgagtgaagatattggcttgttgctataggagccagaagttctgtgctttcataggttttgcataactcggggtttattttcccaatctgcttttttaaataataagcgtggcggtgttcttcagcagcatgtttcagctgaatctgggaaaccaatgtcgggtgttcacattttgatatttttctggcaccggcattttccataaatgaaagcgtgttcagccatttggcgtgggtgtttccgtcctgtacaattcttcttaacagatgatgaaattccatagatttttattttgatgtcaaaagtagtatattgccggatggttgcatggtgccagttttgatattatggatagtccggtcagaattccctatgaaagttttataaagattgatagaaaatctgagacttctatctatctacagattgcgaatcaattgatcaatgccattcagcgtggtgttttaccttttggaacgaaacttccgggaacaagaagcttcagcgagatgctggaaatccacagaaatacagcagttgcagtgtatgatgaactttctgcgcagggctggacagagagttttccgaataaaggaacttttgtgattggaaaagatcaggaaaaacctgttaaattgaatgattttaaacaaaataatcttcaaaactaccctgtttcaactggtttttcgtttaaaacatccaacattctggataatccttttgaacattcggattgtgaatatgtctttaatgatggggtgccggatatccgtttaacacaaatcggacaacattccaggttttacagttctattctgaaacgtaaatccagtcagaaagcttttggccattataatcatgacggaagtgaattttttaaagagcatttatcccaatatctgaatctttcccgtggacttcctatttccaaaaataatctgctcatcacccgaagtacggaaatgagcatttatattgtttcccagattcttctttccaaaggtgataccgtattagtaggcgctttgagctacttttcagtcaatatgatctttatgaaagctggtgttgatattgtttcgattcctattgatgaagaaggaattatagtagaaagcgttcgtgaggcctgtaaaaagcagaaaatccgaatgctttatcttacgccgcatcatcactatcctactacggttgcattgagtgctcagagacgttttgagttgctggaactggccaatgaatacggatttatcattctggaagacgattatgactatgaatttcattatgataaaagtcctattcttcctcttgccagtgctgatacgaacgggatggtaatctacattggatctttcgggaaatctctggctccgggattcaggacaggatttattgtggctcctgagaatttaatgacagaaatgcgtaaatacctggggattatcgaccgccagggagatattctgatggaaagagcacttggagagatgatcgctgaaggtgaaatcaaccgctatctgaaaaagtccttaaaagtatatcaggaaaggcgtgattatttttctgcattgttagaagaaaatcttggggattttattacttttcaaagaccctccggagggcttgccatatggctggaatggaatatcccactgaatctgatgcagctgagcaggaattgtgcgaaagacaatctttttattcccaaaacattattgtatcagaataaagatcttacggcaatgcgtctgggttttggtgatctgaatgttgaagagatgaataaaggaattgaggtattttcaaaaaacgttaaagaattgataagctgattatttataagttggaaaacgcgaaggcgcaaataatggccaaaataatgcgtttttaaggcgcgaagattttatcttcgataaaatttaatactgttatttttacttttgaatggaaaagcaaagaggttatttcaaaagtgtcattctgaacactgactgaaagtctgcgaacgtagttcatcaatgtagtgaaaaatctatcagtgagatttttctttcgtcagaatggcaaatgccatattattaatcttttgagataacctcttctcattattaatgatgagtaggaaaaactactttgtttttcttatgtttgggtttcttctttttcttattcaaatagatgataaaaccggtaatcgggagtgatagtgcgataaacgctgccagaaaatagataattctggtggttagtcccaggatacttccggtgtgaagatcataatttctttcttttaatgcggttccatatccgatatttttatttttatatgattgagattttaaaacttctcctgaatattgatcaaaattaaaatgttcatttctgtattgtcttccgtcataagtcagttctgcataataggttccgtcttccgatcgagggaaattgataagtgcagattttttttctttcaatcctttttccatggtatttccaatcagattgagaatatgtgtcctgtttaaaaatttttccgaaggaattatgcttttggctttcttttctgtgggaatgtttccgtttaacgtattctttacccattgatctacatcttcaaagctccatatcaatgcggaataagagattaagagtaaaggaataatagcatagaatcccagcacattgtgagcatcatagttaatccttttccaattggctgatgttttaatgaaaaacattcctttcagcatggctttactcattttgcggggataccatatcacaaggcccgatagaaggatcacagcaaatatcaatgtggaataaccggtaatcgcttttccgattttctcacccagcagaagtcttcggtgaagatccagtacaatttcaaaaaaatcttttttggcatcttctacttcctgtacttttcctgtgtaaggatctacgtaaatccgataataataaagataagttccccaataggtccatgcttcgttatccatttttaaggtacggaatacataggttcgtgagggatcggaaggcatcactacccttttgattttcaatccttcaggtagtgctttttctgctttttccgtgagctcagacaatgaaagtttttgtctgccaatattttcaacaaaatatctgttgggataaacaatatgttttaattcttcttcaaaagaaaggatacatccggtagctgccataataacaatgataagcccggacgtgagtccgagccatagatgtaactgataggcaatttttctcaactttaatttcatccttaaaatttaaagcttacctcagcaacgaaattacgaggcatctgagctacgataactccttggcctgcaaaatactgcacattgcccaggttattcattttaaatcctaatctgtatctttctttttcaagggaaatggaagcattgactaaagtataagccgggaatgcaaactgtccggtaaccactttatttccggtaatctgttttccaacacggtttaccccgaaaccaattccaagtccctgtagtcctttgatcggaaggatataactgatccatgaattgaatacattggcaggacctgcagattccggacggcgcccttccacagcaggatcagctttttcatatttgctgtgattgtagctgtatccggccataatgtttaatccctgaacaggattcatgatggtttcgatttcaatccctttacttctttgctttccatcctgaacaacaatattgtattcttttccgtcacggattacgccgcttcctctctggatattatccacaagaatatcgtaatatccaaccgtgaaattcactttatttctccaaagatttcctttaattcctacttcccactgattggccatctgaggtttcatttccccgctaatgtccggaagctgctgcgcaacaggtgctgtatagctgaaaccattcatataattaccataggcagataactggtctttaagaatctgatatacaatacctactttcggagaccatgcagtttgattgaaatcaccgttacggatattggtattaaggttcagctgccctttactttcgtaatgatccatacgtaagcttaaaagcgtaatcaaacggtctgtaatataggttacgtttgaaatgtaggctccataaagattggatgcagaattatttcttaccaaaggagctgtggaggtctggattttctgcagtacaagatctcttgtgatattggcatatcctgctaaagtctgcccgttgatgttgtcgtacaccacaattggggaatggttgttattgatcgtctgattcagataatccaatccgatcaaaactttatttttaattttcccgatattaaattctccattgaagttctgctggatgctggtagaagaagcttctgagttctgccactgtacgttacgttccaacatcgcatcacttgtatttcttctgataaactgatattggtataaaccttccgtttttctgaagtttcttgaaatcaaagtctgtgaagtccaatgatctgaaattttgtaattcgcctcagcttttacattgatcgaaggtgcttttaatgtaatatcattattagaataagactttttccagtcgaagcccagttcatcaggattatgggcaaaataaggtcttgttctcgcaaggaagataatcggcgtattggttccttcataattgtagatctgggctcccaaattaaatttcaatctgtcattcacctgataacttattgttggtgccacaaagaaagactttctgaattcggaatctctgaatccgttctgatactggtacgccgcatttaaacggaataacatatttctggattctgtcatagggccgtaaacatcagcggttacacggttcagattatagcttcccatcaggtaagaagcttctcctccgaaatagtcttttggttttttggttacagcgttgatcaaacctccgaaagaagttacggcgcctccatacaatgtccctgaaggtcctttaatcacttccagacgttctatatcagcaggatctatctctccgttggttgttgcgggaacaccgtccaccatcgatactttggtaggaaaacctctaaggctgtagtagaaacttccgtctccggaacctcttcccggacttccctgcatttttaccatacccggaacgtttttcaatacttccgaaatatcgtaagtaagctgttccttcatgatctgctggttgatgcttgtgtaagcctgtggattttcaagcactttcaaaggcattttagccactgaagtactgtctttatccaaaaatttatttctgctcaccgcatatacggtaattccttcaatcacattattgtgtaaaggagcgtagatcgcagggatttcatagacatctttctgaatttggatgggttccctcatcagttcgatatcatttaaaaccacctgaagcgtatattctccaggtggcacattttcaaagtaatattctcctaaattattggtttttgcctggtaaggcgtgttgacaagccttaaaacagcgttttttaccggtgctttttcagacagcatgattttgccatgaatcctgtcgccctgttgtgcagaaagcgagttggaagataaagcaagaccaagaactaatataagggttttagatgttttcatgctgtaggttttgtaacagaggataatttattttaccgttttgtgataatgggaatgattctatacgttctgtgcgtacatactgcgggttgatacgcagtttatttttaatggtctcggtgatgatctgaggatctatttccggattgtcatacaataccacgatctttttatcatgggcattcagacatacgaaagtattgccctgcatttcatttttaaggataaattctacctcatcgagattgagacgtatgccgaaaagcttcatgatccgttttattcttcctgtgatgtaatacattccgttttcaccttttctggcggtatctccggtatggagtacggaaggctgctcataggcagcaagatcttccagtttattggcatagcctccgaaaatactgacatgagaaaacagcaattcatccgtttcaggatcaattttgaagcttcctctttccaccacatttccgattgatgtttcttcttccagcaatccttctgtagtaaggtaagccattcttcctcctgcttcagtctgtccgtattgtgcaaagaattcttttttaaattcatggcagtaagagaaaatcgtttttctcaattcagcgttaatcactcctccggtatgggtaaaatacctaagacttggagaatcttttctgaaaaatccaattctgttcaggttttcataaagaaagggaactccacccaaagtactgtaaccgtattcctccatttcatcccagaatgctttctgcataatgtctttatccgtacacacgattcttccggcacgcatacagttggtcgtgaaaatagagaatccgtatacaaagttgatcggaacatttaaaggaactacatcagtatccagaatcggcatatactgaagaatactcaatgcgttctgataaaggctttcatcagataatttaaccagtttcggaacacctgttgtccctgaagtactcaaaaggattttgatgtcaggatgaatggtaacttcactcttataatcatcctttgcgaagatgctgatgttgtctgagaatgctttcagactgtatccttcaatagcttctctttgcggatcaaagatgtatttagggcgatattctgcctcaatgcgttctttgaattcctcatgcagtttctgccccagtaccgcaatggtgtgtgctgttccgtaaaaattgagcagcacttcaatacttgacaactgattgtcattgtataaaaagagcagccctttttcgacggggtttaagcctaaagaccggtacagtgttcccaccggtattgttgtaccggtggaagcatctgtaaacgccaggttcttattggcaattacattttctaaaattttcataggcttagttttctacgaatacttcgtattttttcattttttcgcgaatctttccgacggttcccatctccagaatatcgttaaaatcaaacttgatctgataaaactgttcaagcgcttctacaataagaagatgagacatagaatcccattccgggatttcctgataggttagtttttcatctaccaactctttctttatggcgatagcagaggcgataatttcataaaattcttctgtagtgttcattttaaatttttatagttttccattttccatttttaaaaatcatgaggaatagtacagccaaaactatttctgaagaaacgatagcagtaaatattcctctcagttcccactgaaatcttactcctaagagataagcaagaggaagctgaatgacataaaacattacgagatacagcagtgtaacctgcatgatatttccggccgcattcaaagcacggctgatcaccatggtgaatcctaacagcagatacgccatagagaccacatggatgtattgaaccgcatatctggcaacttccggttctgtagtgaaaaatttcaccacatattccgctgcaatctgccagaataaggctacaagtaccagatacgtcatattaatagttccggctctccagactgttttttcagcacgttcaggctctcctgcaccaagattctgacctgtaagaactcctgctgcatttcctattccccacgctggcatcgtagctaccgaagcaatacgctgggcaatgatatatcctgcaagtgccgtagttccgaaagtggagataatcttcaccataatcagccagctggatgttggaatgatatactgaaccaatcctccaaaggcgagtttcagaatcttttgcagcaatggaatatcaagctgtaaaggaactctgatgctgatgctggtttttcctgtggcgaatatgaacacctgatataaaacgcctaaaagccttgataaaactgtagcataggccaatcccatcaatccaaaagcaggaataaatcctaatccgaaaacaaggatcactgcaaagatgatattggaaatatggcagatccaaagtgatttcatggcaatatcggcatcaccagctcctctgaaaagtccattgacagagagacggagaattacaagtccgatactcaggaagaccagtcttgagaatgaaactccttcatttaccgtactggcattgattcccagaaaattaacgatttctgatgcgaaaaagcaggaaaccccaccaataagcactgcaaaaaacagagccagcaagatgatatattgggctgttcttcccattccttctttatctttttcgcccgctcttctggcggtaagggttgctgctgcaattcccaaacctactgcaatggcataggcaaagttgatgtagttatcggtaattcccacaagcccaagaaccttgtcacctaattttgcaataattaatagattgacgcttacaaaaacagattccatgacaagttccatcaccatgggaatggcaagactaaagatggaacggttgatacttccggaagtcagttcaactttctttcccgctatggctccatacgtaaaaaccgctccttcttttagtatatgcaggaatttcctcatactgctgctactgaatttttattggcaatctgatacagcggatttggcagtgctccgtcttttctcggaatggcaaatgccttgttttcactgtaaccgttatttttcagacgcagactgttgatatagaatcttttgaatgccggcacatacaggtcatacttttcgtatctttcctgaaggtgggtattctcagctttataattttctacacagttgtgaaccagttcccagaatgtttcttcattaaaattggaataggtatgcaaagcattcgatagatatctgaagaaggcatcaaaaaccccaagcaaaataaacaacggaatattttctttgttggaagactggatcagaccgtctgcaaggtgtgctgggagcttttctctggcttctgttgtaagtacaatatcatccacaaagtctttgattacgattctcttcggaactccgtttttcaaaacaaccataatattttccccgtgtggcgttacacataatgaatgcgtgtaatagatatgtaataaaggcgtaagataggcatcaagatagctttcaatccattctttaatgctcactcctgctttttcagcaaatgcctgaaccaatggaactccattttcatctacataaagtaaagaagccatggttatcatttgctcatcttctttcagatagttttcagcactttctctccataatgcgccaaggaattcattatactgataaggtacgctcgcaatagctccatattgtggatgcagataggtgatggcagcctcttctcctaagaaaatagtctctttgttctcaaggtaagcatcatctttaattaagccttttacccaatctgtaatagccggagcaattttcatctgtttaggtgataatcctctgatatttcctgtgctcagaatagaaacagccgttttcaggtatctcttttcaggatgatctacattgaataaagtacggatactttgctgcggactgtatgtatcactaccctcacccaattgaattaaaagtcctgaagcaatatctcccgcaaaatggatctgaagcttatgctcccactgccacggatgcacaggaataaagtgataatcttcaacaattttccctttgcttatcagttgctgtttaaattcattatacagcaagtctccaatttcagaacgataaaactcatctctgttgatatgttccaaagactggaatgatgatctgcttttatgagaagccagccagattacttttaaattttcatcggcttcaggagcaaatgttttaagatctcttggagaaaagcctaatcggcttttgtttacaattatccatggatgtccggtcatattgtgctctacagtttgataatctgcatccgcaagatcttttgaagatattactcctcttgataaaattaaagcatcacaatacagcgtatgtagtaattcttccgtgtatcttgcaatcgtataaggatctaaatcaaatacagactgcatttccaggaaaaaagcggctacatctactgaagacaaatcttcaccgttttctgtttttgtaatgctgtctttatcaatatgccagtaatccatcattctttcctgtccgcggaagctgtatgaaatattttcaactccggtttcaagggtaaaaacagtatatccgtttttattttcaaaggttaccacaggttttagaagctcttcatgcatcagctctgcgacggttttggccattaggtttctgttggcctgattccagttttcctggcttactgtattttttaagttggtgttcattttttgattaaattttggcagttggtaaatcagcatatttttctacatcgaaatcctggaaagcaattttcttttcaattttataatgctctcttcccagaatatcattgatgatgtaggaattgcggtaagcagccattccaagatctgtagaaatatagctgtgagtgtgtacttcagcatgaagcacatagatttctcctccgttgtggtctattgaataatttctgttaacatcaaacaatccgctggaatctctcttgattctatcctgaatattctttaagaatgcaggctcgtgatagcggtatcctgttcccaaaatcagataatcggcttcctggtcataaggaacttcctgttccagttgggtaaactcaagattgatgaaatccggattgctgttgtctactctattcagctgactgttaggaataattttaagattaggatccgcattgtcgatattcaaatcataaataaaatcgtaaatatcattgatcagatcgtaattgattcctttaaactgagcttgctgcttgcttaaaatggttttccttgaagattcacttctgttgtagaaatagtttacataatcaggggatgtaagttccagcgtcagtttagaatattccatagggaaaaatctgtccggacgggaataccatcccagttgtgtctcttcatttctattttgaagaaggtcataaaaaacttctgcggaactctggccagaaccaataatcgctatttttttaccctgagacaaaagctcttcttttctgtacagataagaactggtgtgaataacacgggaatcatcttttggaatgaaagaaggaatatgaggttgtgttcctgtacctaaaatcagtctttccgttttgaaaaccgtagtttctttggttttggtgtgaatcgtcgttacatgatataaaccatcttcataagtaatatccactacctgagtagagaaacggcattgtggaagctgttcaatcacccattgacagtaacggttgtattcttttctcggaatgaaaaaatcttctctgataaaaaacttatacagtcttccggtttctttcagataattcaaaagacttaaaggatttgttggatcagccatggaaacgcagtcgcataaaaatggagtctgcagggttacatggtcaatcatcagccccggatgccagtcgaaaccatctctctggtccaggaaaagggttttcagttccgaaattggattggataatgcggcaagtcccagattaaatgggccaatccctatgcctattacattgtatacggcttcgttagtcattttttgtgatgtttgtggtgatttgtacctccttattctgtgggaatttttcccagtaccattctctgtaacagaagttcagattggcttttttatgaggcatttcaattactttatctactttgaagcctacatgagctttgttcatcatagacgcaagcgagtctacagacccttcgcctaccatttttcctacctgtggctgtgcaaaaacatagtcaaccatagattgtgtcgatggagagacgaattttttctttggatcggtaggtgcaataaactggtgggttccataatcggtaggcagtacttcataataatcgcctacaatatctctgcaagcccaatacacctcgatattacatgaaggttcgtcattccctgcgatgatataactgtgtgcttcatcacttggaagaatcagtctgtaatacgtttccagttcatcaataggccagttcatctgccagatttttacggcatgttcacggttgaaccattcatgaagcatttctaggtcattttcaagatctataggacgcatactcatcgtcacatcttctttctgaaagtatcttttaaagaaaacctctgttccctgcggattgattaactgatccgagaagaaatgtttgtgaagaaggttcggaactttagcataagaaattgaagaagcatttacacctccgtctacatcagcaaccgccgactgaaggtttgattttactgcccaatatctttgattcaaagcataatccgttaataaggaaggttcagtgccatgaaggttttcaaattccctgtacaaaatatggattaatcttctttctttaaccaagcctgttttacctatggaagcaatcagtgcactcaggttgcttaccagaagatggtgagaaacaatatccagaaggcgctcatctctgatgaaaagatcttccacttcaggatagcctttgatcagagattcatattttcctttgaagctttctttgatcagatatccttgtccgtctcttacataaatagattgaggaagaagctggttatccaattgaataagcagattctgctgatgaacttcaggagccatccctaattgattgtataacctgtttaaaggggaaagcaatagatttacatacttttcaaaccagattatagctgctttttctgcatctacacctaattgattcgcaacatttttaaagaaatgtgtagtaaaattgaaaccatctgtagattcatcctgacaaagccttgccaatagaatcactttatcttcatttgaaaaaggattttcacggagcagaatattcatgctgtccatattttttccttcataatgaacgcttaacgtggatggttccagtaataatttaaacttcgggaaatcttgtttaaataaagctttttgatgctgccaccagattgcggaagcatagcctctgttgagatcttttaagctgtttgttctcacagagcctgtcattaaaacatgcagagagaactttaacatccagctgaaatccggattgtataccgttcttatggaagatgttgcataaaaatcttctcccaatggtccgatgtgaatgattttcccagaacctaacatttccggatattctgctgtggataaaagatattgtgcttcccatggatggcatggaacgatgtaaaaatcattgatgttttcaaaatcgtaactttccggtaaagaagtccatttttcgaagatttcttttgcagaaattcctggaagagatttttctgtaatacagtctttatgaatcaggaaataatccaactgaaatcctttcccgaattccggaccgtataaaagctgttcttcctcagagaatcccattcttgatttggtgaaaggatgcagattgtgtcctgccggaagcatttgctcagattcaaggaaagaataggtcaacagctgatcatcctgaagacaagcttctgttgtcagttccagatttcttaagctgctttgaattctttccacaaagtttctgaaacccgtttcgttggtagtttcggaaagttctctgtaaaccaattcagtaagcttttgatcattcacttcaaaaacttcttggttttgatgatctaccgcccacaaaacaggtccgtattcatgaaaaagagtttcggaacgataggaaaccggagcaaataaaaacagtccgcttttcttcatttcaaatctcataaacaatgaataatcactgttttgaagagcttttgctgtaagaagatcatatttcggaacgccctgatagaattttccgtttcccagttctctcagcattccgttcaacagaattctgaaagtaatttctctggctttttctcccgttctatttttctgaattaaagtcttttccataatttttgattgtggtgagaatctgatgaatgtcttccgtagtcgtaatcgggttcaggaacgtaaacttcagatagaagttgccatccactttggtacttgctacaaggatttccccgctgtagaacagtttcatcttgatatattgattcagtgcattcagatcactgatttccggtcttacatatctgaaaacaagaacgcttaagtcggaatctgaaaggagttcaaaatctgcatcttcagagatcatcgctgcagcatctttggtaagatcgatcacagtgtctgtatattctgtcagctgttctttacccatcattctaagggtaaaccaaagttttaacgcatcaaatcttctcgtactctgggtaatggatttattgatctgtgccggaatctcctcttcgtccatttctttcggattcagataatcggcgtggtgtttaagaatcaacagttcttttttgtttttaacaatgaaagcactgctgctgatcggctggaagaatgatttgtggtaatcaatcgttaccgagtctgctcgttcaatcccgttgatcaggtatcggtatttttcgctcaatagtaaagcacagccatacgccgcatctacgtgcatccagatattatagtgttctgcaatattcgcgatatcatccaatggatcgatatttccaaagtctgtggttcctgcggtagccacaataccgataggaatatttcctagttgctcttccctcttaatgtatttctttaaaagagaaatatccatacggaaacgttcatctgtaggaactttaacaatacttttctcacccaatcccataatggatgcatttttcagattgctgaagtgagatttatcggaaacaaatattctgaaacggcttgcctcggccggcagaccatccattttaatgttgtgattatatcttttctgagaaaaacaatcacgcatcatgaccaatcccattaaattactctgtgagcctcctgcagtgaaaacaccgtcgctttcattcgcattatatccgatctgaccggcagtccagtcgatcagttttctttccatgaaagttcctccggcactctgatcataagtatcctgtgaagaattgatggcgcttacaaggatttctcctgccaatgccggaatcactacagggcagttaagatgagctacatattgcggaaggtgaaatgctgtggcatgttttacataaatatcatctacctctgccagaagctcattataattggaaagtttttgattaaggtcgatctgttgtaccattcccttcattgttttggcttctataccactgaaaggtctgttgtttctctgaagaaattcctgaaccaggtctaaagtactgttgacagcattacgataatgatcataattgtcaggatggaaaatatttccaaaattccctgaaatgtggtgtgaatttgtgctggtgaacacttccagggatgttaaattattgttcataaatgttttttaatgtgatttttttaatctgtgagttgttgtggttttcgtgatatattatcttatatatctttaagtcagttttttaaattttgcattttttattatatttttatttggtgattacgtaattattactaaatttgactcgactattgttatttagaataattaaaaacaaagataaaaattattatttaacatcaaattttttttaatgaattctacacaaattttagataaagactgtttaacagcagtaaaactgcttcctacggtcatagaagtcacctctcaggagagaagaatgataaaagatgcggcgctgcatcttcagaaaaaatatgacacttatgaaaaccgggattttataaaacatgttcatcaactggcttcttattttcttccggaaaggattctgaatatagcagctgattttgcgagtgacttttctgaaaatcagtatggagcgctggtttttacaggattgatggagatagaccaggaggaaataggttctactccacccaactggcaatcggcagattattcaaagtttaatttatatggttttgcgtgtgcgcttattcatggggcacttccctcaaagcctgtacagtattattcacagcgtaaaggcggtggattgatccacgctattatccctgatgaaaaaatgaaggaaacgcagaccggctcagggtcttcaacggatctgtatgtacatacagaagatgcttttctgaaacatcaggctgactttttaagctttatgtatgtccgaaatgaagagcaggtaccttcaactctttattctatccgttctcatgagtctattggtgaaaagtacagagcactttttgagcctatttataaaatccctaaagatgccaatctggaaacgggagaaaatgaagaagaaactctggattctgtattgtatggcaataccaatcttccttttatgcgatttgatgcggcggaacagcttttcaattccagtatcagacagtcagaagaagcacagcatgcactgcatgagttctgggaagaagccagacatttgatttattcaggatttacgcctcaggccggagatgtcattctggttaataatcatttatgtgctcacggaagatcggctttccgtgcgggagtaagaaatattgacggtatagaacagccgtgcgagagaagaattatgcttcggatgatgagtaaagtgagccttattgatatgagagcacatacccttacagaagatcctttttttgtcatagaagaacatctgggtaaaaactttcaacatttttaagatgctgatgggttaactttttgaacattcaatcaatcaaaaacctttttgggcgtagctcaaaaaggtttttttatttattcctaacccgattaccctttgttaagtttcggctaaagccattaaaatttatatttatttattaaaacgggctaaagcccgcttctattgattgtttatgataaaattggcttcaaccaaaatttaaaaaaggcttattatttaaaaaacctgtcaaataaggacaattgttcagacaaggatctgctccaatattcaggaacgtgccctcccaaagattccgtgtagaggtgctggatcttcatttctgtcagttttttatgaaaattcctgttcatattgatcatttgagtgtcttctgtaccacaatcgaaaatatattgctgatctgctccggccatcagttttattttgctgtccgtcaggaaagcaggattcaaagactccaatggccccagaaccttatttaccatgtatttctgatagccttcaccgaatgagttaaagtccagagcaccgcatgaacttcccacaataccaaatgttttgttataagtaactccaatgttggttgctccataacctcccatactccatcccaaaattccacggaattttttatccgctttcacaggataatttttatcaatgaactctaccagctctttaccaataaacgtctggtactgggaatccttaacaatcgggctgtctacataccatgaactgtagtttccatcaggaagtacataaatggtttttaattcctgagcttttttaaccagatccggaatatcctgcttaatgattctgtccggatttccgctgaaaccatgaaggatataaaccgacggatattttgtattaggctgaaggtttggcgtaatgatcaccgttttgatctttttgttcattttcggactgaaaatttcctgatgaataattttttgtgctgataactgtacaaatacagtcattacaaatacaatgttgataagctttttcatactgaaaagtgtttaattaataatagctacaggtatattttcctaaacatataatataccaatgatctttagacaggtcaaaattgtgaaattaaaaaagggaaagcctcaacatatgttgaagcttttgttaattcttttaataaaatcagatcagtcaatgattagtatttccaaagcattaatcctgcctgatagcctgttcccagtgtccatataagaatataatctccttttttcaatgattttacttctttttgatattggtctaaagctaaaaatggactggatgctccggtatacccaagctctttagagtaaaaaggaattttttcctcaggcaactgaaagtaatcgcggataatattgatattcctgatagaaaactgtgaaaataaaaacaaatcaatctgctcaaggcttatctgattgcgctttaagaacagagggatattctccagtgcaaaattgacacttcccattccgtcgaaaatacgatcccaggttgtcagatcgccatgatgatgacgtgaatttcctttaggtgggtagagtacggtattacaaaaactgctgtctgtatgatataatacatctaataaccctgaggtgtcgtccccatcattttctacgataaaagcaaaagcagaatctgaaagacaaaaagcggtaatcgggttgtcaggatctaatatcctagaaaatttttcggcacaaactaccaaagcttttgttccggaccgggttcctttcaaatattttgatacctgatccagcgctataaatcctccaatacagttggcattaatgtcatagcataaggtattcggttttccgttaagcgcatgatggatctggatggcgtcacagggaatatgatgttcgggagaactgcttacaaaaataataacatctatatcgagaatagaaatattactttctttaagaactcctcttgcagcttcaattcccatagaaagtgtagtttcaaaggaattctcaggaacaataaaacgttctgccctgcctaaggcattctgaattttttgcattgaaatttcctgcctttcaaagtggtcaataacagctgtgttgttttctacaaaatcgggatgatagaaatacgtgtgatgtaatctcatgtctggtcaatattttatttatatctcttatttgtgatataatgtaaatttaacataatgatacaatatatcccagaaacatgaaataaatcactttatcgtttgattattaaaagtgtgtggtaatttaatcagtatttatctccattaatctcctttttgatccggctgagctgtgtaggtgtaattcccaagtaagaagcaatatgatgttgttttaacctgttataaagagaggtgttttcaagtagctccaagtatcgtttttttgccgtttcgtatttgagagaaacttccaggggttctttgtttaccacccagtttttttcaagataatacatatgaaaaagagcgaggtcatgatatttttttaataactcacgataagcttttgcaggatattgtattactgaacagtcttccagggcgataatattgaagtcgctgggttcatttttaataatggcggccgtagaagcaacaaaactgttttcctcgaagaagattttgtaaatattatttgcctgttcatcaacagtataatagcctatcaatcctgattttataaagtaataataccttgccatggtacctgattccagcagaaggtcattcttgtgatagtattcttctgtgcagatatccaataaatctttaatagtttcctcagataaaggataatatcggttgatctgttttataaattcggagtttttcatgctaatatccagaaagtatgagaaatattatgtaattatctgtgtcgtctgtgggtaaaaattaatccagtatttttttcatcataagatcggtctgctcttcttctcccagtctgaaaatgtgtttatcaaattcaacaaatccgtttttactgtagaaattgatagcccgaaggtttttctcccacacgccaagccaaaggtatgatttaccaagctgttgagccgtttccagagcctggttataaagaagcttccctacttttttcccgtgatgacttttctttacataaatcctttcaatttccagactggtctcatcctgaagctcagtctgcgcctttccggaattcactttcaggtaaccaaccggattgtcttcttcccaggcaatatagaaaagagaatcaggattattcaactcagactttatcttttcagtattaaagctttcttccagatactttttcatagcctcttcagtattatcttctgcaaatgtttcagtgaaagtctgtatagcaatattttgtaatgtttcgagatctttttctccggatttaataatgattactgatgacatattgtatatttattgttctaatttattaataagattttttatttccggcaatgtaagttctgtttttgcacctgtaactaaaatattttctaaaattgcgctatgggccgtttttaaagcatcttcgcttttgactttctgatcagggattactccaatatgttcccagttcttaccagttgctaaagaggttatttttcctgccggaacaagcagtaaatattgattccggaccataaagtgatctacaggattggcggcaccccctgtcgtttcacctattacttcagcaagtttattttgctgcaaaaagtaagctactccctctcctgccgaaaatgtctttttactggtaagaatatagatatttttatggaggtatttttgtccggtaactttagtctgggtactgttgataactgttttatgatcatgtctgaaatacgtggtataaagatctgttttctgatcaaaaaagtaacttaaaaacaaaagaagcataccgttttctcctccaccgttttctctgagatcaataatcagggcatgggtattcgccacaaaattcatagcagcagccagtgttttttcactggcagcgggagaagcaaagcctttgtaattgatgtaaccaatatttcccggaagtcgctgtactgtttcaaatccaaaattttcaagacggttgtgatcattgtttaacgcctcttcttccttctcgctcatctgttgttcaggagtatatttttcaagatatttcacaaaaaaatgttcatccttaacagtggttctcagtttttgggtgagaaatgctgcaaaatcatttttattgagtgggttaaacgttccttttttcaattcatcctgaaataaagaatctacttttttaaaggcgtctttgtcaatataatagtctttcaccttttttgtaatatcagaaagtacagcttgaacatcatttttctgcgcagctacgaataaggagataaaaaagcagaaccctatgcctatttttttcattgaaataagtatttaatatttcagcaaatgtatttcaatgaagttgatgggaattgtaaaaatggaaactcagataaacagccagatattatttttctcagtatctacatgctcaaagaattttccgggattgattctggtaagctctttaaaatctttaataagatgggactggtcataaaacaggttctcataagaaagctctgtaagatttctggtctttttatttgaaatcagtacatttcggaaacgctggatttttctgaattctgaagctggtttagcgaggtatcgccgggaaatcttattcacatactgccttgttattttatttttatctgcaatttcttcgatgctcatttcggtttcaaaatcattcaaaatgctgtaagccagctgtaaatctttctttatgaatttggaaaaccagtatttttccagcatttcaatttgtatatttctgtcagattcttttaaaataacattcatgctttctttaaaatcagaacaatgaatttcctgctgaaggtcatcgcttttagcggcatcataaaaatgataaattcctaatggcttgaagtaaaccgtaacttcattaacggattgctgataaagaatttcggtaggaacagagcatctgaatacaaaatcaatcacaatattctcagttgcagaccttctgatttctacccatcctttattctgaacaatagaaacatcctgacaagctgacacgataaaataattatccggaaatgtgaggtatctgaccggctgatggctgtcatctttttcaacaaagtaatatccttcaatatattctttaagaatgggatgtaaaggttgataaaaagtgactttcatactaaaggagtgaaggtaaaaaataaacagaaaacaaaatcctgaagcgtgtccaggattgtattatttatgaaaaaagaatcttcttaaatgcttcagaagccagatgtacctgtacgctccagtcgtctgcggcatcgcttcctgcatcatcagaaatatatttcaggcataaaaacggaatattttccttttgggcaatcaatgccagtggataggcttccatatctacaatattataatcggtttcggaatggttcatttcaaaactgtcgccgctaccgcagatgccttctttcaatgcatccattttaagaccgtattccaatacaggtggcactccggataaaggagtttcatataatttaaatccaagccctcttacatccatatctctctggatgaattttgtgcagcataccacttcacctttgtgaaatcctttgcttccggcagaacctaaattaacaatcaatttaggctttctggcatgaatttctttggttagttctatagcagcattcacttttccgatgcctgtaattaatttatttttatcgtcgaaaacggttcctgcttcagaatctaatgcaaaaacaaaaagggtatcatcaattgagtaatgactttcgttgttaatttttatcattgagaaattaggtttatacagctgttgacattgtattacaaagatacaataggttttcctttttttgcattaagaacaataaatattatataacatacaataaacaaaaacaaaggaatcttgaatgcaaaataattaaacttttctatgggagtttgcactatcctgctcataatgggtgaaagcatcatcataaaacttaaaattgttatgggtactttatttttccatcttgtaacattaagtatagcacctaaaagccctgatatagcaaaaatttgttctatattccagaaatcaaaagcagtaaatagaagccaaaaaataaatggtaatcctatcatttgtcccattaaaataatgaacaggtaagaaataattgaggtatatttaaaaatgttaatgttcattttcttaaatattaaaggatttcattgaagtctttcaaatatataaatattcaaatatatacctaattaaaaaccccaaaacaaatatttgttttggggttttcatattttaaatactgcatccatcagcatcgcatgctgctccactgctaccggaaagatctttaaacggactcaccgtttctttataggtttgctgaagtgcattttcaaatacttcggcaggctgtgctcctgaaacggcatatttaccattcagaacaaagaaaggaactccggaaatcccattgtttcttgcctcctgaatatcctggttgacttcatcatccagttgatctgttgtaacagcttctctggcttcatctttatcaagtccaagactttcagcaagagcaattaaaacttccgtatcacctacatttttaccgtcaataaagtgagcaataaataatgcctcttccatttcattggatttgttgtgcttcttagctaaatgaagcaatttgtgagcgctgaaagtattggtgatcaaagtttgtccaaaattaaaatcaattccggctccttttcccatttgggtaacctgtcccagcatttgagtagcctgagcttcggcaactccttttttctctctgaaatattgaagggtatcctgagttttgttcggatctaaagttggatccagctgaaaacttttccattccacttctacttcatctttaaatggaagtttacttaacgcctgttcaaaattattttttccgatatagcaaaacggacacattacgtccgaccagatttctattttcattctattgaattttaaatcaaattaatcatacaaatttactacaatttatttaatgtaacaaaaattattacatttagtttttgtatctcaataagtaactatcagcgttctaaaatacccattaaaataaataattatttccctatggcagctttatttactttttttgaaaacaaaatatgcgcaatcagacccaatactccaaatgtagtacctacaaagcatacaccaccccattgtgccttttgccatgcaatagaagccagccaggttcccagcgatccaccaataaagtaagataccatataaactgtattcagtctgtttacggcattggatttaagtaaaaaataattggtctggttcataatatggctggattgcactcccaggtcaacaagaattactccgacaataagtccccagtaggtttctcctgcaaagtaggtaaatccccagcttccaatgacaatcagcagggaatacaatataatccggttaatatcaagatatttttgcagttttcccacctttgcagcagccaaagctcctaccgctcccgccagtccaaaacttcccactacagaagaacctgcattgaaaggcggtttctccatatggaaaaccaatgtcgtaaataaggcacacatagacccgaaagccattgccccacggaaagatgccagctgaagaaccggctgggttttcgcaagatgggcaacagaacgcatcagttctttataagttcctttaaagttcggaggtaactcgggcagcattttatagacagccacccaaaccagaatcatcagtcctgctgcaataccaaacatcgctctccagccccacacttcaccaacaatacctccgataaaacgggataaaagaattcccagcagcaatcctgacattaccaatccgatattgcccgatttttctttatctgatgaaagttctgctgcaataggtacaaaaagctgtggaataacggaagttgccccgatcagaagacttgctgcatacagcatccatagctgattggcaaaagtcatccatacaagtgatccgaaaacaagaaataaatcaattaaaattaattttttacgaaagaatttatcacctaatggtacaatcagtaataatcccaatgcataaccaatctgggtaagcacagaaattttacttgctgaactctcagaaatctgaagttcttctgaaatgagggccagtagtggctggttataataattattggcaacaacaagtccggaaataatagccattagccagataaccgtccgggaaataccatgggtagaactctcctgcattacgtataaaattttgtttgaaatgaatctttctgacgtttgattttatagggtcagattttttaagagatcaaagataatcattaaaaaaagaaatttcccggtttaagacttcacattttttataaataatccctgaggctatggtaagtagaatgatttcaacaggctgccggatcattgtttttattcatgatatatattgatgaaaaaccttttacatattggaattattaaagaaatttgcagcatgaaaatcattccacttaaagaaggtaatttttcggcaagcaaaaccaaggattttacacttttaacagatgaaaattttgatcaggttggaggaattaaaatgtctgtacagccttttctcatcattactgaaaatgattatattcttctggatgcagggattggctggaaaaatgagtccggtgcaacggtaatttctgaaattctggaaaaggaaaatataaatcctggccagatcactaaattattattttcccatcttcacaaagatcatatcgaaggagcggtaactcttaaagataatggttttgaagcaacttttcccaatgctcagatttatatacagaaacgtgaactggattttgcgatggaaaatgaaggcaatccttcttttgattttgatatgctggaaaaattgatccagctgcccaatattatctggatgaatgaagataaaggtcagattacagatgaaatttcatatgaagtggccggcgggcatactccgtttatgcaggttttctggatcagggaaaatgaggaaacggttttctatggtgccgatgatcttccacaggcttcttatctgaagtatcatctggcttataaaagtgactttgatggcaggaaagcaatggaattaaggcttaaatgggaaaaagatgcacgggagaaccactggaaaattctgttatatcatgatctggatcaggctgtcatagaactttaaacaaaaaaatggtttaaatttcattaaaccatttgtagatatcaaattccgaaggaatattaagtttttttctgatcctgtttttcctgttttgtatggctttgggcgttacaaaaatacaggttgcaatttccttggtggtcatattgagcttaagatagatacaaaagatcagttcagagttttttagcgaaggctgtatagcagataactttttaaaaaaatcaggatagacgagtctgaatttattcagcaaacgtggagaatttgctttggccagtgccataatttcgtcttgtacaagaatcttttgattcaaatcctcaatattcggttcagtttttttgtttttcataatactttctcatctctacttatttcaaatgcgacatcttttgcgcatcagtacaaagtctttttttctctgatctgtgttttataggttaataatggaatgaaataatttctatatagttaaagttttcacattttcaataattataattcaatagattgcaatatttaagttgtattaagttaataaatgtgttaaaaaaaaatctacttgtgaatttgtatcatttttaccttggcaaagaaagaaaaaatgattaaaatttaaataaaaccgcgtaccacatagataccacgttatttttttaagcaaaagatcataacagcttttatcagccagtttcccattatttgcaatgtacttctgacgggttgtaaatgtagctgattaccgttatatctttttatgatctcaatcaatattgttaaaagaaataattaaaaaaagtgaatatgtgtggtatatgaatggtaccacgttgttcaaaaaataaataaaatccatgttcctttattttaagaaaatttttaaacaagaatagtacgaatgttcatttaaaaaattaaaataaattacaatatgatcattgaaaatttattgatttcatttggtgccgaaattaaagattataaggcggaagatattattttccgggaagaagagtctccaatgtattattaccagattgaaaaaggtaaaattaaactcaataattatacagaagacggaaaagaatttatccagaatatcttctcagacggtcaaagtttcggagagtctttattgtttgtggacagaccatatcctatgaatgccgttgcaatggaagattcaagtgtattcagaataccaagacagaattttatggacctgatccgcaataatcccgaagtttctttaagtgtctatgaatgtcttgcggaaaggatgtattataaatacctcatgttgtataatctttcttttcaaaatcctgtatccaagctgaaattacttatggattacctgaaaagttatcatgaggaaaaaacgccctattcttttcaggttccgcttacgcgccagcagcttgcttcacttaccggattaagggtagaaacagtgataagaaccataaaacaaatggaaaaagatcagatggtaaaaatagaacgccggaagatctattattaaaataaaagccggatgtactccggcttttattctattttgtatgacaatattctgcccgctcctattgatcaagctgtctttgaaattcttccaggtatctggcaatatgaatcccgtctgccaatccatgatgtgcttcaacagaaacaggaagatattttctgccgtcacggatattgaatcttccaaaagcaacttttggtacagattcttgtgtattaaaatcagtaggctgcaatatcgcactgaaagagttccagggaatagtggtatgtcttacatgatcctttcccagtctttcattgcttaatctcagtcccgaagtctggtgaactccttttatttcctcctgcaaagcagcattaaatgtttcaaaatcctctgaataatgggtgaaagaaaaaccgaaagttccatccggtcttccgatggtactgccggcatgaaccgtgtcaaactgtacaacctgcccgtcaacgattctgagttttaattcatcaactgtattgatcgcgaccatagacttatgaaaataataggcaaaaaaagaatatcctttttctttggctgtttcgtatgcttttgtacagtctacttctgttgtaaatccaaaataaggacttgccatattagagaaaaattcaaaatgttctttcctgttccagttatctatgtctacaatcttcatgaactcttattttttgcaaatttctgaaagtttctccggtttaaaaaatttatgactgaaaatataattaaaacttaacgttacaagaccgttgtttggtagacattttgcagcaaaaacaacacatatttgcagtttacttatttgctgcataactcttttttattcaggaaattgacattacacactatcgaattaacaataaattatacaatatggcaatggaaaaaatcggatttatcggattaggaaatatgggacatcctatggccaagaaccttgaaaaagcaggctttcagctatctgtttacaacagatctgctgaaaaaaccacagattttgaggaaaaatcatccgtctgcacccaaattaaagaccttgtacaaaacagtgatattatattcacaatgcttaccaacgataatgctgtaaaagcagtgtatgaggaaattctccctttagatattcagggaaagctcttcgtggatatgagtacaatttctcccgaaacctccacggaaacagcagcagctctgaagataaaggaagcttcttttattgatgctcctgtagcaggaagcactatgcctgcaaaagaaggaacgctcattattatggccggaggtgaagaaaaagacatcgagcgggccatgccctaccttttgaaaatgggaaaatctgtaaaacatctcggtgaaaacggaaaaggaattgcaggaaaactatcagttaattattttctgtctgccatttatcagggactggcagaaactgtattgctggccggaaaattaggaatcgagcggtctgatatgcttgaaatcattaatgaaagtgccagcggaagcggtgcaacaaaggtaaaaacaccactgctgattgcggatgaatacgccccggcctttgctcttgatcttatgctcaaagacattcttctggctaaaaatgccggtgctgattttcctttatcagaaccattgattcaaacgtatcaaaatgcacatgacaaaggctttggtcaggatgacgtaatagggattatcaactatctaaaaacaatagaataaaacatgctgatatgaattataaaggaaaacattggtctgccagaaaagcagatcaaatgtatatcgtaagtattgaaaatcattgcaacattgtggagacactaactgattttatcagggatcagaaaattcaggcgggagaagtaacaggaatcggagcagtaagtgaagcaacacttcgtttctttaatccggccacaaaaaaatatgtagataaaacctttaaagaacagatggaagtcaccaatatttccggaaatgtttcagagatcgagggaaaactgacgcttcaccttcacattacactgggaagagaagattacaccgctttggcaggacaccttttagaagcaaaaattcagggagccgcagaatttattttctatccgttgaataccagagtggtaaaagttaaaaaccaagaaacgggaatcaatctttatgattttgaaaaataaatcgttggaaattgtcgattggataaatgctttacttaaagttcaaagtttttgaaaatgcaaaggcacaagatttaattcctgtgcctttgtatttattttaaagttgtgctttttaatggttgcattaaacttcagtagtggtcattccgaatttctttttgaatgaagaataaaagtgcgataaattctcaaaacccagatcaagataaatatctgaaggtcttttatccctgttttttattaaataataggcttccttcaatcttttttctttcagccattgtttgggcgtcatccgaaatgttttactgaaatctctcttaaaccctgaaagactgcggcctgtaagctttgcaaaagtaccaaccgacacattgaacataaaatttctgttcataaattcttcaagatcaattttatgaggttctgagaaatcaaaaagaagatttttaaaatcaggattgctcagtaaaagcagctctatagcctcctttacctttaaaatggccagttttggaggtatctccttagtcttattgatataaggaataagagaagcaaaatagcttttaaaaaaatcatcaggctcaaaaaataatcgttgatctcctggaaatccagtttgcacctttattttgttttcagcagcatattgtctcaatgtttcatcgtcaagtgtgatagatacaaactgatatttctccttggctgaaggatatttgaccgttctgatcagctggtttttcctgaccagaactactgtattttccttaatcactgtttttccgtgttcatgaaaagcatgtgtttcccctgagatctgaaaccccagaaaatgatccgggataaactcttcatgacctctgtaggattcaaaagcacatgaataaaccagtttgtcaaatatgatctcagtaatattttccatgatacaaatatctgaaatttaagctatagcctgcgctcctgcttctgctatttccttatcctgttccggtgttcctcctgaagaacctatggcaccaataatctttccggatgtattttttatgacaacacctcctgcaatagtcagaagtccttcattcgaattcagcattccataaccatgaatacctgtttcagaaataattcctcccattacctcactgtttactccaaacatcactgctgttttagcttttttaacagcaaaatccatcactccgcagacactgtccagtcttgccagtgcaacaagatgacctccggcatccatcacggcaatacttacaggaatattcataaataatgctctttcctttgctgcatttaaagccttttcagcaagttcgtaattcatttccatagcactagctttttgtgttccatgcctctgcctgaagctgttttacaaaatcctcagtttcctttggatgtacatttctgaaattacattggtcatctaaagctacatttacaatcacttcagccatagactgcggatcaagttgatgtgctaacgattcagcagcaccatcaaaagcagattccggggtaaaattgatcttcggatcataccaatggaaaatagagtctactcccctgtcattaaatccggttccaaatacacccggattgcaggttgcaattttaatattaaacggagcgagttcagttcttaacccttcagcaatagattccagcgcatgtttggaagaacaataagctgcaacataaggaacagtccacaaccctcccatagaggaagtaaaaacaattttaccactcttcctttcaacaaactttctgataaagccctgtgcaagattcaatgccccaaacacattcacttcaaacatggaacggataatatctaccggctgttcagcaataggaccgccttccataattcctgcgttgctgattaagatatctatttcatactttttcaggatataatcaatatctttttggctggttacatccagcttatccactgtaagatcaattccctgttccttagcctcgcggattaaatcactcatttgaggataaacctgtgcggtagcaattactttatggccctttttagcaagatcaaaagcagcaatctttccgaacccgcttgctgcacctgtgattaaaattgttttactcattgtattcttttttaatgatgatacaaatttcaaagatttccacaagggtaatattgcctgaaagctcatttttatattgctggaaagttcataaaaacgaacagaggatgaatagctttcaaatagttcctcttctaccttataaaaatacaggctttttcgaatcgaagcagctttttttaatctcttttcatactttcaatgattaaaaataaacggattgttgtaaattggttaagtttttgaaggtactctacaaaaccagtcacaccattgaaattaatcacatttacaaaaaaaggaatttactgtccccagggaaaattttatatagacccctggcgacctgtagatatggcggtcattacgcacggtcatgctgatcatgcccgctggggaatgaaaaaatacctgtgtcatcatttcacaaaacctatccttcatcagagaatcgggacggatatcgaatgccagagtatagaatacggagaggttgttaccattaatggagtaaagctttctctgcatcctgccggacatattatcggatcagctcagataagacttgaatataaaggatatgtaaccgtaatttcgggggattataaagtacagaatgatggactcagtacccctttcgagctggtgaaatgtaatgaatttgtgacggaaagtactttcggtcttcccatttacaactggctcgaagttccggatctaaataaaaaacttcagaactgggtactgaaaaataaagaaaataataaaacatcagtcttcattggatattctcttggaaaagcccaacggatcatgaaggctgtggaagaactggggaaaatatatgttcactattctatcggaaaacttaatgaagcttttgaaactgtgggaattgatcttcccgaatacacaattgcagatttcagggaacgtcccaaagaagtacagcatgaaattgtcattgtaccgcctgccttactggacagcaatatcatcaaaaagattcctgatcctgctacagctatatgttcaggctggatgcaggtgcgcggtgccagaagatggcggagcgcagacgctggatttgccatgagcgaccatgccgactggaaaggattattacagaccgtaaaagccaccgaagccgagcttgtacatgttacccacggacagacagaagtattttcaaaatatctgaatgagatcggaatcaaagcagatgttgtggaaacattatttggagacgacgaggaagaatccgaaaaagaaacccttcaaaccccggaatcatgagacactttgcagaacttatcaacgcgttggaaaccaccaataagaccaacgctaaaattgatgctatcattgattacctggagcgtgctcccgatgaagataaagtatggtttattgccttgtttaccggaaaaagacccaagagaaatgtgaataccaattacatgaaagaatgggcacttgagattacgcaacttccctactggctgtttcaggagtcttattcttccgtaggagatcttggagaaaccttatcattgatactgcctcctccgcaggaaaaaatcgagcgttctttatcagaatggatgaatgatattgttaatttaaaaagcaagacggatacagagaaaaaagaatttgtactgcagtcatggaatggcctggattatactgagcgtttgattttcaacaaattaatcggcggaagtttccgtatcggagtatcagataaaacattaatcaatgcgctgaccagattttccggtcaggaatccagtgctttaatgcatagcctgatgggaaaatggcttccggatgaagtgtcgttcaaagagcttattgatgcagaaaatgttaatcccgacaattcaaagccttatcctttctgccttgcctatcctttggaaaaagaacctgaagaacttggaaatcctgatgaatggctggtggaatacaaatgggacggaatacgcggacagatcatacggagaaatgatgaagtcttcatctggtcaaggggtgaagaacttgttacagaacaatttccggagatcagggaagttgtacaggcaatgaaaggcaactttgtgctggacggagaaatattggcagtaaaagatggtaaggttttaaatttcaacgaactacaaaaaagattgaacagaaaaactttaactaaaaaaatgctgtcggaaatcccgattgaagtttttgcctatgatcttctggagtttgaagataatgatttgagagagaagccgatctctgcaagacgtgctttgcttgaagaactattattgaatgaaaatcctcagaacatcagcatttccaaaagcctggagtttgaaaaatgggaagaattgaatagcctcagagaaaattcaagagaagtaaacagtgaaggattgatgctgaagcaaaaacactctccttatcattccggccgtaaaaaaggtgactggtggaagtggaaaatcaatccgtttaccattgatgctgtgcttatttatgcccagaaaggaagcggcagacgaagtgcttattataccgattatacttttgccgtgaaaaacggagacactttagtaacgattgccaaagcctattcaggtcttacggataaagaaattatggaagtaagccgctttgtgaccaaaaatgcaattgagaaattcggtcctgtaagaacggtaaaagctgagctggtattcgaaattgcttttgagggaataggtttcagcaaccgccataaaagcggtgtggcgctccgtttcccgagaattgtaagatggcggaaagataaaacagtagatgaaattgatgatttggaagaaattaaaaaattaatacaatagattttaatgcaaggacgcaaggactttttatgatagcgtaatagtaaggcactctgctaagctatagtaagatattgcctttgctgagtgagacgcccttatgatcggaaaataaacaatattaaataaaaacttagcgcccttttgcgttaaaaatttaaataaaaatagaattggcagcttttgaacatagcaacggattaaagatcattcagcaatggatgaccgataaaggcattgccccttttaaatttcagctggaaacctggaaaaaattcggaaacggatatagcggaatggttgtggcccctaccggattcgggaaaactttttctgtctttttagcattggtttcagacttcctgaatcatcctgaacaatacaaaaaaggattgaaaatgatctggatcacaccacttcgctctttatccaaagatattgcaaaagcgatgcaggaagccattgatgaaatcgggctggattgggctgtcggcgtaagaaacggagatactgatcccaaagtgagacagcagcaggtaaaaaaaatgcctgaaattcttgtggtaactcctgaaagtcttcacttacttctggctcagaaaaacaatgaagcctttttcagggatatgaaatgtgtggctgtggatgaatggcatgaattactgggttcaaaacgcggtgtcatggtagaacttgcggtttcacagctcagaaaatacgtcccgaaggttaagatctggggaattaccgccacgatcgggaatctggatgaagccatggaagttcttattccttatgatattaaaaagacaaaggttacggcgaaagaacataaaaaaatagatattctgcctgttttcccggatgaaattgaaattttgccatgggcaggacatctgggaaacaaacttgcagataaagttgtcccgattattctcgaatcaaaatccacaattgtctttaccaatacaagaagccagagtgaaatgtggtatcagcttcttttggatgcacatcctgattttgccggccagatcgccatccatcacagttcaattgatgcgcacctgagaatatggattgaggaaaacttaagttccgggaaattaaaagctgtggtttccacatcctccctcgatctgggtattgattttaagcctgtagacactgttattcaggtaggatctgccaaaggagttgcgcggtttctgcagagagccggacgtagcgggcactccccttttgaaacctcaaaaatatattgcgttcccacccactccctggagctgattgaagtttcagcattaaaagaagcagtaaagcagaaagttgttgagcccagggaaccccaggttctgtgcttcgatgtattggttcagtttctgatgacattggctgtaggagacggtttttatcctgatgaactgtatgaaagaatcaggaaagtatatgcatttcaggagatgctggatgaagaatggaaaagtatcctggaattccttaccatcggcggaagtgttttaaaaagctacgaagaattccataaggttgtcattatggaagacggactttataaagtaacttcaagaaaaatcgcgatgcttcacaggatgaatatgggagtgattgtaagcgatgccatgctgaaggtgaaatttatatcaggaggttacattggaatgattgaagaatattttatttccaaactaaaaaaagaggaaaaatttattcttgcaggaagaacactggaagtcgctatgatcaaagatatgacggtgtatgtaagatctgccaaaggaaaagcgctggtaccaagttatctgggcggaagacttcctttaagttccaatctgggacattttttaagagaaaagctttcccatgcattaaatcccaaagcatcagaaaaagaacttaaatttcttcattctttattaattaaccaggaaaaaaattcccacattcccaaagaagatgaattcctggtggaattgattaaaaatcgtgaaggataccatttatttatgtatccttttgaaggccggctggtacatgaagtaatggctgcattaattgcttaccgcatctctaagctggctcccatttccttttcgatggcaatgaacgattatggatttgaattgttcagtgataaggagattccgcttaacgacgaaaatctgcaacagattttaacccgtgataatctgatgaatgatgtgattgccagcatcaattctgccgaaatggccagaagaaaattcagggatattgccgtaatatcaggaatggtgattcaaaattatgcaggacagcagcgctccaacaaatcgttacaaagttcagcagggttaatttttaaagtgctggaagaccatgacgccagtcattttttaataaagcaggcctatacggaagtctttaatatgcagcttcaggaacaacgtcttgtagaagcttttaaaaggattgaaaagtctgaaattattttaaaacattcccgttcgtttactccgctcagctttccgattaaagtggacagcctgaggcagaccctttccagtgaagggctggatgcaagaattaaaaggatgctgaaactctctgatataagtgatcttttataatcaattaatatgttttctgtaagaccagatatgccgatgaatatttgtttatcgcaaagacgcaaaaattgataataataacgttttaaggcgcaaagattttatctccgataaaatttagtcacgttaatcttgctgaaaatctttgattttcttacgccttaaataaaaatggataatataaaatttgcgcctttgcgagattttaaaatttataaaatcaaataaaaaacctgtctttttaatcttattcatgacttaatattctgagttaattttcttgataagttaaaataatcatcgtaacttacagtaaagctttacagaagtttaaataaatgtaaataatggaaaaattattcttggtccgtcacggacagtcactctggaaccttgaaaacaggtttacaggctggaaagacatcgatataacagaagccggtattgaagaggcaaaaaaagcaggacttgctttaaaaggagaaaggatagatatcgctttcacttctgccctcatcagggcaaagcacacactctccatcattctgaatgaaataggaaatcccaatatcccggttataaaagataaagctctgaacgaacgttcttacggaaatcttgaagggttgaacaaagcagaaacggcacttaagtatggtgatgaacaggttcatatctggcgcagatcatatgatgtggtacctccgggtggcgaaagccttaaagatacatacaacagggtaattccttattttgaaagccagataaggccgttattaaaaaagggcgaaaatgtactgatcgttgcacatggaaatagtctccgtgccctgatcatgtatctggaacatctttctcctgaagaaattctggaaagagaaattgctacgggctttcctctgacgtatgtttttgatgaaaagtttcacgtaagccggaaagtaagctgattcggttaataaagcttacctttgaacattaaatcaattcatacagcgtgtttatagctaccaaaagcatttctattcagaacgaaatttttatcctaaccaatcagcgtgccgcattctgggaaaaagaaaaggcacttgttctttctgatcttcacatcgggaaaactgctcatttccgaaaaaatggtattgcactgtctaaccatattatgaaaagcgacctggaaagattatctgcactgattgaattttttcagcctgaaaaatttgttgtggtcggggatttactccacgcaggagacaattctgatgtagatgagttctgcatatggaaatcacaatatcctgaaatacaattctatcttattgaagggaatcatgatcgcttatcaaaagctctggaagaaaaactatgtttcaatcataagtctgagatgctcgagataggagatattacttttattcacgattttgatacaacaagaacgggatttcagattacaggacatatccatcccggaattgtactgaattctgctgttaaaaatatcaggcttccctgctttgcgctcagcagcgaccaattattactgccggcttttagtgaattcaccggattggataccaaaaacctgcctaagaaaagtaccttttttgtcttcacggatgcggagatttatgaaatctgatctatctctgaccatagatccgtgctaagattttaagtcttagcacggatatacatcagataaaactatccctgaaatcttaacctttcttactcaaacggatactgtacagtgtgatcagtacggtaatcaccagaaataatgcaccgatccatggtgtgcttgctaatcctaaagatgacgtcacaataattcctcctgcataagatccgatggcaataccgatattaaatgctgcaatattgattcctgaagcgacatcttctgttccgggaagttccttttctgcaatctgtactaccaacagctgcaatccgggaacagaagcaaatgataatgctcccagaaggaaaagtgtaatgatacttaaaacaggactgcttaccgtaaagtaaaacgcaaataataccaatccctgagccgcaaacatccataaaagtgccttaagaggatttttattggccactttcccgcccaggagattccccagggcaatggcaattccgtagatcagcaggatgaacgtaactgttgattcctgaaatcctgtgattttctgtaaaatgggtgacagataagtaaaaactacgaatgttcctccatatcccattgctgtcattagaaaggcaaaaatcaaacgcctgttccccaatactttaaactgacttcttaaagaagctgatttcccgtttttcagggtgttgggaaccagcaataaactggccgctaacccaatgattccaagaattgaaactcctataaaagttgctctccatccgaaatgctgtcctatgaatgtacccagcggaactcctgttacaattgccagtgtgagcccggcaaacataatggaaatagcagtagccctcttttcttcaggcaccagagaagccgcgatggtagagcctatggaaaaataaaccccatgagcaaagcctgtaagtattcttgccagcactaaagttataaatccgggtgctatagatgccaatccgtttccgataacaaatagcagcatgatagacactaatagcatctttcgtggaacttttcctgttaatgccgttaatatcggagctcctatcgctacgcctattgcataaaggctcaccagtaaccctgctgaaggaatgctgattccaagatcagaagctactgtaggaagcaatccgacaattacaaattcagtggttcctattccaaaagcacttatcgttaatgcccaaagtgctgcaggcaaaccttttttaatagtttgtgatgctgtattgacctgtatttctttttgataattcattgtcttgtattttgttgatattgacgaggcaaatttccggcgaataattgtattataaaaattatttaaattgtaataaattatcagaataatgatagttttattttacacttaaaatttgttcctttgcagaataatcagaagttttaatgaaaaaatcagaagcaacccgccttacgattctccagaaagcgttcgaattgatctatgtaaagggttttcagaccacaagcattgatgaaattatcgcaacgactcaggtgaccaaaggagctttttattatcattttaaaaccaaagatgaaatgggccttgctattattaccgatctgatgaaacctaatttcaaaaaaacttttattgattctcttcagaacagcaagaaccctttggacagcatctatgatatcatgcaccatcttcttatggaaaatgattttctgaaagttgaatatggctgtcccacttccaatttcatacagcaaatggctccttggcatactgctttcacacaagctttgcacgatctttcaaaagaatgggagttggctcttgctgaaagtatcgaaaaagggaaagaatctggtatcattaaaaaagaagtcagtgcaaaggaagtcagtgtttttgttatttcaggctattggggcgttagaaatcttggtaaacttgagaattcaaaagaagtatatctcacttatttaaaaggacttagatcgtattttaaaaccctgcaataatttttttattcaaaaacatactagttagtatgtttttattatacctttgctgtgttcaaaaaaataaacgatgtatcagacccttacctttttacattcccaaacccgatggctggttttactcagtctgatttatgcaattttccgtgcttttaaaggttatttttcagaccgcaaatttacaggagctgacaattcagtaagacattggaccgctaccattgctcacatccagctgattctaggaatggtattctatcttaaaagtccggtaatacaatacttctggaaaaatttcaatgcagcaaaagaatcttttgaacatctgtttttcgggatgattcatatttcattgatgattgcagccattatgatcatcacaataggctccgcactggccaagagaaggcttactgacaaagaaaagttcaaaactatgggaatctggttctccattgcactgatcattatttttattgcaatcccgtggcctttttccccatttgcaaacagaccttatttcagatagattatgatagaattattgaaaacaaaaatcggccggttaagaattctggcaattctggaaggcatttcattactgagccttgtatgcattgccgttcctgtcaaatactggatgggaaaccctttacttgtgcggttattagggcccgttcacggaacattattcctgctctttcttttcaatacgctgagtgttggtgtagaacagaactggaaattcagagaaataacatggaaggtaattcttgcctgtttcatcccgtttggaacattttatattgacaaaaaaattctgagcaagctatgaagagccttatcatcatctgtggaatagcctttatactgtatgtcgtatacagagtttaccggtttcagactttagatgacgatcttcctcaactgctcaggaaaggagcagttatcctggatgtaagaactgaaaaggaatatgaaacgggacatatcgaaggttctgtcaatatttcactgggaaccatcagagaacgttatgtagaattagacccgaaaaagacatacatcaccgtttgttctcacggactgcgaagtgtgaaagctgaaaatatactgaaagaaagaggctttaaacatgtttataacggaggagcgtggagtgatctccagaaaaccatcagcaagtaaaatcatttaatccctctgtgattctcagagggattgaatttttaaactgttttatcatccagccatactactttctgatcagataaatgctcctgccctattatttctctgtataattcaggtcttcgggctttaatatatcgatatcctcctgcctgggtaagcttttggggagtgatcaatgcagattcaaaactgtcttcccacgaacggcattctgcaatcacatctccgaagggatctataatcatagagcatccgtttttcagctggtcatcatccattcctacagggtttgaaaaaactatatatatcccgttatcataagctcttgccggcagccatttcattaaccagtctctacccttcatcccattgaattctaggagtaaagaagtaggatctgcttctctgttttcccagagctgagaatctacaaaaccggctccgggccttgtagaaggagtacacattgttacgtggggcataaagataatttctgctccaagcaaccttgtagcccttacgttttcaataatattgttgtcatagcagatgagaataccacatttccaacccatgatatcaaatacacaatattcattaccaggtgtaagatgaggattaataaaaggatgcagttttctgtatttagccttcagtccggttttatcaacacatacatacgctttaaaaaggttatcatattcatccttctcgaataaacctgccaatatggtaatgttattctgagctgcaatctgttgtaatttccggatactttcaccttccggaatacgttctgcaatattcaaaagctcttctctggaaagctttcgggcaaaagtataacctgtgacggagcattcatgaaatgcaataacatcagatccttgagcagaagcctgctgagccagtttttcgatgacagagagattgtatgctttatctccacttttgttttcaaattgtgcggttgaaattttaatattcattgtttttttaagcaaagctagacgctgttacttttaaaaaattgtataaaaccgacatgctttttacaactcaatgaaattaactgccattttattttctgtgttcagatattgctttggagtaagcccggtattgtttttaaactctctgataagatgcgactgatcagaatatcctgtttcgtatgaaaatgttgccatatttttatgatcagcacttctgtttatcagacttaaaaaataatgcagccggataatattgctgtatttttttggagacattcccatatgaaattcaaatttcctttccagatggcgttcagaatatccggtgaatttttccagatctccggatgttaccaaacctttgttctgaagaatatattgttgtgaagcagcaataatttgatgatctttattcatgctctcagacagaaaatgagtaaaaaacaaattcagatcattgataatatgcaaagggtttattttgttaaaaagttgttcctgaaaagtttgcagtttattcttcaacacatcttccacagaaacagtctgattagaaatctctctggcagatgtatttaaaataatattcaaaaaataaggttgaaatacaacagcaataagggaaaatttatcttttgaagaaaaatctttatatccgtttaaaactccgtaaaaaaaagaaagcggcatcttatctccggaaataccggaatacagattcatatcgcctgataaaataagcccggagctgccatcagtaaacagccttagacttctgattgtcttttcagaattttctaagaaaatataatgcctgataaaagcagccaaatgtttaggaggtgaaatctgcatataccaaatgtacataaaacttgccggcagaaaaactgtttttgctattcaaatttcttacaagggctgataagataaaagttatcgtttttaaacctccaataaatattttatgattttgaaagaaatcaatcacaggtaccacattttgtttctttttggtcaggtatttgaaagacttaagcaaattattcatcattttgatgtataaacctcttttaattaacattaatcacttaaaatatttaatatgtcaacagaaaatcttacccacctggaagcgatcaaaaagattaaggaattatcagaaagtgcaagaatatgcatgttctgtacagaactgggcactattcctgtcaattcaagacccatgacccttcaggaagcagacgacagcggaaatctttggtttatcagcagtggaacaagcaataagaattttgaaattaaagaagaccgcagagtacagctgttttttatgaataacagtgactcccaatacctttcggtatatggggaagcttcggtttatagggacaaagcaaccattgaagataaatggtctcctatggcaaaagcgtggtttgatggaaaggatgatcccaatgtaaccattatccgcgtagaacctaaagaaacttattactgggacactaaggcaggaaaactcgtaagcctttttagttttgtagcagctgcaatcaccggaaaaaaaactgataattcagacggtgtagaaggaaatgcaaccatttaaaaaaatctggatagcaataaattttctcacagattttattgcaggaacacaaaaacggctcaagaaattgagccgtttctataagattaatgatgctgatttttcacatcttccaaagatgttccaaaattaatatgaaggacattgccgttcggggttaataaagccggtacagactttacccctgcgtgctcagcgtcttcaattttgtttttatcatttcccagatggatgatttcaacattttccaaacctataagattaatcatatcatgctctgcactgatgcagacaggacatcctgcatgataaaaaatggcttttttcataagattatattaattactaagtgttttaataatattttttaattcctcagtttcctttttatcaagcggctttaagggacttcttaaatttcctccgttttccccaagaatattcagtccagatttcaccgctctcggtaaacctttgctgacaataaattttaaaaggtcaaactgctgatagaaaatttcttttgctttttcaagatttccctcttccactgcatgataaagactgatattcagttccggaataagattgggagcagccgtacaccaacctcttgctccggcagaaaatgcagccagcgccaaaggattagaaccgttgtagaaggcaacgtcttctcccagttctctactcagataatgcatcctctgaacatctcctgtgctttctttaatcatcgttatattgggaatttcaagcaaccttttcagtaaggccggtgacatatctaccccgcttgttgccggattattgtaagccataatcgggatagaaattttacgtgctacagcatcataatgcgaaacaatttcgtcgtctgtgagtttccagtagctcataggaatgatcataacggcatctgctcctgctttttcggcaaactgtgcatggtgaattgtcttttctgttgtaagattggaaactcctaccagcgttggaattcttccttttacctgctgcaaagtagcctctgtaacttcttctttttcttcatcagacagatagggcattacccctgtacttcctaatggcgcaatgccgtggcttccggaagtgaccagtctttctacaagatgtttaaaaagaggaatatctactttttcattattgtcaaaaggcgttatgggataggcgataatccctttgaatggaacatttttcatgtttttttgatttacaaattgaaaataattttaacctcttaccttaaaggtctctgccttcctcttctcttaatgcgactcccaaattctgcagctgaggagcattttcgcaggcaatgtatttggcgggttctgtatcgctcaggttctggtgtttatgccaggcccatgaaggaatatataccgcatctccggcttcccaatataccctttcatcttctacttctgtccagccttttccttcaatgacgaataatacggtttcatacgtatggcgatgtctgttggtttgctggcctggaagaagtccgccgatcgtcatgctgacattcttactgggaagatctacaaagaaaaccggatgcttcctttctgttgaaaactgattgtgcacaccagcattttctacatttttatgaatcaaatggctgggctttacatactttggtcttgcaaaagtttcgtgaaagtctttagaactgaattgtttcttgtccataatttaaaattattaaggttttgtgctttattgcatgacaaaattattttatatttggactgtttaaatgattcagtttttacataaacagatagtccagatgttacgaccttggaaattagaattagaaattgataaaaagcttgatcaacccgtttatctgcagattgccgataccattatcagggatatccgttcaggaagactgaaacccggtgatgctcttcccgggagcagaaatcttgcccaaactttgaagcttaacaggaatactgttgtagaagcgtatcaggttctgatgaatgaagaatgggtgatttccaaagaaaggaaaggaatttttatatcagaaaatcttcctgctttacatgagaaaaaaacaggcagaatacaggactctttgaatcaggagatgatttccagtggaatgctaatcaattttgatgacgggcatccggacagtaagattgcacctgtaacagaactggcaagagcttacagacagattttcagtatcaaagctaaatggcagatgatgggttatggaaatgaacatggcgatgttgaattccgtaaaatgatttcccagatgcttaatcatcagcgtggaatgcacattcataaaaatgaaatttctgttacccgaggcagccagatgggaatgtttctcacagctcagactcttttaagtcccggcgacattgttattgtagaagatccgggatatcagcctgcatggcatgcttttgaatatgccggtgcccgacttttgccggtacctgtagatcaggaaggaatcagtattgaagctgttgaaatgcttctgacagaacatcagaatattaaagccatttatattacgcctcacaggcaatatcctacaacagtcactttaagcctttccagaagattaaaattaattgagctttccaatcagtatcatataaccatcattgaggacgattatgacaacgagtttcatttcgggtaccgtcccatccttcctgtttcaagttttccggagcttcacaactatgtttatatcggaacattgagtaaagtggtagctcctgctttgaggattggttacctggccactaaaaatcagaaattactgaaaaaaatcggtgatctgagaaaaattattgatgtgcatggagatgttatcatggaacaggctgttctacagctgatcagagaaggtgccgtgaaaaagcatatcagaaaagcaactgttcattataagcataaaagagattttgtttatgagctgttaaaaaagcatatggcaggtattgcagatttcacattgcctgaaggtggacttgccttttggattgttcctaaagctcaatgggattgggatgtggtaaccgctcttttattggagaagaatattaaaataatccatccgaaacaatacagtcagaataagattaacggcttcagactaagctacggagccctttctgaagagcagctggaacaaagtattcctttgattgctgaagttttttcgaactcttttaaccattgatttcacagactacaaatatctcacaatcaaaaatcaaataaaaattgaagatttttaaacttatataggcttttaagcagtatatctgtagcttaaaatcaacttaagtgtttttatcttttgtgacttttgtggtttagttttaataagaactattccacttcaaaaatagcctgaatttccacagaagaccccacaggaattgatgttgctcccaaagttgccctggcatgttttcctttttctccaaagatttcaaccgttaggtcagaagccacattcataagctctgcatgttttgtataatcctcttttgtattaaaaattcctgtaagctgaacacattgttttactctgctcaaatcccctcctacagcttcattcaatacagaaatgacgttcagcatggtaacttttgtagcttcttttacctgctgttcatttacttcagcacctaatttcccgggattgaagattttgccgtctttcaaagcaacctgatttatgaataccagatttccggagcgtacaaaaggctgataatttcctgccggttttgggacctgcggaagggtgatatttttctgtttgagtatttcagcgaagttctgatgatgctctgcaacaagtgcagctcttttcggacgggtatcttttaatgccagcgctacctttgcaaagtttttcccttgtaattcggcaatattccgctcacctttggtcggtctttcaacatcttttaaagaagccatacttgttactcctaatacggtatttccctgtggaatagctttgttcagctcttctgtcccacggatgccgttaggcaccaatatcattccgtgaacggcaagactgttccagaatgcctgcatggccagctcttttcctgcaccacttcctgctgacataaaaaccgaagccggaacaccttctaaagcatgattggtccaaagctggacggttttagctaaaaattcactcattcccgtactgatatttccgaaataaacgggcgaaccaaaaacaattccgtcataacctgtcagttcgtctacggttgccaccggaagatttttaaggttaggattttgtgaagatttgaccattttgatataaggaactgcattattttcactttcaattcctttagcaatttctttggccagttcatacgtcccgccattatctgaatggataagaaccaatatttttgttttattttgtgccataatgatgttgatattagtgaatacaattaaaataaaaaagagacatcgttttttcattctgaacgggataggttatttttaatactttattgcagtacaaaattagtattggcgtttttattaaatttgccaaaatatacatacaaaacgacattatgaaatgcggactgattgaaaagacggaaagccattttatcgattctattgaaaaagaggcttatatctggtgtgaaaaaaactggaaacatgatgattatgaacacaggcatagccgtgctcagctgacttttgtggaagaaggataccagtatttccatatcgacaggaaaatttatcttgtcccacagcatcatgttatctggattccttcagaaaaaggtcataaaataacttctgaagcacaaacggtgaatctgatggtatttttgttcaaatccgtttttgaagacgaattttataagaatgttcaggtgtttgccgctcctcctgtattaaaggaaatgcttttatatgcttcaaaatggaatcaatcattaggtgaaaatgaagaacaggacgtgttttttaaagctattttaaaaagtcttcccaacttttgtaaggaaagcaacagtctggaaattcctgtacctgcagatacaaggctgattcctgtatgtaatgaaatcaatacccattttaaatataatcttgatatcgattctctggctgaaaaagcacaaatgtctgtacgaagcttacagagaattttcaaaaatgaaacgggaattaccttgcaaaaataccttcagttgacaagaattttaaaaagtatcgaactgattgacaccagacaatatactttaagtgaagttgcttataaggttggctatcagagcctgtctgcatttacttcatcctattttaccatcatgcaggaaaagccaaaagtcaaaaaagatcatggtgtctcgtcatgaggcatatcaaccggttttgattcgggagaacctttttcgcgaagccatatggataaaataaccagtgaagctacagcgagaaattcactctgccagttctgaaaagactcaaaccagaatcttgattctgaaatatactgcattgccgttacggcaggtttactgttcatcagctgttcatcattaaaatccttaaggcttccatagaaatgtaaaataaagctggccaggaaaagaatggcaaaagcaatggataaggaatgtttatagagtttcagccatattcctccttttttgacgggccatggtgctttgggatgcggtacaggctctttgtcaacatcttcctcttctgtcatggatttcgactcactggagcctttctgtctcagagaaaccgttagcaaaacatagagcatcatctggagaaattcgctttcccagttttcaaaagttgcctgtataaaatggccgctatgaatatattcacctatctttaatgcaggctgtccattttcaatgagttctttgttttctgttttccagcccataaagaactgtcctgcaagaaaaataaccatcagggtaatcagaacaatacttaagctgttgcgatacaagaaactggtgcgtggcatatttctaagtttttagtttaaaattcaaggtttaagatttgagatgtagcatttatgaatcatgtttctgataagggaagactttctgcagatttttggttgtcggaccggtaagtattttcccattcacattgaatctggaaccatggcacgggcagtcccagcttagctctgcactgttccaccgcacttcacatcctgcatgcggacaggtacttctcagaagatgtaatgtaccgtcaatctctttatataaagcataagattctgattcgtaccgtataactttagcttcaccctcaccaatttctgaaaaggactctattttatctttaaaaattttatcttttacgaagtcaaaggctaccgctgcattttctttcacaaaatctgagaatccggcaacaggcttgattcttgaagggttgaacaaatcaccgtatttactttctcctgtaacaatcagatcatgcaggatctgtgatgaaagtgttccgaatatcatcccgtttcctctgaaccctgtggcaacaaaaattcttcccttactgccgggaagttttccaatatacggaagaccgtccaccggctcataatattggctggaccagctataatacactgtttccacatcaaagtattctctgacataattttcgagccttgaaaagcattctccggtatcttctgcatgtcctgttttatgatcttccccacctgcaatcaaaaggttttcaccttcaatattctgaatacggtaataatgataaggttcacagagatcgtaaccaagcgcccacggatagcggtcgtttttcagagtaaatgccatcgcatagcttctgtaaggtgcattcgtaaaatgaagaacattcactcccggtggtatgtgggttgcataaacgatatttgcggcttttatttctccttttgaagtttttaaagtaacatattcttccttctcatcatgatcttcacagagacagttttcctggatggaacctcccagctttataaaagcctcacaaagtcctttgatgtattttatcggatgaaaatgtccctgtccgggaataactactgcttctttgaacggtataggaaaaggagtttcattcacataactcatttcatggccaactttatcagctccttctacaatatttttcaattgttcctgttgcttttcatccagtgcaagaagataggctgattttctggcaaaatcgcagctgatgttgtattgtcgaatgcggtcttcaataatttcaatagcatcacctccggattctgcataaagtctggctttttcaagaccaaaatccctgatagcctcgttgaaggtagtatcaaaaaaatcatttaagtgagccgttgttcctcctgttgttccaaatccgatattcgcagcctccagaatgatgcatttctttccggattcctgcagcttcagcgctgttgacactccggtaattccgccgcccactatggcaacatcaaatatctggctgagatcagtttctgcagaaaattttctgacttcttcctgccatatactttttcttgcaccgtctctgtacataattatttttttttcagttaaacttacctgatgttcagggtatcgctttcagggattcctgttttagcagtagtggcatgattgttcttttgatctctttttctgttttcgtcttcgtcaagattgcatctgcaggaagtaaaagtaaacaggcttaaaacgcctaaaataagtgctgttgttttcataatgtaattttttaatgttgagtatctatccgttcacaattaaccctccattgggatgaagcacctgtcccgtaatctgcgaggcatctttactggccagaaacagaaagctggaggcaatttcttcaggagtggcatttctctcgaacggaggtttgttggggttttcttctttttcgtcaaatgtttcttcagtaagcggtgttgctacagggccgggcgcaacggcattaatccggattccttttggttttgcctgtaatgccagtgagcgggtaaaagaaacaatagccccttttgtagcggaataatcaagaagctccggatggccctggtacgcagaaaccgaggttgtattgatgacacagcttccttctttcagataagggaatacgaccttcgtcagtaaaatcattcccacaatattggaatcaaaggtttgtcttatattcttttcctcaagatcttcgatcctgtccgcaggaaactgaataccggcattattgatgagaatatcaatttttccgaataccgagatcacttcctttactgtttcttcacagaattcatagtcgttgatgtctcctttgaaaataatgcattttctattcagcgtttcaatttctgcttttgtttttcctgcatcattatcgctggagtgataaataatggcaatatctgctccttccatggcaaaaaggagcgctacagccttaccgattccactgtcggcaccggtaattaaaacagatttattttttaattttccgatcataccgttatttattatttttccaatgtgggtttttgcatttcatacattctgtgggcagccatactgtcgctggaaatattagccatggcgacggaaagtttattttttaagcccgatactattttatcatctccgttcatcagagcattgtaaccgtcaatagccacttcttcaggagaagcgagattatctctgtcttcaagtattttacttgtgttcatatccgctttattgaagaagtccgtgtctgtaggtcccggtaaaagtgccgtcactgtaattcctgagtcttttaattcttcacggatagcttcagaccatgataatacaaatgctttggtgccatgatataccgattgccatggaccaggcgctttactggctacagaagccagatttaaaatttttcctgatcctttgggcagccggtccttcaaaaacagtttggtcaatatgatgacagaaatgatatttaactgtataatgtctacttccctgtgaatatcggtatcctgaaattttccatagacaccctgtccggcgtcattaaccagaatttcagggcttatcccattcattttcaactctgaatacagggaataagcttcttcttccagaaaaaggtttttggagatgctgatcacattcactccaaaatttttaaattcatcagacttttttttcagctcttcatgatttctggccacaataacaaggtcatagccattcttggcaaacagtttggccagttcgtagcctataccgctggtagcacctgtaatgagtgcaaattgattcttgcgatccatacattttattttaagattaaaagtctgttcagctcacttttaaagcagcccaaaatgaattccgtataataaagctgggcattcagggcttgtgttttgggatgaagctccagttttttagtcaggataatttcacctttgtaagagaatgagaaataggcgaaaattttatatccggaattgcggatcggtgtgcagtagcctgtggtggcgatagaccagtcggactcataaagtctggctacattcaatgccatggtttctgcaatattttctgaaacacaatcgcattcttcggcttcctgtctgttgacctttagcagctttactttttcctgcaaagaataagctgtcatacctcctttataaaacatagaggcattcggcatctgtgaaaaagccagctgtaaacatcctgaagtgacactttctgccaatgaaatggtttcatctgtggtcatcagtgactggcttatatattcgagaagattcttctgaaaatccatactattaattttaagtaattgattgataattgtatcaaaatcctgtttatttccacgggtcaagaacgacctttacacatccgtcttcttttttatcaaaaatttcatatcctctgcttacttcattaagagaaaggcggtgggtaataacatcatcaagtgtgatttttccggtcacaacataatccatgagttgatctatgatgggatgaacattacattggcctgctttaatggtaatccctttgtcaaagatctgtccaagtctgaaattgtcataattgacaggatacactcccagaacagaaacaataccacccctgcggacagcgctcatgcatgcttccagcaccttgattgagcctttttcaaagttcaaaacagcttttgcccggtctataaagctcctttcgggttcaaagcctacggcttcaatacaaagatctgctccgcgtccgtctgtcatatccctgatcttttctatcgtgctttccgcatcttcccacaaaatggtttcgcatcctgtaagcgttttgatacggtcgagcctgtattgaagggtatcaacaacaatgatcttctttgcattatacaagacagcacttttggcagccattgtgcctacgggccctgctccgaaaatgacaacagtttctcctcctttaagttctccccacatcacgcctgtataaccggtggggaaaatatctgtgagaaataaaacctgttcatctgttaaattgtcaggaacctttctgggaccaaaatgagcgtagggaactcttacatattgtgcctgtccgccatcatatcccccatacagatctgtatacccgaataaagctccgcctttatctttaaaaatacctccttccggtccataataatcggggttactatgctcacaggcagtaggaagatcatgctggcagaagaaacagctaccgcaggcaaccgggaaaggaactacaaccctgtcccctaccttgagatgggtaatgttttttcccttttcttctacaatacccataaattcatgtcccattaccatgggtcttgcctggggaattcctcctgaatacatgtgcaggtcactgccacaaatagcagtggaggttactctgaggataatgtcattttcatccagaattctgggatcttctacggtgtcacaggtgatgttacctggtgagtgaaaaacggctgctttcataatgtaaatatttaaagtgattggtgttggtgtgaagggtgttttatgattacgcgtttctctccgtttcaagatcccagactctgtgctgagcaattgcctggatgaatttatctgcaggattcccgtcttcccatgtaatgattccggggtcctcatgctgttttgttgctacgttggaattctgatacaggacttctgtatcttttccgaaataaatggctttacaatgtttataggcttcgttgatgaaatgcagtacctgatgtttgttttctgaagtcataagctcctttacagcatcttctcccggacagatggcaagagcatcaaagcatacgcttgcaatactcgtaagagagtgttttggtatgagttcagaactgtcatttaatcttaccggagcaacacttggtgctatcagttctactctggcgccctctgcttcaagctttgttttaagatcattcaccgctccgccatcggcaccattagccaggataaaacctattttacggcttttgattgtattttttaccgtatgcgccatgctcagtgcaccggaaaattttgtgtcaggttctctctcttcgctctgaagttctataatattactgtctgcaggcaagctttggttaggccattccagttttttgacttctacacctaatttttctgcaacgctccatgcaagagacatatcaatatatgccagctgacctaccagtctttctctgatttccggacgggttacttttgacagttcaaagatcaatgcattctgaaggtgcattttttccggtgttgactggctgttgtagaataatttagcctgagaataatgatctacgaaactcttgcttctttctctgattttcactccggaaactctttcctgctgagaggtaaatccaccttcagacatcattgcctgaaaagggcatcctccaccgatggaattcggttcataactgctttttcctttgacaatctgttgtctcatatggccatccctctggttattatgaacggtattaagggatctgttaatcggtatttcatggaaattgggagagcccagccttgacagctgagtgtcggtatatgaaaataatcttccctgcagcaacggatcattggtgaaatcaattcccggaataatgtgtccggggtgaaaggctacctgctcagtttcagcaaagaaattatcaggatttttgtttaatgttaaagttcctacaatttctacgggaacttcttcttcgggaactattttggtaggatcgagaagatcaaaatcaaatttgtgttcatcttcttcaggaatcagctgtacgccgaagtcccattcaggataatcgccgttttctatggcttcccaaagatctctcttatgaaagtccggatctacccctgaaatcatctgggcttcgttccaggctacagagtgtacgcctaatctgggtttaaaatggaattttacaaaatgtacttttcctgcctcattgatgaatttaaaggaatgtactccgaaaccttccatcattctcaggcttctcggaatagctctgtcactcatcagccacataatcatatgcatgctttcgggcatcagtgatataaaatcccaaaatgtatcgtgagccgatgctgcctgtggaatttcattatccggttccggttttacggcatggataagatcaggaaatttgatagcatcctgaataaaaaacaccggcatattgttggccactaggtcataattcccttcttcagtataaaattttacagcaaatccacgtacatctcttgccagatcagtacttcctttgcttcctgcaacagttgaaaatctcacaaaaacaggtgtttcttttcctaattctgttaaaaattttgctttggtatattctgcaaggcttttggtaagcttaaaaataccgtgggctccggaacccctcgcatgaactactctttcaggaattctttcatgatcgaaatgggtaattttttccctgagaataaaatcttccagtaatgaaggaccacgttctcctgctttgagagaatcctgattgttattgatctttaaaccctggttggtggtcagtttttcattttcgttggaagtgctgtgcaggtcaagctgttctgcttttttgttgtgttcgttggttttcatattcataatctttttttgtggttgatctgtttttcaaaagcagttaataagggggcgacagaattaatctgttttattttccagaatttcaaggaacctgttgatatattcttcctccttcagaaccttataataagccgttttggcatataaagtgaaagatggagattcaaattttatttcagtatccatttcagcggttcccatcgtatttttagtatggaattcccggatatgaaggaggtattcatttatataggtgtcaattgtatgtttcaggatatcacatttcgcattatttttaatcttttccaaagacttgatcagaaaagcagttactccgtaagaattgataatcggcggaaataaagacgcattctctattgcattatttttatcattcagcccggaatgttgtaaagtgtcgttttcaaatatcatattctaaaaatggtattagttgtgaggagcttttaaatattgctcaaaataatggaggtcgtttttatctttaatggacagataaaacatgatctgttccggttcttttaatccaatactgctgaagctgtcgaaatgggcaattagtgcctgaatattttcaatatcaatatctttcagaataatgaacagaagaaaaatattttctctgatctctttggcatacactgctgctccgtcttcaaaacacttccctgtgtgaggtatttttataaaatctttgtgtctcagtttttttattatgttctgacagtccatatattttgatttcatagttaaaaataagccacatagaacaagctacatggcttattgcatgctttaatcttcctgttctgcatcaaaattgatggatgtttctgcaatatcggtaagcagggaatcagtatcttcttcttcctgaagtgttctttccagaaggtctgctgccttatcgtgccccatggtaatggcaagctgtgcaagtccgccgtaggtggcaatttcataatgttctactttctgtgcagcaataataagggcgacatctcttgttgcagagccatcttctgtggctttgatgacttcttcgccttcttctataattcctttgatggccttacactcttttttttcaggcttctcgtcaataagctggaatactttttccagacgtttcacgtgtttttgggtctgaagatgatgatcctcaaaggcatctttcagctcttcagtagtggctgcttcctgcattttctccagagcatccaggatggcattttcagcaaaataaatatctttaagtgcactcacaaagaattggtgaagcggtgaacttttcatttcgtcttctttcacagttggcttatctgcagttccttttttagtagcagaaacagcactattggtttctaatattttatttggcatggtatgaatggtgttttgatattaaaaggattacctctttatatatttaaagaggcaatcctggaaaaagaattatgaattacgtctgcctccgaatccggaacgacctgaagatcttccgcctccatgggaagcctgacctcccattctggctattcttgtacgttcagctttgctcatagatgcgaaacctcttcttgatgttcccgaacctgaatttgagccgcctcttcctgagctgctgccattatttcctgatcttgatgagcctcctcttcctgaaccagagttagaagatctgcctccaccatgtgaagcctgaccacccattctggcgattctggtacgctcagctttactcatagatgcgaaacctcttcttgaagtaccacttcctgatgatgacctgcccctacctcctgatctggagccggaaccagaatttgaacgtccacgggaaccaccaccggagtttcctccacgagatccgcctctaccggaagtaaatcttccctggctgtctctttgctggtttccgtttcctcctctggaacctcctcttcttccgccgctgcgtcctctctgatcatcatcgtcatcatcttcttcgtcatcgtagtcttcatcatcctcatcataatcatcgtcgtattcatcataatcatcttcatcataatcatcgtcataatcctcatcttcatcaaaataatcttcgtattccgaaaagtcatcatcgtaatcttcatctcttgaggcatcattaaaaccatgatcatagcctaactggtaaacttcttctaagttttccggtgaatgtgactgtcctcttgaactgcggtttcttgaatttctagtgttcataactgaattttttattattaatatttagtgatgtgtattgcagtccgtgactagtattagacggcaacaagttgggtgtcggtaattttaaaatgataataaaagcaaatgctttttatgttccttttactaaggtcttaagaattggattgaaaatttatatttcaaatgtacatcataataattcacttttttatgacctgaatcatgttaacgtagattaatacaaatttttctttttaaattctggttcttcagtcttgtgaagatttcctgagatgccggattcagcatcatattgtttgataattgcaggaatgattttatctttcatccaaaagtttttcaggaagtctggctcatcaaaaagacttccagacttttcctaattcaaaaaacatttcttataaagagttttactttttgctgagatattattatctgaaaatcttttgggtctgatgtattagtcttctgtacatcttgaacagaaggctttatcacattcactcagcttattatttcaatagtcttatggatttaataaaaaaaatcacaaaataatatacgaaactgtttctaatatagaattttgcgattttcaattctcacgattttatccttctccatatgtttgatggtccttattgcggtttctacacaaagaccggtaagactagccatctgctgcctcgttaatggaatcagaaatgaatatggacgtgcatctttctgaaagctcttcagataatccatcaagcctctaagcctaatagacggattttgagatgagagattctgcatcatgataaatttataataaaggcgctcagaaagaaaactgcttacttccatgcataattccggattccggttcagcagatttaaaaaaatggatttatgaagccttaaaacagtacattctgtaatagcctctgcattcatcggataaggcttatctatgaaaagtatagattcaccacagctttctccatcggataaaatgttttgaataaattctttcccttcttcattataattattaagttttatttcccccttaataatctggtaataatagttggggatgtccccttcaaagaatatagtttctgaagggctataatgtctcgtttctgctcccgctgaaatcaaaatattttcgtcgataaccataatagttgtttttggtgttgttttcttcttctcctcttctttagtcttagtaaaaatatcattgggaactgatggtagtatgtatgcaaaaattgcacctttatgattgtttatgaagttaaaaaaagttaaaaaaattaataaatgtaaacctattttgaattattggttaattatttttattaaaaattaatttaaattaaacttttgataccacattttgaagttgtaatttcaactacccgaaaaaatattagaaaataaaaacccgtttagtttgattaaaacgggttttttcaaaagaataacagaaaaaaccgttattttcttggagatttattgttagaggttcttgcagtatctgcgtgtttttttgtagaaactgtatccgtacgcattgtatctgcaggaaccggagccataggggtaacattggagacggtgtctgtcctcatcgtatcagagataacactatcagttgtaacggacgtttctgttctgttttcttttttacagctcaggacaatgactcccatgagcaggattgacataataaatttcataatagtatattttgtggtgatggttcaaaagtaggccattatgaatctgttttcttatgacttaaattataatgctttatttttcgttatttcgcaaattttttggttcctgcaacgcataaaattactcccactgtcactcccagcattcctaggcttacctgttcgtgaagaagccaggcagccaacgcaagaccaaagaaaggttgaagcagctgtaactgtcctacagtagcaataccgccctgcgccaggcctttataccagaatataaatccaataaacatgctgaaaagggagatataagccatcccgaaccatccctggaaactgacattaccgatatcatcaggaaaataaataaaaaataaaggaatcataacaggtaacgccaacaccaaagcccacgaaattacctgccagccgcctaatgtttttgaaagttttgcaccttctgcgtagcccataccgcataaaataacagcaagcagcatcaggacatcaccaataggcgaagcagatattccttgcgaaacggcatatcctatcactaaaagacttcctacaattgaaaaaagccaaaatacaggatgaggcctttcccctccacgcatcaccccgaatacagcagttaccaatggaagcattcccagaaatacaatagaatgcgccgaggtaagatattgaagagctaatgcagaaagaagtggaaaacctattacacagcccagggagaccagaagcagagggactaaatcttttttaacaggacgtttttccttccctatgcctaacactataaaagctaatactcccgccaccgctgcacggactatggttacaaagatcgggctcatttccatcactgccaacttggtagcgggcaatccgccactgaacagcagcactcctataaagccattaatccatccacttatattttcatcttttgataattgattggtcatcattttactaagcttttaattgattttccaaaattagaaaggataaacagataaacacagtaccagttttgtatatttgcatgagcacagttcaacattatgagtaaagaatatttatatacagaaattgcagacggcattgcgaggcagatcagaaatggggtcttaaaagccggagataagcttccttcggtaagaatgctgtgccaggaacatcaggtaagcatgaatacagccaagcgtgtttttctggaactggaatcacaatctttggtagaacccaagccgcaatccggttattttgtaagccagcttctctctgcaaagcttcctttgcctgaagtaagtcgtccgtcgctcattgccaataatgatgaaccggatgagctgatcagcaaagtatatgaaaatatggggaaaaacgatattacttttttctctatcggaattccgtcaggcgatcttttaccccaggcaaagctgaaaaaagaaatagtaaacgctaccagggaattaaaagatggcggaacggaatatgaagaacttcagggaaatctgaaactaagaagaatgattgccatacgttctttacagtggggaggaaacctgaatgaaaatgacctgatcactaccaacggcggaatgaatgccctttctttctgtttaatggccttaggaaaacccggagataccattgcgatcgaaagcccctgttatccaggaattctgcagctagccaacggactgggccttaaagtactggaacttcctacccatcccactaccggaatcgaaattgaagctttaaaaaaagtaattccccaaatcaatatctgtctccttattcccaatttcaactcacctttgggaagctgtatgcctgatgaaaataaaaaggaaattgtaaaaatactttctgaaaacaatattccactgatagaagatgatgtgtatggagatctttatttcgggtccagccgtccgaaatgctgtaaatcttttgataaagacggtaatgtactgtattgcagttccatctcaaaaactttagctccggggtatcgtgtgggctggattgctccgggaaaatataaagacaagattatgaagcttaaactccttcattctacctcatctatttcgatcgtgaatgaagcagtagctaatttcctgaaatccggcaaatatgaaaagcatcttcagcagctccgaaggacattgcagatcaattatcagaactatgttcagactatagcagaattctttccggaaggtaccaaaacgagccgtccgcagggaggattatcaatatggatagaatttgataaaaagataaaaacaacagaattatacgatctggccatcaagcagaacataagcatcgctcccggaagaatgttcaccttgcaggaacagtttgaaaactgcatgaggctctgcatagggcttccatggtcggaagatacacaggcaaagctgagacagattggacagcttgcccgaaagatttatttaaaggaaggaaggtagaggctggaagatggaagtgattttatttttaagaacagcttagaaggtgtaaatattaatcaccaggttcttcaatgtttaccaaaacttcaagcttccctcttccatcttccaactttttatttatccggaacgaaattttttctcgccagttcttttcttacacggctcaggctctcaggagtgatccccaggtaagaagcaatcatccattgcggaactctcagcagtaaatccggatacattttaatgaatttcatatacctttcttctgcagtttctcccagcagggaattgatcctgttctgaagacttctgatgtgtttctgaagaaggaaatcactcctctcaatactgttcggaaattgctctacaagcttattgaaaaaatcaggatgtaaaaacagaacttctgaatcttcaacagcttctatatagtaaatggatttttcattgaaataaagactgcttcggtccgatatcagccagctttccggagcaaactgtataatatgttcctttccgttcttatcaatagaatacattttcagcaggcccttttccacaaagaatatatgacggcatatttcgccatactgaagtaaaaactggtttttagggattttctttacttcgtaatgcagactgcaggtattcacgttctgaagcggaacatttaaaactttggctaaataattatttatattcttcatgacacaatctggcttaaggaaatatcctggtgtgaagcattgtttacagcttttccgttctcaattacaatcagctgcggactttcatgtctgatctcaaagtctgttgctattttgttggaaacaggtctgtgagccaaaagatccagataatatacattaaccggctgttctgaattctcaacctctttttcaaagtttttcaatacagtcctgctgataaagcaacttgtagaatgtttgaatatggctatcttcttctgaaaagaatcttctattgctctggcaagatcctcttcagattctatctttttccagaatgttttttgttcagggctttcactttttccaccgaatattttatcaaaaaaactcatacactaaattgttttagatggtgatcaagatgcttgtattctaaaaatgtccagtctttttcagtcatgcttccgaacaatctgtgacggcccggcagcttgttattacaacaaacttcccggaattcttccagcgttttcagcagattggcttttgattcatcaaaatcacactcaaaattaacgattagtttttgaaaagtaggcatgtttctgggaattccattattgaaaacatacatttctattttagtacagattcctatggtctcaaacaggatattgatacggggaaggtccagtttttccaaagctacctgaagaaccagatcacaatgtttcagcatctgacacacgttcatttttccccattttctttgggaattttcagataacatggaaattctgtccacaatttccttatagtatgtgggattattaagactctttcttaccaacctttttctatcttcagattttcaatatgggcaaaatggtgattacagtgccatacatataaagcaaggctctcccttagattatagtttttgttatgttcaggatgatgaaatgttctttcaaactgtttgttcgtaaggcttttaagaagaacaacccatctctggtgtgttcctttcagcattctcatagcagattttaccggcatatgaaaactatcctgaagctctgcccattttgcttcatcataaggttttatggtaggattatcttcagtaagggccagtttaaaacggataaagctgttcatatgactgtctgaaagatggttgacaagctgtctgacagtccagccgccttccctgtaaggagtatccagctgctcgtcggtaaaatgttcaatgagattttttagcctgccgggaaagtctttgataactttaatgtaagtgtccaatgtagtatcacaaatattttcaggggcttcaaactgccctattggaaactttttcttctctaaatcgctcattgctacggttttaatttttaaacagttcaggtttatccgattatatctttcaggacaacttttcagatatcacttgtgtaaatttatcaaaatttcaagaatataaaatgaataaagcattaattgtagcgataacaatttattgaacaatatatcttcattaaaaacggcctcagtgatgatactgggccgtttttagaaattatttttagaaattaataaccatgcagatcaattccttctgttctttgtaaagttactttcttacccattttcttttgaattactctgaaatgctgtaactcatcatcagtaagaatgctgattgccgttcccttttcattggcacggccggttcttccgatacggtgaatataatccaaaggagaacgtggcaattcataattgataacacatggcagggattcgatatgaattccacgaccgatcaaatctgtagcaaccagaatctgcgctccgtttactttaaattcttccagattatttcttcttgctccctgagacttctgactgtgaatagccactgccttaattttattctttttaagcttttccaccaggttatccgcagatcttgtagacgaaacgaagaccaaagctttttcaactttcttttctttgatcagataccgtaaaaaagggcctttattttcaggagcaacatggtaggccagctgctcaatattctcaatttcaacttcttcttttttaatttcaatgatgacaggattaatagacaacttctctttcatttcagccaccttatcatttagtgtagccgaaaacaaagtcgtttgttttacgacaggcatcagagcaaaaagtttattcatttcttccccaaaacctaactgaaacattttatccgcttcatcaattaccagatgccggattccggaaatactcaaagcattatggtcaatcaggtccaataaacgtccgggtgttgctatcagaacttccactccaaacatccccttcatctgtggatttatagaaaccccaccgtaaactgccattgtacggatctctcttttcagatttcctgtaaaagctttgaacacttcgtcaatctgaatcgctaattccctggtaggaactaatattaatacctgaatattccgtccttttttaacgtctgcattctgaagcttttctaaaatcggcatcacaaaacaagccgttttcccggaacctgtctgtgcaattcccataagatctttcccttgtaaaatcacaggtacagcctgctcttggatcgggaatggctttaaataccccagtttgttgacagaacgaataatattgtgtgataatcctaacgattcaaatgacataaaatatttatttcctgcaaagatacgctattgttatttggtttatctcttaaaatcctatacgtttcttacaaaaagaaattatcctgattgataatcccttcattttataaggggtaaaagtttatgttgccgatttgtccgataattcagttttggacaaatttttgtggattagttttgtaaatttatcaaaaattcgagaattcaaaatatgaaaaaagcgttaataatagtcgatgtacagaatgatttttgtgaaggcggagcacttgcggtccctggagccagcgaaattattccatatatcaatcttctgatggaggaaaatgaatatgaccagattgttctgacacaggactggcatcccgcgggtcataaaagctttgcaagcagtaatggaagaaaggtaggagaaagtattattttaaatggagttccacagtttatgtggccggatcactgcatccagggaactttcggtgcagagttccataaagatctgaacagagacaaagtaacccacatcgtacagaaaggcaaaaatattgaaatagacagctacagcggtttccaggataataatcattttatgaaaaccggtttggatgactttttaaaatatcatgacattcaattggtagaaatcgtagggttggcattagattattgtgtgaaatttactgcattggatgctgttgccaatggttatgtaacttgtctgcatttcaacggtacccgtgctgttaacgtaaaacctgacaatgccagggatgccatctatgaaatgattgaaaaaggagtaaccgttttagggtaattataaatgatgagttatgaattcttatattcatgccttaatataacaaaaaagcgcagaattatttcctgcgcttttttatttttatcctaaatcctttttgaaaaaatgatataagctgaaccctgaatctgttattcataattcataacttataattcatcattattttaaagcattttaagattgttcacttccagttctgtaaggattctccaatgtcctctcttgatgtttttcttcgttaagcctgcaaacatcactctgtccaaagcttccacttcgtaacctaatctttggaaaattcttctgataacacggttccatccgatgtggatttcaattcctacttcattctttggtttcccttcaatataagaaatctgatcaacaacagctacaccttcatcaagacgaataccttctgctataagacgtaaatcttcaccggtaagctttttatccaatgttacatgataaatctttttcgcatcaaaagatggatgcgtcagttttttcgtcatgtgtccgtcattagtcaataagataactcctgttgtagaacggtccagtcttccaaccggaaaaagtctgtaaggagaagcattggctacaagatccataactgtttttcttgctttgtcatcttttgtagtggaaatataaccttttggcttattcaaaagtacatatacaggtttttcaggcgtaatgctttgcccgtcaaaaactaccctgtctgttttctgtacctgatatcccatttcagttaccacctttccgtttacttctaccagcccctgggtaatcagctcatcagcttctcttctgctgcagatcccggaattagcgatatacttgttaagacggatgctgtctttatgaacatctttttcaattttgttcagtcttcttttctgtacaaaagatttcgctctgtcttcatttctttcatcaccattagatggtcttcttccgtatttcaggctgcctctttcgtacttatctcttgtatcaaaatttttcccgcctctcttaggttttccaaaagatttcttctcatagctctcacttttgttcgtgatataaggttttctttcagattttgaaccaaaatcatcattggaattttcgaaactgtcggtatttcttttgaaaggtttcttttcaaatcttgagttggatcctttatgttccggccctttttttcctccgtctttagagaaaggctttttaaaaggttttgatcctgaagaatttccagatctggaagcacgagaatcatcagaacttttcttggttgaaattcttggtctctttggtctgtctgaattattattatctctgctcattctaaaaatttctgcaaagatagtaatttagttacgagttaaaaattaagaatcataactttgcactatagtttacattttaactttacatactatagaagatgataacaatattaaacgataatttttcacagctcaacgagtttcttcacgagagatctttcagtaaaattttcattcttgtagatgaaaacacccatgaatactgtcttcctgttcttttaggaaatatggaaactgatcttggctttgaaattttagagattgaagccggagaggaaatgaaaaatatccagacagccaatcagctttgggaaattcttacggagatgaaagcagacagaaaagcattggttatcaaccttggtggcggtgtcattacggatatgggcggatttgttgcatctacttataaaagaggaattcagttcatcaatatccctactacccttttatccatgtgtgatgcttccataggaggaaaaacggggatcgatctgatgcattataaaaatatggtaggaacttttgcttttcctgagcagattttcattttccctaaattcctggaaacattaccatttaaagaattaagaagcggttttgctgaaatgctgaaacatggattaattgccgataaaaaccattgggaccaactgattcagatccgtaagctggaagtggacaccgtaattccgcatattcagacttcaatgcatattaagcagaatgttgtagatcaggatttccatgagcagaatatcagaaaaacacttaatttcggacatacgattggccacgctgtggaaagcctgtgtttacagcaggaaaatcctattcttcatggtgaagctgtagcaatgggaatgatcgctgaagctcatctggcatttcttgaaaaccttatttctgaagaagattcaaaattgatcattgaaaacatccagagatactacccatatcttgatatcagtgattttaaagatgaagatatcacagcattattactgaatgataaaaagaatacggacagtaaaatcaatttttccctgctttcaggaatcggttcttgtacctatgaccatcagtgcagccagaaaaacataattgaatcaatagctttttatagaaacctgaacgatgcttaactgtttttctgaaaaatatattagttttttaaaactattttgacaaaattgtcaatttagacactttctaaacaaatgtttattttcatttttaaaacactgtaaatcaacctgatagtttcaaaatcacttaaacactaagtgatttttttattgattttaatcataaaaaacttttttggcaagcaatttggaagatactctgcgttcagactgaaaatgttgaacaagtagtaaaatttaaaattaagaaagagtaaaattaaaaaattaaagttatgaaaaagttaattttaggattagcgttaactgcaggaacattcgcattcgctcaacagacaggaaatacatcttctaacccagtaacatttggtgtaaaaggaggaatgaacgtatcttcattatctaatggtgcagatctaagtgactctaaatcaaaaattggttttaatgcaggagtttttgctaatattccattagcgagttcttttagtgtacaaccggaagtaatttacaacgatttgggctcaaaagtaacaagagaatatactgtacttggaaataattataaaagtgaatattcaagaaatttagggtatgttgctgtaccagtaatgtttcagtataatgctacacctgaattcttccttgaagcaggacctgaattcggtttccttgtaagcgctaaagataagttaaagagctcaacaaacaatagcaacaatactcaggtcgcaactcttaacaaagatgacttccaaactttcaacttcggtatcggtattggtgcaggatattacttcattcctaatttaggaattacagcaagatatactgcaggtcttactgatatttataaaaacaactctggtgatgcggtaagaaacaatgtattccaggtaggattagcttataaattcaaataagcttatacattcaataacaaattttatattcaatagaaaagatcagattattttaatctggtcttttttttatgtatgattaatagcttgtctactttggcataacatttgatagttaaggaaacgttaaataaaacttaaaaactattaaataaaaacttatgaaaaagatttttttaggtcttgcattagtagcaggaactttcgcattctctcagaaaacttcagcttctgctgcttcaacttctcccgttagatttggattaaaagcaggtcttaatatttctaccatatctaacaataatgcaaattcaaaagcagggttttatggtggtgtttttgcaaacattccagtagcacaagacttctctgtacaaccagaagtattatatagtggacagggggctaaagctaaagctaacagtaatataaaacttaatacggattatattgcggtaccggtaatgttacaatacaatttgattcctaatctatatgtagaagcaggccctcaattcgctttccttatcagtgctaaaggaaaaggtaacggtgcaactgtagacgtgaaagatgattttaaaacttttgattttggtctagggttaggtgcaggttattatttcacacaaaatattggggtgaatgtaaggtatactgccggattaactaagattgctaaagaagatgatggtgattcttctaaaaatggagtattccaaattggtttagcttataaattctaataaaaaacttatatcagtacaaagccggatttaataaatccggcttttttgttttagaaatgattttggcaagaaatttgcgtattaagtactgattgtaccctagtccggaattccaacttacagttcctgttatacaataagtaagcgtaattcatttgttttaattcaactggatgtaaagctgaaacctaactattaccataaacttttaacgagaactgcatcggtttgtccgaaacaacagaatactgaaaagtattttgctcaacaatgaaaatacattttgatttcaatagaaaaagtcaggtttattagtttaagcctgactttttcgcttactgcgtgatttatatcacttttctcctttgtggcagatattttgctgcagaaatcagtttaaaactttaatcatgaaaaaggtattttcaggactggcattggccggatcacttttagtgaacgctcaggaaaaacaacagtcagtttcttcaaaatctcccgttacatttggtgttaaagcaggattcaatgcctctacacttagcactggtaaaactgataatgctgacaataaccacaagttaaagcttggctaccatatcggagtatttgtcaatattcctgttgcagaaaagttcagtgtacagccggaacttctttttagccaaatgggctccaaaacagaagggaaatatacctatggatctgctgtgggcaatcagtttataatacaggaattcaattataaaaccaatctgaactaccttgttctgccagtaatggttcaatatcgtatccttcctcaactttatgtagaagcaggaccggaattcgggcttcttctgggcggaaaagttgaaggagaccaaagagctcaaaatacttacaatggtacggtaagcatttataatgaaagcttttccaataaaatctcaatggacctttacaatagattcaattttgggatagaaatgggtgcaggatattattttacccggaactttggtgtcacagccagatttacagcaggtatcacagacatttttaagcatgattattataataataaggtaagaaataatgtactccagcttggagttgcttatcaatttaaatagagatattaattttcaaaaacgaatgccggcactaaattccggtattttttatgtccggccttaaaaacaatccaaaatatctcttttatttgtgtaaaaactctttcatttttttaatttttcattatttcaatgatcagcaataaagtattttttacattaaactcttttcatacataacgggtatagcagtacatttattcaataaaaagggataaatggttaaaaaaattcttttaaaaacccgctcccaaacccttataaacaggcctttttcaactttggcaagcaatttgcaaaataattcgggtctgattgaaatgatcgacacacaaatagtaaaattaaaaaataaaattatgaagaagttatttttaggattagcattaactgctggtgtattagcttttgctcaggaaacagaaacaaagacagagaccaatacagtaacagcatcgccactaaaaaaagatgttcaaccggttagattcggtattaaagcaggaggaaattcatcttacttcagcaagcagaaattcgggatcaactctcagcaattaggtttccacgcaggtgcattcgttaatattccaatttcaagacaattcagcttccagccagaggtattatacaatcaaatgggagcaaaagatgtgatttcatctacagaaacggataatggagttacaaatgtgaagactagagttgaggacagagtaaaaatgaactatatctcagttccgttaatggttcaaatgagacctgtagataatttttatattgaagcaggacctgaattcagttatttcatcaacgggaaaaataaaggagaatcaactgtagcaagcactacaggaggtgttacaaccactactacaagttctcactctacagatattgacaaagatcagatcaacagattcaatttcggattaggtcttggtttaggatatgatatcacaccgaacattggtatcaatgcaagatatgtgaacagccttacaaaaatcgataagagcagaccggcagctgaaaacaacaacagagtattccagttaggtctgaactataaattctaagtaaagaaccaattttttaaccctaagtgcattaaccagcacctataaaatcgccggaagaaatacttccggcgatttatattgtagcaaaatctgatatttattcaaatattctgggatcgtcactaataacgccatctatacccatatctttcaattcttttaatctttctttggtatttacggtccatgggattactttcatacccaatgcatgacattcctttatcaattgtggtgttacaagagtatgttcagggctgtaaatcgtaggagtaaaactcaggaaattcatatctccggctactccattcagatgatcgggatacatcttaaatttttccagaggaatatttttaaaataagcctgctgctgagccagttttttatcatctaccttttctacaagcaaagcagtcttgatttcaggatattctttatgaattatttccagtgttctgggatcaaaagactgaataatcaccctatcctgtattttcttttcaacaataatcttcatcatcagatcaacaaattctctaggctccggatgaaatatattgtctgagaagggacgcgttttggtttctatattataataaggtaacggtcttttcaattcacgggcgtatgcttcacaggcatctattacgtctgaaaaaagaggtttctgagccttcattttcttttgatcaggatatctgtcaagcttttttaagcctacatcaaaggttttaatcttcgcataaggcatttcataaattttgtaataaaaacctgaatcttttgggatataagttccatccggttttgtaaccagctccggcgaaagaaacacatcatgggaaagtattaccttcttgtctttcgtgatggccagatccatttccaatgtagtcacattcatttgtaaagcatttttcatggccgggattgtattttccggaaaaagagattttcctccgcggtgagcctgcttatcgaaagattgtgaaaagtaaaattgagccaccagcaggaaaacaccggttaaaaatatatttttcatatcctgaagttttaatctgacaaaattaaaactcctctgtatactgtataatatggcaatattaagcttttgctacatttataaagcaaaagaaccaggttgatacccggttctttttattatttcattaaagagattaattgaataaatctgtttcttctccttttcctacaggatattcttctgtaaagcatccgaagcagtgattagcagatcctaaaatttctttcaggttgtctatgctcaaaaactctaaagaatctaccccaaggtagtttttaagctcttctgtagacatatttgcagagatcagatcatctttggacggtgtatcaattccaaggtagcaaggagcaataattggcggagaaacacttctgaaatgaatctctttcacgcctgcatctttcaggatcttaaccagtctttttgatgttgtcccacgcacaatagaatcatcaatgatcacgactcttttatctttcatctcagagataatcgggttcagtttaaggttcactaccctttctctcatttcctgtgtaggaacgatgaagcttcttccgatatatctgtttttgatcagaaccgggcgaaaagggattccggaagtctttgaaaaaccaatggcagcagggactccagaatccggaactccaattaccaaatccgcttctacaggagcctgttcccagattttttcaccggatttttctctgatctcatatacattgatgttttcaagcgtagagtcaggtcttgcaaaatagatatattcaaaagagcagattctctgctttcctttcgtctcatccatcatataagaatgaagttttccaggctcgttttcattggtataaatgatctcgcctggaaggatatcacgtacatactgtgctcccacagcatctaaggcaacagattccgaagctacaacatacgatttctcatcaatagctcccaataccagcggacggataccattgaagtctctgaatgcaaagaatttgtttctcgtcattccaactacagaataagcaccttcaatcttttccatggttgctttgatagctccgcgaagacctaaatcaaggtttttctggatcagtctcaggataacttcagaatcggaagtcgctctgaaaacaacaccttcagcttccagttctgcttttaattcttttgcattggtaaggttaccattgtgtgctatagaaagtataatctggtcatattcgttttttgcgaaaaatggctgaaaattatatttctttttatctcctgcagtggtataacgggtatgaccaattgcagaatttcccataaaagtttcaggttcgtgaatgtctttataaacatccaaaacaagtccttcgtctttcatatttgtgattttcccttctttcaggacggaaataccacaggcttcctggcctctgtgctgcaaagcaaaaagcccgaactgtgaaagagagaatgtatccagatcactatccgaatacaatccgaagatcccacactcttcattaggagcatctagtctttcctcttcctgagttctgaaaagatttcttccgtaagtctgggtttcaaactgttttaaatattcacttttatgaatgtctaaacttttcatttctattttttctaatgattagaagttagatattagatattagaaattagtctaagttaacttcaattataattttaaacttgcttttaatgaatatatcattttttgaatttcagctaaaagttcctacaaaggaattattcctgaaattattttgcaagtaagtttttaagacggttatagatttccacataagcctcagtaacttctcccaggtctcttctgaatctgtctttgtctaatttcttcatggtatctttgtcccaaagtctgcaggtatcaggagagatttcatcagctaagatgatttcaccgtctgaagtttttcctaattcgattttgaaatctaccagaatgatattgattttgtcaaacagttcgataagaatgtcattgatatctgaagacagctcatacatttcgtcaagctcttcataagtagctgctcctaagaaaacggcatggtgatcattgataagcggatctcccagctcatcttttttatagcagatatcgaagatggttaccggagatttaattccttcttccactcctaatctttgtgccatgcttcctgcagaatagtttcttacaaccatttccaaaggaatgatagaaacttttcttaccagctgctctctttcgtctagttttttgatgaaatgagttttaatccctttttcatttaaatactcaaaaataagggtagtgattgcattgttcatttctcctttaaggtctacctgacctcttttttgagcgttaaatgctgtagcatcgtctttgaaacgtactactacttcatcaggattatcggttgcaaatacttgttttgctttcccctcgtacaacatttctttcttttgactcataattttactttctaaattgtagttagatttattgatttattttattattattcctgttaagacagccagtccaaaactcagcagtgtaccaatcagtacatactctgtgagctttctctgttttgcctgtgcaaggtcgctgaacctgaagacagatttggcagccaccatgaaacctacgccttcccagtgattcaccataataaaagtgaagaccataagacgttctaaaattcctatatattttccggcacttgataaagattcggtttgaatagtgttggggccatccggagcgggtgtccatgatgacaataaaattttgataaaaacagaagcaggtgttgtaagaaacaatgccgccatgattatctttaaaaattcctgattctgtaaaaatccgaaactgaattcccggaaataaaaagaaattccgccaatcactaaaatatgcagcagctggtcaataaaaaaccatcttttcttagtttttacattttgaaatataagcttggctgcatcaataataaagtgagtaaatcctaccagaacagctacccaccaaagctgaagatcccaaaggaaaataaggcttaaagcggtgtgtatcagaacgtgaaggtataaaaatttacttttcagtttatagttctccttatctgcaacccatgaatttggctgaagtgtaaaatctccgagtagatgtgccaatatgagtttgatgaagatcatgcttatagttctgagattttctttctgaaatactgattggtttccacgatgagctcatagttggctcgcttcagtctctggcttaccgaagactgtgaaatggcaaatctcttggcaagatcttcctgggtaatatcatggttcatgatcatttcatgaataatctctgctgtagccatggtccagttgtcaaaatccttggacgaccatttcaacagaatattaagatctctgtctactgaatcactggatgttttaatagcaacggtatgtccgtcacttttaagatcattcagcagtcttccggaattcacgtaagcagtaccattagattcagtaattttttcagaagagaaactttcttcaccaataccgatggccattcttacatctaaattttcaacacttttaataagagattttatggctagaaatcgccagaaaacgtcatcaatcctgcatttgaactgaaactcatcacccctgtagatttcccatgtgtgaggagcgcttccccatttttcgagaagatgtttaagcctggtaatccaaacttcagtgtccgcatgctgtgaatttataatatcaccggtaatgaccgctatcatactgcaaatataagcataattacttatatataaaaaatataagcagaaacccttatagatattgattattagcgaatctgcttatatcgatgatgcagtaaacataaggtttttaaggcgttatatcaaatctgaaaattgggaaaaagcaaaaaaataagtaaatttttacagttacatttactttaactctacttttttcaagtttttttaacgagaagcttattcctgctatccgctcatactcctcgctcctgcctatccctcgctctttaccctccagctcttcccactcacgctccggggtaaccgctgctatcagggctaaaaaagtcagtgtgagcaaaacaaagcgatcttatcaatttcccttatgtcttattaaaaataaacctaacaggtttgatagcatttaaatctgatttcatttactttttaataaactgatgtgccttttcatcaagctttaagaagtaaattccagttggaatatcttgcacagcaatatctttcttatgtctaaaaggatctttttcggtataaatcacttttcctgaaagatctatgatctgggccgtttttattttgtcagtttctccggttacataaagatgatcatcaaccggattgggatagatagtaaattcattatgatcagcaatcaattctgaggttgacagtgtgccgagattctgacagtaattggatggataagaatcccattcgccgatagtaaatgtgctggtaggctggttgatggtattctttctgtataaagatacattaccgttattattaatggtgtattttaccccgatagcatctaccgtaactgttttattataagcaagctctacataattttcccctgcaaacatcatggggtcagatgctgttacaaattttgcctgatcaggagtgtagcatgacagggttccttttggattcagaataacaaaagtttcattgtttcctactttcccttccaactcataggtatctccattatagatcgctccggtgtttgtatttttgaactggatgttgattctgtaattattcagattaacctcatgtcctgttttattaacaatttcaagtgcattattcttaatgaattctgtattcgttccggaaatatatttggtgatcataagatccggtgcataggtatccgaagcaatggttgaagctgtaacagtagtactgaaaggcgattccagatatcctttatcaaaagctttcaccgtaaaagtataagttgttgacgggctcagatgatctatgctgacagaagtcccttttgtaaccgcaacaggtgtcgttgatccattcatatacacccgatatcctaaaacatccgtgtcaggagaagcagtccagctcagattgataaaatgagcattctgctgtgtagaagccagtgatcccggtgctgcgggaggaatattgtcgggagattcagaccagatcatatcgatccattcaggatggtcaataaatggatttctgttcttttgtatagtataaatggtattattccggtcaatttccctttgtgaaaccggatctgcagcactccactgtttcagcattgcaatataggcaagatcaatagctctttcctcagttccatccagcggacattggtctgtagcaggtgtgatggtcgatgatgtgctgtaagctgtattaaatgacccgagttttccttcatatctcacagcgaaatacagcagcgttcttgcaatatcacctttgaactcattaatgggttcgtaaacccttccggtatacggataattgggaatcgcagcattggccattctggaaccattggtgaaattatagaaattggtattaccacctattccataaggataattgtttctcagctgattgatccttgcatcagccggaataataaagttaagatcagaatacataggataatcgctgatggatgagcttgtactgaatgtactttgcggcatcatatgctcccggttgtatcccataccttccatactgccattaccgatgagttgatttactttatactcataagcatccgggccggttggtatttcagaataaatatccagcagatattcggtattggaggcatcatgatcataatatttatcaagatcagtctgcccatacagtcccggaaggtcattgtagtgccagttaatcattttttccgaaatgatatcatgaagttttgatttcagggcataccccgttaatccggcagtaccatcataatatccggcaggagcctgcgcggaaatataagaggaaattaaaataacaggaagtagaatttttttcataccgtaaaattgggcaactaaaatagtgaaattaaaaattcaggaaacccaatatttgattaagaaagtattaattctcacacataaaaaattgaaaactaagagcattacccctgataaaataatttgttttggcattccatcaatttggttatctttgggaactaactattattatatgaatactgagactattgacaacattaaaatgatagcggagacggctagagaatttgcagaaaagaacatcagaccgaatattatggaatgggatgaaagccagacttttccaaaagacttattccaccaactaggtgagatgggctttatgggaatcgtagttcctgaacaatatggaggttccggattaggttatcacgaatatgttgctattctggacgaaatttctcaggttgatccctctattggtctttctgtagcagcacacaattcactttgtaccaatcatatctatgaatttggaaatgaagaacagagacataaatggcttcctcagctggcttccggaaaagtaatcggagcctggggacttacagaacacaatacgggttcagattcaggagggatgtctactaccgctgtaagagacggtgacgagtggatcatcaacggagctaaaaatttcattacacacgctatttcgggagatattgctgtagtaatgacgagaacaggagagaaaggagctaaaaataattctacagcctttgttttagaaaaaggtatgcccggatttacttcaggaaaaaaagaaaataaactgggaatgcgtgcttccgaaacagcagaactgatctttgataatgtacgtgtaccggattctcaccgcctaggtgaagtaggtgaaggtttcaaacaggctatgaaagttttggacggaggtaggatttctattgccgcattaagcttaggtaccgcaagaggagcttacaaagcggctttgaaatacgcaaaagagagacatcagtttggaaaaccaattgcagacttccaggctatcaactttatgctggctgatatggctacagaaattgatgctgctgaacttcttatccaaagagcttctacccttaagaatgcaaaacaaaaaatgacaaaagaaggagctatggcaaaattatatgcttctgaagcttgcgtaagaatctctaataatgctgtccagatcttcggaggctacggatacacaaaagacttccctgctgagaagttctacagagactctaagctttgcaccattggtgaaggtacttctgagatccagagactggtaattggaagagatatcacgaaataatttcaaatcccgatacaaatgattaaacaggcacttttaggtgagtttctgcacgaagccgaaaacaccagaaaaattttacaggcaatccctgacagcgcactagactggaaaccctctgaaaaaaactggaccaccggtcagctggcttcccacattgcagaagtatacaactggtatgagcccactttcaatcaggatatttttgatatgggcgcttacaggtatgataaaggagatatttccagagcggaaaatatccttgcaaaatttgaggaaaatgttgccaatgcacagaaagctctagaaaactctgacgaaaagacctatttcaacgagtggaaaatggaaatggacggaaatgtacttttccctcctatgcccaaagttcaggtgataagagcttttctttataaccatttgtatcatcacagaggtgaactggttgtttatttaagatcaaccggaaataaagttcccggactttatggacctaccgctgatgataaaatgtaattaaaaattgaataaatagaaaaagctgtttcattttgaaacagctttttttgtcaataaatataatgtagtaaatcgactttcaacaaatttaattaactgatattgctctaaaaattgaataatcatcaatatatattgtctcattttaataaattaataaataaaacacatttatatgaattaaaattgaatttatcgttttcgcttttcttttattaatgagctttttcaattatatataatgtatcgcatagtatattatgttcaaagtctaaattttccttaaaaaattttgttttccataatatattttttattagatttgatattccacaatcaaatttaatatttaatatgaaaaaacaattaacgctgattggaatgctccttgtttcgggtatttctttcgcacagactgaccgtctttggactgaaggttccagaaaagcttcatcagagatctttgaaaacaaaaacagcatcaacaatcctaaggtttacaacctggatatcaacggattgaaaaatgctctgtcaaaagctcccaaaagactggctgcaggcgaaaaatcagaactcattatctcttttccgaattctgaaggcagaatggaaaatttcaaagtgagggagaattccaattttgcccctgagttggcagcaaaatatccggatatcaagtcctatgtaggacaaggtctggatgatcctaattccacagtctatttcagtgtttctccactcggactgtcatcaatggaaatttacggcgataaatcagctgtattcattgagccatacacaaaagacctttcctcctatgttgtgtacagaaaatctgataaaaaggatgatcttaacaaatttgaatgtacagtagtagaagccgcacagaaaggagtttcaaattcctcactcgcagcaagacctaatgctgacgatgccaagctgagaacattcagacttgcgctttcctgtacaggtgaatacactacgtactttggaggtaccaaagcacaggctctggctgcaatgaacaatacgatgacccgtgtaaacggtgtttttgaaaaagattttgcagcaagaatggttcttatcgccaacaatgactctgtaatttacaccaacgcttctacagacccttattctgcagcctcaggaatgagcaactggaattctcagttacaaagtactctaacttctgtcattggtgaagcaaattacgatatcggacacctgttcggtgcttcaggtggcggtggaaatgcgggatgtatcggctgtatctgtacgaacggatcaaaaggaagcggatacacttctccggctgatgctattccttcaggggataattttgatatcgactatgtagctcacgagatgggacatcagtttggtggtaatcacacgttctccatgagcaacgaaggcacaggtgctaatatggaaccgggatcaggatcaaccatcatgggatatgcaggaattacaagccaggatatccagcctcattccgatgcattcttccatgcgataagcattcagcagattaccaataatattaaagctaaaacctgttctgtcaataccaatacaggaaactcaattcctactgccaatgcaggtttagactataccattccaaaaggaactccatttgtactgacaggtaccggaacggatgccgacggagattctttaacatatatctgggaacagatggacaacgcctcttcttctcagacaggagcaagttcggcagctagtgcaacaaaagcttcagggcctaacttcagatcatggactccaacaacagtgcctgtaagatatttcccaagaatggcttctatcctgacaggtgcaaccacaacagcaggctctgaaatcactgtagaggcgctttcttctgttgcaagaacattaaacttcagatttaccgttcgtgacaacaaagcaggaggttcaggaaataattctgatgatgctgttatcacagttaattccactgcaggaccatttctggtaacttcacaaaactcagctacaacatatgccggaggaagttcccaaactgtaacctgggatgtagcaggaactactgcaaacggagtaaatacagccaatgtagatatcttatggtcaacagacagtggaaatacatggactacactgttggcaggaacccctaatgacggttcacaggctgtaacgattcctaatgcaaatactactacaggaagaattatggtaaaaggatcaaaccacattttctttgatgtcaacaatgccaacatttctgtaaatgcaggttccggaactcctgataccgttgctcctacagctcctacccttgctgcttcaggaacaacttctacaacaaccaacctttcatggtctggtgctacagataatgtaggagttacaggatatgatgtatatcaggggacttcattaatcggttcaacggcttctacaacgtataccgtaacaggacttactccttcaactacctactctttctcagtgaaagcaaaagatgcagcaggaaatgcttctgtttccagtaatacagtaagcgttaccactctttcaggcggaacggttacttactgttcttcttcagcatccaataccgctgatgaaagaatcggaaatgtaacattcggatctattaataatacttctacaggaactgcaggttatgaaaactttacttcagtttctacgaatgttacaagaggaaatgcctatacaatttccatcactccggtttggacttctacaaaatatagcgaagcatatgctgtttatattgattacaacggtgacggagactttacagacagtggagaactggcatggacaaaagcaggttctacaaccagccctgtaacaggatctatcacaattccatcaacagcaactgtcggttctacaagaatgagagtaatgatgaaatacagctctatccctacatcatcttgtgaagcatttacttatgggcaggttgaggattacacgcttaacattgtatcttcaggaaaaggagatattcagaataccaaagatctgatcacagatgtgaagctttatccaaaccctgtaagagatatactttacatttccaatacagcttcagaagattataaaatcttcgatatgggtggaaaactaattgactcaggaaaacttcagagaggttctgtaaacgtaagcaatcttatcaaaggtgcttatatgattcaaatcggagaatattctaagagatttattaaaaattaataactttaaaattaaacgatgtgaaaaactgcccttcggggcagttttatttttaatgtaaatattacatgaaaaacatttatgcctgttattaattttacataattattttaggtgattatatatttctttacactaatttgttaaaataaaaaagagagcaactattgctctcttaaatttttataattacttttgattttaggtttacatctcgtatcaataccctaggcgaaaaggagaagcgccgaaggtgacacggtgatggttgtcatcattaaaacttgtaatatcatggcctcgaaacctaacaacaagttcgtaaaagttcacaaaccaacgaaagatggcagagggttcttttacagaagcaaacccaaaagttgccctaaaaagtaacaattggtagcaggggcaaccctgcttttttatttctatgtaaatgtaaaactattacttcacattaccaaaaaccttgattctaaaattaagatttaggcttatgattccaaactttagtaatcatattatcaaagtctgttttcacatgtatgtattctgccatgattaaaggaattttctcatgatacttaattttcaatgtctcaatctttaattcagggcaattgctttttatatcttcaacataaaagtattcttcaccatttaaaataatggttcttacttctctttgttttaataacacttctttcatttatcctgttaaatctttgtatctggttctcacattattgttattcaataagtgttcaaactttttatagtctgtgatttctcttaaattatacctatacacaaattcatcaacatatttttgaagatgcttttttgaaacgtgattatacattcctgaaacacttcttttcagaatgttccaacttccttctatgttgtttgtgtgtactgtattatcttgcaaacttacatattcttttttagaatgatctataattcgatgatcgtaatgtctatgcaatcctctataagcccaccattcatctgaaatgagtcttgtacctgtttttacatatttatgtattaaaggctgaatactttttctctttgtatcagtcactacaaacgcattcaacttcccatctctttgtagcatacccattacaggaactttgtctttaaaacttctaccttgtgagtgtggaactttcttgtctttgtgtctattcttgttttttcctccaataaaagtttcatctgcttctacaattccatcaagttcattacagttttctatcccaaaacaagctctgattctttgtaaaacaaaccatgcagtcttttgggttactccaatatcttttgctaattgcatagaactaatccctttcttatgtgctgtaacaagccatatagctaagaaccattttctaagactaacctttgaattttcaaacattgtcccagtcttaatattaaaatactttcttgtattcttacatctgtatctgttgtttttgcatttgtaaacttttgaagttgcatcaaaaggactaacaacaataccagtccaaataatttcctccaaatagtctatgcaagcctgttcagttggaaaggcttgtattaattctaatactgattttatgttggtgttaatgaacatatattagtctgttacgtttttaataattgtattaacagcatcataaagccaattaacattaccattataaatagtctgcatattggagtttactgtttgagtaaagtcgtttaagatcttttcttttttagtctcagaaacatctaaggattttatttgacctacaatatcatctattactgcctgagcattcttttgattattattgtatctattctgtaaagtagttgctgcattgcccaaactagaaatatctaatttttcaggatctctatattgatacggctttctttgttgagcttgatctactctgtaatattcccactgtttcgataaggaattaaactttttgaaagctattagattaccataagaatctatataatcatatctaccataagtagaattgtatttctcagtaatagtttgagaaaaacaaaatgctccaaataaaagcataattgaaaagaaaatttttttcataagtgaatttgataatccactcaaacccaaagcagaaattttaagattataaataaagaaaggcgtgggtttgtagtctttatttattacctgtggctctggattgccaaatgacataaacaagacaacccacacccatataggatgtaagtgtctaactgtttattctgtgtcattttaagaaattttccagatttcaggtaacagaataaaagctaacgcttcctttttaatcgataaatattcctacaaaagtacaaaaattatacctttttcactatatttggagaaactaaaaatcaaaaaactatggatccaacagcgtatcacaatcacaaggcaaatttcaatagattgacaggtaaaaatgctgatgaagagttagctgcttttttcagctatcttaatatgttaaatctatttgatattaaagatcttttaaaagatctgagaattatgataaaaaatgtagaaactaatactaagaattagaacttagcaccctatcttttaagggtaattctcctgtagttatccaatcataattttcattagcattttgaatatttccctttgctaaaattaggcacaataatctcaattgtgcttctgtaaaatttttcattttgtaaatttttaaattgttattaaataaaaaagaccaatctaaatattagttggtctttatttttttctatgtttgtgtaaacttatatatagttaccttattttatttaaaataaaaaatcaccagtatttgagttttttgatttaaatttatcaaataatattctattgtaccgtttgcccagtttgtatttaagggagctccgaaactgtttttaacatctgacaccgttgcttcttttgactctgttttgggatcatttagtacttgaacaattccggttcttaaatccagttatattgactgcaaagtattaccgctttcaccttagcatttccacttatggcatatgtaaagaaataatgtttcaaaaaggtagtcccctttaataccttaataattttaaaataatttaatttttttatatgaaacatttatttaagtacttttttatcttaacgatcaccactttctccgtcgcctgtagctctgacagggatgatgaaccagaatccaattctgatgtcaccattgtattctataaaaatgctgatgaactcgcagcaacttacgatccgaataacagtgtaagccagtctgtaagaaatcaggcctacgatctttacaaacagggtaaatggagcgaactggaagcacttttcaaagcaaacaatttaaatggtggatggcctcctgccaacggcggttacaatatcgttgatgatgttccgctacaggttggacagaaatttgacagatacagcggagctgtgggcaattataccggcaatggcgtccctactttaggcggaagttttaccagtccgattattaacggatatacctatacttttacgcaaagagccttaaatcagcctgaagacaaatatgatttttattatgaaattgatgtcctgaataattcaatgcagtttaaaacccagaccgcagatattattccatggtttggccaggctggaaaaggaaaacaaaccatgtggaaaattccgattgatatcaataccggttatcagaaaacatggaataagcttgcagaagaaggctatataaaagttaccattaagaaaagtcccagcggaaaatataataacttagcaggcacagttattcagccataaatcagctcaaatgtattcaatatcagaaaaaataagcattaccggaaaagcttctgttgaaaaaagctctttcatgaatgatgaagctctgccttcggcaataaccactttcagctgctgtgattgcgggaacaaaaattcaattgcaatagctccctatgaatccgggtttcccatccttcagctttaccatgaagataaagtagtatccaaagacgaattgttgaaaaatggaatggtcaacagaacctctcaaagagtgcttcatttcggagaattcaccgttaatgatcttccgactttatattttggcaccgattgtacttcctgtcgctcaaagtatatctgtatattcagctatggagaaaagcagccgggcctggaaatattaacgatttccggtatctggaaatacgaataactgaaatcatttctattaatattataaaagtctacaactttaaagttgtagactttttcttaacttagcagacaaactaatttcaaccatgaagcacgtctacaaatgagaaaaatagccctatttctttttgccctatgctttggatcagtattttcacaaaaaacactctctaaatatcctgaaggtcagttcccttataaagaaggacctgtccaaatgtctgcagacatgcagaactattttctgaaaagcggtgcaaaaccttgtgataaaaacgagatgtattttgtaaccttaaaaattgataacaccggtaaaccttctttggtaaagaaaaagagtgatgatgctattatagaaaaaaataaatgtgcattcgatctcgccatcaagtctataggaagcctgaaaaactggcatcctgcggaagaaaacggagaaaaagccattgcttattttgatttccctttttttccacaagacttttttgaaaattataaatccgattacgacctttcaaaactataccaatatcctgacctgcctggcggatcgcatgagttgagaaaagaaatccataaaaaactggaaggatatttagatcctacatcctatagtgcgaacggaaaatttattatttctttcatcatagatacggacggcagtatttctactgtagatatcgaacctaaaatagataatagtgaacagttttttgaggatattaaatttattttgaaaaaaattaaagtaaaatggaatcccggaaaaattaaaggacaacctataaaatcaaaattcagaatgccattcaattttaaatcaagagatttagattaagattctcgaaaagcagttcttttgtactttgcattttatccctgtatatttcacattttacaaatccttttctatctttgtgggaaataaaaaattcatggataaaattgatagtctgaaccaagtagcagaattccatactactttcaaagcccctattttagataccccacaaattccttctccggaaagatgcaatctcagagtagaacttttacaggaagaacttaatgagttaaaacaggcaattgctgataacaatattgtagaaattgcagatgcactttgtgatttacagtatgttttaagtggtgctgtgctggaattcggacttggcaacaaatttgtagagctattcaacgaagttcagcgttccaatatgtcgaaagcatgtgataatgaagagcaggcaaaagaaacagttgaattttataaggaaaaggaagtagaatctttctatgaaaaatccggagaaaaatttaatgtttacagacaggcagatcataaagtattaaaaaacaaatactactctcctgctgatttaaaatcaattatcgaaaaataaaatatgaaaaaatttattaccaatattgttgccgtttcaagcttgtttttagctgcacaacagctcagcgctcaaaaagtagtggtaaaccgcgaggttgaaactcagaatgacggcaaaatgcttttgggaaaccaactgaaggagcagtttttaaaagcgccttacgcagattggtacgtaaaggaacatgatgaatatgcccttgaccaaaaagcagtcagtgaattaaaaaaagagaaaatcgggtcttatgatatcattgttttcatgggaacatggtgtgaagacagccacagagattttcctagactgatgaaaatattggaagccgtaaattatccggaaaataaactgactatcattgccgtaaaccgcaaaaaagagtctccaaccggggatgaaagcctttacaatcttcagaaagttcctaccattattctgaaaagatatggtaaagaggttggaagaattatagaaatgcctaccaccggatatattgaaagagatttagttcaaattttgaaaaagaacgattcgtctgttatcaaagaaatttttaaatagattttgagaaattatagaaccatattatcctttgcagccggtgccggcgctatggtacttctgttctttggactgaagtcctgcctgaacctcggaaataaaacggaacagtcggattattatatcctgaccaaccagatttccaagatgaataaaatggtcgtattggaacaaaatacttccagcatgcagaaaaccaaaatgggttatgaagtttttggaaaagaaatctccagcaacagtattatcacctataccaaaacgaatgcacaggtttcctacgatcttaataaaatgaagattgaggtagattctatcaataaaaaactggtgattaccgagcttcctgatgctgagataagaattacgccaagcgttgagatccaatctctggatgattctttcattaacaggatttcggaaaaggatattaaaaatgttacagcaaaagctaaggaaacagcagaaaaatcaattgaccagaatcagctgagaaatgaaggccggaaacaattgatggaaaacctgaataatatttttgttttggcaaaagccctgaattataccatagaggataaaaccggtaaaattggtattttgggactgtagaatgaaatttttccgtttggcaaaccctttgaataataatttacatgttcttggaacttaaaatgtaaagtcatggatacaaaaggaaacaccaaaaagaaagaatctgccaatacagcagagaccaaaaaacaaaatcaggattttcagaatattcctgcagcatcaaaaaagaccaatccacctgatattgataaagaagatatccggaaatcatcaaagaacaaatcaggaaaaacggataatacaaaagacaaaaagcaataagacttttataattgaaaagttccgtctcatgcgaggcggaacttttcgttctaactatctaactgaacttttattttctatacaatggtggatttcccgatctttacattttcaaaattataatatgacgtttcggaatatctgatatggtctgcaataaagcttcccacttcacttgttgagtaatattgtttcgtattaagatcaacagtgacgtatttattttcaatagcatgttctactgattgtctcaatttgtcggctgcggcctgtaaattaagatgatccagcatcatagccacacttaaaatagaagccacaggattggcaatgccttttcctttagcctgaggataagatccatgaataggctcaaacagggcattcttctctcctactgaagcagatggcaacaacccgatagaaccaccgatcacacttgcttcatctgaaataatatctccaaacatattttccgttaaaataacatcaaaatgcttaggattaagaatcagctgcatggcggcattgtctacaaacatataatcaagctctacatcaggatattcaggagcaatttcctggcatgtttttctccataatctcgaagtatccagaacattcgctttatcaataagcgtaagtttcttctttcttttctgagcttcctgaaatgccatatgtgcaatcggaataatatcttcacggctgtatttgcagacatcataggcgtaattaccttccggatctgtaaatttttcaccaaaataaattccgcttaccagttccctgaaaatctggatatcagctccttcaataatttctctcttcagcggactcttatcaatcaatgacggataggtcttcaacggacggatattggcaaacaatcccagctctttacgaagttttaataatccctgttcaggtcttacttttgcttccggattgttatcaaacaccggatcgccgatagctccgaaaagtacagcatctgattctttacatatctttaaggtctcttcaggcagaggatttcctgtcttaaaaatagcttctgcaccgattaatccgtagtcaaaatgaaatttacattgaaaaacttcagcaatagtatctaatatcttaatgctctcaccgataatttccgggccaatcccatctccgggaagaaccgcgattttaaaataattgtcgttcatttgttttttgtgtttttagttcgaattctgtaatggctttttttctgctgattaagaaatcaatatcatcataaccgttcagcaggcatatttttttataagagtccagttcaaaggtttctgtggtatctttgaaactgacagactgtaattccacatcaatagcaatttcctgatcaggattttcattgattccttctaaaatttcttttaaaaatccttcggaaacctttacaggaagaagtccgttattcagggcgtttcctttgaaaatatcggcaaaataacttgaaatgataactttaaatccataatctgttaatgcccaagccgcatgctccctgctgcttccgcagccgaaattatttccggcgacaagaatttcaccactgaacttaggattgtttaaaacaaaatcaggattcggttctcctgtatgaatattgaacctccagtctctgaacagattctctccgaaaccctttcggtctatacttttaagaaatcttgcaggaataatctgatctgtatctatattttctgccggtaacggaaccgcagtggattttataataactaatttttgcatgtacttttagtgggtttagtttaaactttcaaaagctgaaattttaccttctatagctgcttttgctgcggtgagcggactggcaagaattgttcttgcgccttgtccctgtctgccttcaaagtttctgttggaagtggaaacacagtattctccttccggaatcttgtcatcattcattgccagacatgcggagcatcccggctgacggatctgaaaacctgcatcattaaagattttatccagtccttcctcataaatctgtttcaccacctgctgggatcccggaacaatcaatgcttttaccgcttccgctttgcttttgcctttgatatattgagctgcagaacggaaatcttctatccttgcattggtacagcttcctataaaaacataattaaccttgatactgttaaccgcttgtccggcttccagccccatatattgtaatgccttctcttcagattcattctgcggcgcaggaataacttcacggattgaaatacccatgcccgggttggttccataagtaatcatcggataaatatctgatgcatcaaagctcagttctttatcaaatactgccccttcatctgttttcaaagtcttccagtattctactttttcttcccattcttctcctaccggcgcgaattttcttccttttacgtattcaaaggtggtttcatcgggagcaatcattcctcctctggcacccatttcaatactcatattgcacacggtcattcttccttccatcgacatctcttcaaatacatttcctgcatattcacagaaatatccggttcctccgtctgttcctatctttgaaatgatatacagaatcacatctttaggctgaacattttcgtttaatttgccattgactgtaattctcattgattttggcttattaagcaacaggcactgacttgcaaatacctgtgccacctggcttgttcctattccaaaagcaatagttccaaatgctccgtgggtagacgtatgactgtcaccgcaaacaatactcattcccggctgggtaatccccagctccggagcgatgatatgtacgattccctgatactgatgccctaatccgaaaagttcgatattatttttcttacagttttccgtaagctgttctacctgatttcttgaaagttcatctctgataggctgctcctgatgcaaagtgggtacattatgatccgcggtggcaacaatctgttccggtctgaatatttccagatttctggattccagttctgcaaaagcctgaggactggttacctcatgaatgagatgtttgtctatataaatgatctgaggtccgtcaggaatggtttctaccacgtgcgcgtcccaaactttatcaaaaagtgtctttttactgttgttcattgtttactttatcttgattttaaatcaaacctatcctatttttctggcaaaagaatgcatcatcatgttcaggtcctcattgtctatttcttttttaaggtcggcgatcttcagaaattcctggtacaggtaatcaagttcattcttggtaacttcatacccgatatgcttaaaacgatatgccagtgccgagcggccgcttctggctgtaaggataatggaagaggcattcactcctacttctgcgggatcaatgatttcataggtttccctgtttttgattacaccatcctgatgaattcccgaactgtgggcaaaagcattggctcctacaatagctttgttaggctgtactgccattcccatcagatcggataccatggcactcatttcattcagcattcttgaattgacattggtatgcagattcaggtctttatgctgttttaaaatcattacaacttcttccaatgctgtattaccggctctttctcccaatccgttgatggtacattcaatctggcgtgctccgttaattgccccggcaatagaattggcagtagccagtcccagatcattatgacaatggcaagacaataccgctttttcaattccctttacattttctttcaggtattttattttctggccgtattcttccggcagacaatatcctgttgtatcaggaatattcagcactgtagctccggctttgataacagcttcacaaacccttgcaagatattcattatccgttcttcctgcatcttcagcatagaattctacatcttccacataggttttggcatatttcacagcttctgccgctctttcaataatgtcttctcttgttgagttgaatttatatttaatatgagaatctgaagttccgataccggtatgaattcttggtctttttgcaaatttcaatgcttctgctgccgtatcaatatcttttttattggctcttgtcaatccgcataccttagcatttcttaccagttttgaaatttctgaaaccgattcaaaatctcccggactggaaatcggaaaccctgcttcaatgatatcaatccccagctcatcaagcttttcagcaataaccagtttctgttccgtattcagtttacatcccggaacctgttccccgtctctcagtgtcgtatcaaaaatttcaattttttcggaattcataaatgaagttttttacttaattttgattcaaaactacagcttgcaatattttttcattttcacattttttgaaaattacaatattcaacagttgaaaaaacaatcttatttacctattaatcaataatttaatttataaaaatttacaatggcagaattgcagaaagattttttgtttgtattggtaaagtcattgactacttctgaaaagcgacagtttaagctgtatgtaaaccgtctcggaattaatgttgatgctaaatttcttctgctcttttctgagatggataaaatgaaggaatatgatgaaacagtgattattgagaaaaaaatttctaccaaacaacagctttccaaccttaaagcccatctttacaaacagattctggtaagcctccgtatgaacccgagtcatcagaattatagaattcagcttcgggaacagctggattttgccaatattctgtatcagaaaggcctttataagcaggctttaaaaatattagataagactaaacagactgcactggaactggatgaaaaaagtattgcttccgaaatcattgatctcgagaaagtaattgaatcacaatttattacacgaagtatcgaaggccgtgctgaagagcttatcaaacagtctcaggagatcagtaagcaaaaccgctacacgacaaaactttccaacctttcgttgaaattatatagtgaaatgcttacccatggttatgtaaaaaatgatacagaccgacaggaagttatggatattttcaatgctgaaattaaaaatatcaatcccgaaaaactgaatttcactgaaaaattatggtattataaagcccatgtatggaagaaccagctattacaggattataaatacactctgaaatatgcttatcagtgggtagacctctttcataagaagcccgaaatgatttacagccatcccgtctggtatattaaaggaaacacttatctgctcaagatcctttttctgtatggaaatattgacattctggaggagcattttgagaattttaataaaatggtacatgctgagaactttgttcagaatgaaaatcttcagtcccttattttccttacccagtacaataccctgatgaatattcactttgtgaaaggagaattttttaccggtaccaaacttattcctgaagtggaattgaaaatggaaaaactcagggaaagaattgatgagcaccattttatgattctttaccttaaaatggcggccatgttttttggcagtaaaatgtttgaaaaatcaattgagtattctatgagagtcatagaatccaaaggtaatgtacaggaggatctgctgttccatacgagaattctgatcttaatggcaaaatatgaatccgggaatgatgaagattatgatgaatttattgcttctactttgaagtttgctaagaaaatgaagaaaccggaagagttccattttgaaagcattcagttttttaagaatcttaataatcaggtgccggatcagagacagaaagcctttgaaaattttgataaaaagctggaagaattttcgaaaaatgaatattacagacgttcattattctatattgacatccatggatggatcaagtctaaagtccagaatgtagatgtgattgaaattatcaagcagaaagtaaggtataaaagaaaacattaaacaatatcaattaacaatctgtttttaaacatattaaagcatgttatttaatgtaaaataaaacagtaaaaaaatcccgcagatttagcttattatcacagataaatataaaatctgtttcaatttccaaatctgcaggatcataaaatcatattaactgtattctactcatacatattctcaataaaattaagggcatttctatggctgattttttctgccagctcagatgaaaaacgtttttcaatttctttattaattgcagaatatcccgaagcattggaatgttcaggaaagaaaaaaggatggcgggatgtatccggatgatccttccaataaaaatagtctgcaccgtaagccatactgttttctccgccaagatctaacccgtattggatatgctcgtaaattctatccgggttttccgtatctacataatccttgataaaattcagcccgatcaggccttttcttctgatgacttcctttgcaagttcatcaggaagattcctgttgttctgataaacagacctgtagttggaatggctcgccagaaccggaattgaatagtttctctgatcaatataagtaaaaatatcatgggccagctgatcacttgtatgggccagatcaatagcaatattacggccagcaatataatcaatcagaactttcccgtcttcctttaggccggcagtggcattatttcctcctccaaaacggttttcaaggtgatgtgttattccaatgtaaaagactttatctacattttcaatcatggcttccaggtttttgaatccggaatcaagactttgattttcatcacaaaaagcggatgcattttcaatggaagcaataattcctatccggttttcgttacctggctctttataatgatccttattataaagaaagaagttttcatttttggtaagatctgaaaataagcggctctgtttcaacccataattggtgctgtctgctcccgttcctgcgtacattgccatcacctgaacttttacatttccttcccgtaaataaggaagtgagcagcccagctctttatcatcaagcgtggcacctgatctcagcatataataaagtaaatcgcagtggagatcaacattgattgtattcatattaaaatcgtaattcgtttattattaaagctttaaatcagaaaataaatcttaaaactgaaatgatgaatgatcaaaaatcagcagatacttttcactaaaaaactgattatagaatttaatgagacaaaagctttcttcatctttttcattttaaatattaattctcattctaattgtaagctaatatagtattttatctaaaaaatgcgtatttttgcatcttaaaatttcttagtaaacaatgataaaaattacacttccagacaatagtgtcaaagaattcgagggagcagttactcccctagatgtggcaaaatctataagcgagggattggctagaaataccatttccgcaattgttaatgacaaacaagtagaaacgaccacacctataaccacggattctacggtacagcttttgacctggaatgatgatcttggaaagaaggctttctggcactcttctgcccaccttttggcgcaggcaatccttgagttttatcctgatgctaagttgaccattggtcctgcgattgaaaacggattctattatgatgtggatttcggggatgaaagcttatctgaaaaagattttgaaaagatcgagaaaaagatcttagaaaatgcaaagaaaggttctaccttctctctgtatccggtttctaaagaagaagctttaaagacttatgcagacaatccgtacaaagtggagctgatctctaatcttaatgatggagaaatcacttttgtaacgcatgataacttcacagatttatgtcgtggtggtcacattccgaatacgggaatcgtaaaagcggttaaaatattaaacgcagcaggagcctactggagaggaaatgaaaagaatcctcagttgaccagggtatatggtatctccttccctaagcagaaagatcttactgaatatcttgaaagactggaagaagctaaaagaagagaccacagaaaattagggaaagaacttggaatttttgcattctctgaaaaagtaggtgccgggttaccgctttggttgccaaaaggaaccgctttaagaagaaaactggaaaatttcctttctgatgctcagaaaaaaggaggttatgaatttgtaatgtctcctcacatcggagcaaaagaattatacgtaacttcaggacactgggataaatatggagaagacagcttccaaccgattaaaaccccgaatgaaggagaagaatttttgttgaagccaatgaactgtcctcaccactgtgaaatttacaaaacgtcacaatggagctacagagatttgccaaaaagatatgcagaattcggtacggtatacagatatgagcaaagtggagagcttcacggattaacaagagttcgtggatttactcaggatgatgctcaccttttctgtactcctgaccagctttctgaagaatttgagaaagtaattgaccttacactttatgttttcaagtcgttaggatttgaagattttgtaactcaggtttcgttaagagatcctgaaaacaaacaaaaatatatcggttctgatgagaattgggagaaagcagaaagtgcaatcatcaatgctgcagaaaagaaaggtttaaaaacagttatcgagtacggagaagcagcattttatggccctaagcttgacttcatggttaaagatgctttaggaagaaaatggcagttaggaactattcaggtagattataaccttccggaaagatttgatcttcattatatcggaagtgataacgaaaagcacagaccggtaatgatccacagagcaccttttggttctatggagcgttttatcgctattctgttggagaatacagcaggtgatttcccgttatggctaagccctgatcagtttattattctaccgatcagtgaaaaatatgtagattattcaaaaaaagtttcacaatttttggaaaatcacgatattagcggtcagattgatgacagaaacgagaagaccggtaaaaaaatccgtgatgcagaattgaagaaaattcctttcatgctggtagtaggagaaaatgaagaaaaagaaggcacgatttctgtaagaagacgtggtgaaggagatcttggagtgatgaagctggaggattttgtagcttactttaaaaaagaagctgccatataaattgaattaaaagattaaagaattaaaatattgaaaaattactaagtgtaaatcaatcttttaatcattatttttttaatcttttaattgagaataaaatagtaattaaccaataaaattataatacaatagcacaaagatttaacaacaggggcccacagagacgtccggtacaagaggacgctcacttgatcaacgataaaattcgtgtgagagagcttcgtttggtgggcgataacgtagagccgggaatttatccaattgacaaagcaagacagattgctgcggaacaggaattggatttagtagtcatttctgacaaggcagaaccatttattgcaagagtattggaatataagaaattcttatacgagcaaaagaaaaaacagaaggaacttaaagctaagcaggtaaaagtggtagtaaaagagatccgtttcggacctcagacagatgaccatgattacgaattcaaaaagaagcatgctgaaaaattccttgaagaaggttctaaattaaaaacctacgtattttttaaaggacgttcgattatctttaaggatcagggagaaatcctgcttttaaagcttgcccaggaactggagcatgtgggaaaagtagaccagctgcctaaacttgaaggaaaaagaatgattatgatgatgagtcctaaaaaaccggcaaaataattaagtcattattttacatacaaacctcaaagcaatttgaggtttttttattgcttttaaagaaaaagaccgttgatcaggactactctgctgtctgagtcaacggtcaatcatttaaaagatatttaaccttcaaaatcaccgcaatcatgctctttgaaaagcggtaaagcttttttagtagtgaaatatttagagactcttttgttttttaattccagcttctggccttctataaccagttcgtagaccggagccttatcaatttgagttaaaatatatgttctttcaggagttgtaaagaccgctttattttctgctctgtcagagaacgaaaaatcgtgaatttcaaaaatgtccttttcatcacagacatttgtccatttgattgccttctttgtgatagacaaacttgccaggtcacacgaataacagtttccggaaaactctacgccatatttttcatacacatgagtgctcttgatattcaaaacatcaataggaaccaatgatgaaaaatcagttggaatatcggattcttgtctatctttttttacctgagcaggagcagaaacctgttttacgtttgcgttttcagaatctgcattgttcatttttttatctgtagcaggagaacatgcagctaagattatgattgcaattgacaggctggttattatgtttttcatctttaaaaataatttacaatatctggtttatcttttttgtaaaattctccaaaatcctttgttcaacacatccctgttttcagccatttatcccttattacaagccgttttgctaaatgtcgtctgaacaaagatgcattcactacaaagaatgttatcatttattaattgattttccacagatttacaaattacgcagattattatgtttattgatactgccgtttattttccggatataagattaaaaattgatattatggaaagataaaaatcaggaaacggcaattcaaaaacccctgaaaccagccagtgtgtatggatataaagtctaatatctttgcagcaattatttaaagagatacaatgaaaaaattaagtttgaccatccttttttgtttgttaagttttatggcttttgcacaatcattaaaagtagttatcaaacaggatggaaaagttattgagccggtaaatgatgtttatgaactgaaaaaatctcctttcctttttgaaattacatcaaccaatctggaagggttcttagtgggagccactacgaataaggatatttatgcgggagctcttggcgttttaaatactgaagttgaatggtttcagaacacaggaatggcagaggaattatataacaaggacaaagaaatgttcctgatggattctgccccttcgtattggtactatacagatgcgaaagatcacaggtttgacaaaaaccctaaaggcaatgccaagcaatggactgctacacgtactattacaaggttttatgatattatggtagatcagcccatcaatttgaaagattttaacggcagcgttttcatgctgatgtatcagcctgtatataatgacgagtatgatttaacagacaagaaaaacctgtttcaggctgcgttgaaattcagagattaataaatacacaccaaaattatttgattatataagaaaaaggttgctttcattatgaaaacagccttttttgcgatatatattttattcaataatcaacccatattctatagctaatctgatggctgaactgagattggatgtctgaaacttttcaataagatttttcctgtggctttctacagtatggggacttataaataatttctccgccatttgattcgtagtaagtcctttggcggcttccgccagaatttctttctctctgcgggtcagtttcggaacctggtttaatccgtcagctgattttttcttcagaacagactgcgtttgtgaacataaaaactgttccccttcatataccgcagtaatgccttccaaaatctcggaaacagatgcattcttttgaatatatcccaaagcaccttcagctaaagtactgttgattacaggcagttcattgtgaacgctgaggatgattatccggaggttgctatactttttctttaagggtttaataagttcaatgctgttggtatcggcaagattgatgtccagcaataaaatatcaacagcctgttttgcaaggccttcattcatttccgaaacatttttgaagcaatctaccacgtctattgtgctgctgtttcctaaaatattcttcaatccttccaaaagaagtggatggtcgtctgttatggctacttttatcatgtttaatgaatagggatttgaatttctatactggtaccaatattcaattcggaagtgatattcatcgttccttttaaaaactgtacccttaattctatattgtgaaaaccggctgttttcctcacgtccagagctgcgaggtcaaagcctttgccattgtcctctaccgtaacgttcagctggttttgttcttcgcttatctgaataataatttccgaagtctcggcatgttttatagcattgtttaccagttcctgaatgattctgtaaacgatcagctgtttttcctgggacaacgaattactgtaattgataaattcggtatggatatccagtgcgttgttggatatgcgggaagcaaactcttcgatagcaacctccaaaccatatttcattaacaaatcaggcattaaattatgtgcaacccgtcttaactcttctactgcaccatcaatctgttcaagtgatttcgaaattccttcctgtaaattttcggactgatgaggatttaaataagacagctgatgtttggtcccggaaagcaatccgcccaatccgtcatggagatcacgggccagcctgccacgctcctgttcctgcccttgaagcaatgccgtaagtgttgaaattttcgaattttgtttttcttgctccatcgccaaggcatgtaattcatctcttcgcttaatggaccgggcacgttgcttataggcataaagcagtaagaatatcagaataatgaagaagataataaaaaagacataataggtattgatcttttctttaaaagcgagcagctttttataactgttgatatcattattcttctgttgggtctctaactttgccaggcgaagctgttgttcttttttctcggattcaagttctgaaaacttcagccgttcccgctggttttcttccaccagctttaagttgttgtatacctgttcacgctgtgcccggactatattaatcaacttgatttcctgcgcttttttatcactttccagctgcagcttgatgtacttctgttcttgccgttctttatcaaactgagattccagtcttttggtaatatccagtttttcctgatcgtaaacgtttttgtactgatcaacataacttttgtaataagtcagagcctctttgtagttcccctgttgttcgctgattctggataaagattcaagaatagccagttcaattctctgatctctgaccggactttttccgatttccatagaagctttcagaaagtaggacttcgccaaatcataatttttatcctgtatagccagttcagccaggattccgaatgaggaagcaatatgaatggcatcaccggtttccagactcacacgattggccagctgagcatactgcatggccttattgctgtcaaaaccggtatataaattggctaaattgattgcagcatatgacaggttgctcctgttaagcattctatctttatttttgttaaatgttgtaatggcctgcaggtaatactgttccgttttatttctaaactcagtattggatggaaattgggtatatttttgttcatatacatagcccatccgcatataggcatcgaaaataagattaggatcattttgtttggatgccaggagcaaaaattgtttgctgtatttctcctccagctgatattcattgaggttggcataaatagcggacagctcttttgctgcattgccaaatcttgcatacaatgtagaggtcgttggtgagttttcgaaatactcaatagcttttaaataggcggcgacagcatctgttgttttattattacgttccagaatccagccttttgcgtaatagtaatagcctttagtctcggtgctactcgtttttaaactatatactcttgccatatcaaggcttttcatagactccgctgctttattatccagccggtaattcatggcctgcacagcgtataaaattgtggcatattttccatcagactgctttctcgcgatggaaatattggtctctaagatctgattagatttggatttaagatcatgaaagaataaggcacttgcatacttgggagcaagattgagctgctctgctgtattatttgacgcatggttgtattccttttctaatttgcttaaaatgtcctgcgcatgtacaaaaaacggactgacaagtaaagtgaatataaataatagcctgcgtatcaaatctttatctttatgaagttgtaatatagtaaagactgtaaatataagtaaatacctgctaatcgaccttggtctgttttcctgaaccgaaaagcaggagcaacaattacttttacagcttcttttcctcccaatttacctggctgttgtttttacccatactttttagttgtgttcgttcgaaataagaatttatcattgaatcgggtatgaaaaagaaagctataaaagttgtacattcatatttatctaagagaatggctatcaggaatgattatatgatcatgattttttaaccgttttgtctttgacaaatttttgcgtcaaaggtaatgataggagccatacgaaaatatccctgataacagtggtttttagtgtatccttttttacttctactcccatgaattttaaggcatataagttccaccttgttcaaatagcatcatatagcaaaaagaaacagccagtacgactccggtaagtccggaaataacaaataaaagaagatagtatgaagcctttttacttttcttctgtaaagaattaataataaaagcaatgagtgtacatattaatcctgctccgaaaaaaatgattagcacagcaaggaataatgctctttcaaggtgtaaatctgcagatgaaagcattggtatattaaatttatgggttaaaatgaaacttccgaaacttagttattcaatattagagagaattacgggatatgacaatcccgattatcaggtatatttgatagtacagaaggtttcaaaccggaaggtgcattgttcttattgatgtacattaaaatttcctttcatagatgacttttttttcgtaattttgcaaactattattcctgatgtctttaggaaaccataaacagatattgataacaaaaacaataaaaaagcaaaacaatgccaaaattaaaaacgaaatcaggtgctaaaaagcgttttgctcttaccggttctggtaagatcaaaagaaaaaatgcttacaaaagccacatcttaactaagaaagaaactaagcagaagagaaatcttactactacttcttacgtagctaaagtggacgaaaaaagcgttcaacgtcaattagcaattaagtagtttttataaatctatattcggtttataagaattcaaaacaaattcaacaatttaaccctggaacggtgccaataaagagtaacagctgttaccgcccttttcaaaaaaacaatttaaattatgccaagatcagtaaatgccgtagcttcaagagctcgcagaaagaaaatttttaagcacgctaaaggttatttcggaagaagaaagaacgtttggactgtagctaaaaacgcggtagaaaaagcaatgcaatatgcttaccgtggtagaaaagagaaaaagagaaatttcagagcactttggatcactcgtatcaacgcgggaactagagagcacggaatgtcttactctcaatttatgggagctcttaaaaagaacaacatcgaacttaacagaaaagttttagcagatttagcaatgaatcaccctgaagctttcaaagctgttgtagatcaagtaaaataatgtagaatagattttgttatcaatataagtcccgggatttcccgggattttttttgtggtatcctttttttgcttcagtttaaatttaatctgtgcaacttatgtggagtttaaaacaaataataaaattcagccttacctaatgacaaatggcataagaagatatatcattgtcaaaaaaacaagaaaatatgcattgcagcgaacaactaataataataaataatcatttattactatattagcaatcctaaagaaagtataaaaatgaaaaaagttgcagcttttttgctcacttccatcgcactgcaaaatacgagtgcccagagttttatccaagcttataaagacagggcagatatggtaactcaaaccaatattaacaacaatcttcaggaatttgcaggatttggggtaaaaagaacaggcacagcagccaataccaatgcgctgaactggcttaaaaataaatatgcctcctatggatataccgcaaatgatctttctgaggacactttcacttatggaagtaatacttcaaaaaacctgatcattaccaagaccggaactttgtatcccaaccaatacatcattatctgcgggcattatgatacaataacaggtccgggagtaagtgataacggaagcggtacttccattattcttgaagcagcaaggattcttaaaaatgttcctactgaatattctatcaaattcatccatttttccggtgaagaacagggacttgttgggagcagccattacgtaaataatgtggcataccagtcaggtacaaaagttctggatatcaagcttgttttaaatattgatcaggtaggaggattgcttggaaataacaacaatacaatcaactgtgaaagagatgaaggaggaatgtccgccaacaatgcagcctcagatgttgcaacgcatgagcttatgacatgtacaagtctttattctcctcttcagaccaacctctcttacacttacagctcagattacatgccttttgaagctaaggggtatactattacagggttttatgaaactatcgaaagtaataatcagcataccgtaaatgatacttttgccaatctggatccggtgtatgttctcaatgtaggaaaagcagccgtgggagctttgcagcattttgccgttgcttctacaaccaataatctgctcagcacaaatgatacctctttacaaaaatcaggtgaagtcatcaggctttatcctaatcctgctaaagatctggtgactgttgaatttgagcaaaaagtaaagcaattcaaaattgaagtgaatgatatggcaggaaaccttgtcttaaaccttgaaaaccaggaaaaaattaatacatcaggattaaaaaacggagcatatacctttaccattaagactgataaaggaaatacaaccaaaaaaataatcattaataaataatatcaggacggaaattttgaatcagacagcattcaaaagatatccgtattacgattatataatgaagaaaatcattacttttttactcgcttctattactttgcagagcattgaagcacaaagcttcattcaggcttatcaggacagagcgaatatggtgacccagacgaatatcacagccaatcttcaggagtttgccaacctgggagttaaaaccacgggttcaacagccaatgccaacgcactgacatggcttaaaaataaatatctttcctacggatattccgccagccagattacagaagatccttttactgcaggaagtcataattctaaaaacctggtgattaccaaaacaggaactgtatatcccaataaatatgtgatcatatgcggacacttcgacagtattaccggtttaggaatcaatgacaacggaagcggaacttctattattctagaagcagcaagaattctgaaagatgtacctacagaatattcaattaaattcattcatttttcaggtgaggagcaaggacttctgggaagccagcattatgccaatacggttgcttatcagaacggaacccgtgttctggatattaaactggttttcaacctggatcaggtaggcggagtgatgggcaacaataacaataccgtttattgtgatcaggaccttggagggcttacttccaataacgcagcttcagcagctgtaacccaggaactcagaaactgcacggcactctactctcctcttctgacagccgtagacccggccgctgatacggattatattccttttgaacaaaaaggtgaagtgatcacaggtttcttcgaaagaatcagaagtacgtatccacatactgtgaacgatacttttgccaatacagatcctgtatacatttacaatatagggaatgcatctgttggggccttacagcattttgccgttgctaccggtactttgggcacccatgaagccactgtaaaaaacatattggaaacggtgaaaatttatcccaatcctgcaaaagacatcatcaatattgaacttcctgattccggaattaaaaattttacttttgaaatcactgactttcagggacgttccattttcaagaaaaacaatgaaacgaaaatcaatgtttcaggattagagaatggtgcttatttaggtattttaaaaaccgaagatcaaaaggtcgtaagaaaagtgatgattgaaagatagcaacatgactataaaaaatagtaacagaaacctttgaagtaattcagaggttttatttttttcaacaccttgttgaagtatttatagcacatagccaacattggtatgatattcataataaaattcatgtgattttgatacattaaacactttattgtgatttatttactacattcgtggtaccaaaaataatatcataatatgaaaaaattaacaacacttttatgcactgcactaatgatgcagagtattgccgcacagagttttatccaggcttacaaagacagagcggatatggttacacaagccaatatcactacaaatcttcaggaattcagcaatttaggcgtaaaaaccactggttcggtagctaacgcgaatacgctcacctggatcaaaaacaaatatctttcttatggttatactgccagccaaattgtagaaagcccttttacctttggaagtacaagttcaaaaaacctgatcatcaccaaaacaggaacactttatcctaataaatatgtcattatctgcgggcatttcgatactatttacggtccgggagttaatgataatggcagcggaacatctattatccttgaagccgcaagaatcctgcaaaatgttccgacggaatattccattaaattcattcacttttccggtgaggaacaggggttgagaggaagctcccattacgtgaataatgtcgtatatcagggaggcgtgcgtaagttagatataaaactggtcttcaatctggatcaggtcggcggtgtaaaaggaaataacaacaatacggtatactgcgatgaagatcagggaggtgtttccagtaataatgcagcttctgcagctgttacccagcagctgagaaactgtacggcgctttactctcctcttcagaccgctgtagaccctgctgctgatacggattatataccttttgaacagaaaggagaggtaattacaggtttttttgagagaataagaagcagctatcctcacagttcaaaggatacttttaccaatatggatcctgtttatgtgtacaatatcggaaaggctactgtgggagcattgcagcattttgcaagtgcatcaacaacaatgagtaaacctgctgctaaaaataccctggaaacggcaaaaatctatcctaatccggctcataacgtactcaatattgaattaccggattctaaagcaacgaacttcagttttgagatcagtaattctatgggaagatcaatgctgaaagtaagtaatgaaagaaagattgatgtttccagccttcagaatggagtgtatgtgggagttttaaaagttggtgaagagactcttgttaaaaatattatgattgaaaggtaaatattatcagattcaacgtaagaaaacagcaggaatatcctgctgtttttattattgtaaagctattattttctgtatttcggactttatccgttctgtaatccagtcttgttcttcagaagccagatctccgagcagattcccattattttcattaaaatctgtaaggacatcctgtaaaaactcgtgctgaatttcatgaagacgatccggattgcttttatcaaacgccccgactttggaagttacactttcaaaccggttctgtgttacataagttcttaattcttctgtaataaaggaaagactttctgcttttgaagaaatatccggaacaaatgaccatttttctgctttatgaaacttttcttcttcatcaaattcagggtttttcagcttgataaccgggcgtttagacagcaattccttatcttttaaattatagggtttaatcacaactccttcaatcagattatattccagatcaggaagtccaagctcttttggaaccggagaatttattctggtattgaaattcagagcttcattgaattttcctatgaataatggttttacataggatatcccgaattgctcaaagtaggatgctgcagtttcataatccatataatttttcaatcctgattcatcaacaatggctatatcaaaagcataaaaaagaatatcaggtgtatagtaaactcctgtctgtacagcctgtacattttcaacggcagagacttccgggtgcggataatgtcctccgaataattctccatatacaatatacctgacgccaggcactgcagttctcagatgctcaaacaatgaaagcatcccatcctccaattggctgacaacaagctggaacccaaagaaatcatctttccagtcaagatactctcttcttttagcatatctgagtgtatcattttcataagcgaaactgaaattggcaccatggattttctcagtaaccacccatttcagtttatccatttttgacaattcaccttcattgagaccgagtttcttcaatgaatcaggcattttttcgtatccggaaaattcagttaaggctgtattgttcatattagttgttaaatatattattttagctgacagaaaccatatactttgttatggctttacttgtctctgttctgcaggatctcttcaatcgcttccagcgaaaatccttttgctttcaataaaatcaaaaaatgatacagcagatcggctgcttcatttttaaagagatcatcattactatcttttgcttcaatcaccagttctacagcttcctctcccactttttgagccattttattgattcctctctgatagagcgaataagtataagaatcttcagcttttgaatctattctctgagctattttttcctccagttcgtacaggaatcctttcgcattcttttctccgaaacagctgaaacgtccggtgtgacaaaccacattctttggaactgctttgattaaaatggtgtcctgatcacaatctatatcaatactttttaccgttaaaaagttacctgattcctcaccttttgtccagagtctgtttttggaacggctgaaaaaagtaacaattccttctttttttgttttctcaaaagcttcttcattcatgtagcccaacattaaaacctgcaatgttctgttgtcctgaatgactaccggaacaagcccgttgtctttattaaaatctattttcatcgtacttcaattttttgcgtttttaactgttccttcaattcctgaatccctatttcattaaaatggaatatactggctgccaatgcacctgtagcttttgtttcatcaaacactttaacaaaatcatctgttgtacctgctccaccggatgcaatcacaggaatactgattgcttccgaaaccagtccggtaatacggagatcaaagccatttttagtaccatcaccatccatggaagtcagcagaatttctcctgctcccagagattcagcttgttttgcccattctactgtagagagttctgttgcttctcttcctcctttgatatgaaccagatccttatctcctaccttccttgtatcaatagccaccacaacgcactggctcccgaattctttagctagatcagaaataagctctggattttttactgctgaggaattgatactgattttgtccgctcctgcttccaaaagctttcttacatcttccacagacgaaattccgcctcctacagtgaaaggaatactgagttcttttgcgatgtcttttaccagctgtacaaaggtttttctatcttcaatagtagccgtaatatccaggaaaacaagttcatcagcaccttcctgctcgtattttttagcaagctctacaggatcccccgcatttttaaggtcctcaaaattgactcccttcacggtagacccgtctttaatatccagacatggaataattcttttcttaagcattttcaataaaattttgaagttgtggtaagcttatttttccctcataaatcgctttcccgataattgttccggcacatccgatatttttcattttatagacatctgtgatgcctgaaatgcctccgcttgcgaccagctgaactgatgttttatataaaatctcaatatataaagctgttgaagggccttccagcataccatcctttgcaatatcagtacaaatagcggtttgtacccctttttcctgatactgaaggataaaatcaatgatatcatgagcactttcttccagccagccagaggttttaatttttctgttttcgcagtctgcacccagaataattttttcagcgccatacttttctatcattccgaaacagaattcaggattctgaaccgcaatacttcctaaagtaatctgttttgccccggaattaaaagctgtttcaatatctttctgagtttttaagccacctccaaagtcaatatgcaatgaggtagacctggcaatattttccagaactttctgattgacgatatgttttgatttcgccccatccagatctaccaaatgtaggtactgaattccaaagctttcaaactctttggccacttctacaggatcttcattgtatattttctttgtattgtaatctccttttgataaacggacacatttcccgtcgataatatcaatagccggaattattttcatgattataaatttataaagttcttaacaatctgatttcctactattccagatttttcagggtgaaactgtactgcatagaaattgtctttctgcaaagaagcactgaatggcaggatataatcacaaacagaagtggtaaagtcagaaagctcacaataatagctgtgaacgaaataaacatcactactttcttcaattcctgaaaacaatggcgaagtcttcccggaaacggtattccagcccatatgcggaacaatatcctttgaaggaaattttctgacattgatatcaaaaattcccattccttccgtatttccttcttcattttccccgcacatcagctgcatgcccaggcatattcccaaaaccggctgtttaaggcctggaatcaaaacatcaagctctttttctttaagcagtttcatggtggatgaagcttctcctacccctggaaatatcactttatcggcctttaagatcttttcaggatcatctgttattatcgattcaacattcagtctgttgagggcattctgaacggaatttacgtttcctccgttgtattttattatagcgatcatacttataaacttccttttgtagaaggtaaactgtaattagcatctgactggttcactgccattttaacagcttttgcaaaggctttaaaaatggattcaattttgtggtgttcattatccccttctgctttgatattcagattcgattttgaggaatctgtaaatgacttaaagaagtgaaaaaacatttccgtaggtacatctcctattttctctctcttaaattcagcatcccaaaccagccatgatcttcctccgaaatcaatagccacctgggaaaggcagtcgtccatcggaagcaggaaaccatatctttcaattccttttttctttcctaatgcctttaaaatagcttcaccaagaacaattccggtatcttctatcgtgtggtgctcatctacggcaaggtctccttttaccttgatggtaagatccatatttccgtgtctggcaatctggtccagcatgtgatcaaaaaaatgaagtccggttgaaatatctgacttcccgttgccatcaagattaacttcaatttcaatatcagtctcattggtttttctggatactttcgcctttctcattcctgatttcaagaactgatagatctctgaccattttgatgcagacagctccgcttcactatttaagttctgattaagataaatagctttagccccaagatttttagcgagttgcacgtcagtacttcgatcaccaattacataggaattttctaggtcgtaattgccgtaaatatattttcccagcattccaatacctggttttctggtaggaagattttcggattcaaagcttttatcaattaaaatatcactaaaaatgattccttcgttttcaaatgcctgcagcattttttcctgtggttttataaaatcttcttcgggaaaactctccgttcccaatccatcctgattggtcaccatcaccaaatcgtaatccagttcattggcaatttttgacagattctgaaaaactcccggataaaactcaagcttttccagagaatctacctgaaaatctgtaggcggttcaataatcaatgttccgtcgcggtctataaagagtacttttttcattttagatacttttcaaaaggttaatcaatttttcattttcttcacggtttcccacattgatcctgatacatccgggaatcgcaggatctcttctgctggccaaaatctcttcttcaagcattcttgtatacactgaatcaacattttccattttaatcagaaagaaattggcatctgttggaaagacctttgaaatacatgcagttctttcaaattgctgcttcagccaagttctctcttccaaaatacggtttacgttttcctgaagcctgccttcatcttccaatgtctttaaaatcaattcctggctcataacattcacgttataaggtgcttttacggtattgataagcccgatgatttcttcagatgcataagccattcctacccttgctccggcaatcccccaggctttggaaaaggtttgcagcacaatcaggttagaatattgctccagcagctccagacttgattttttttctgaaaattcgatgtacgcttcatctaccacaacaattccgttgaaattctgaaggtaaaattcaatatcatccacgctgtttcccgtaggattattgggcgaacataaaaagaagatcttcagtgaagaatctttcgctgtctctaagaaattatcttttacaatttcaaaattctcatccagatccagttttaaaactttattttcattaatggctgcataaaagccatacatcgcaaaagacggattcatcatcagaacggcatcttttttaggctcacagaaaattttgatgataaggtctatcaactcatcacttccattccctatggcgatctgtgaaggcaaaacgtttttaagctccgcaagcctgtttttaagatttttctgggtagaatccgggtaacggttacattctccaaaaggactttcattcgcatccagcatgatcggggaattgaattcattttgatccctgaaactgatgtagggctgtaattgtaatatattttctcttaccagagttttgatactgctatttttcattgtattgtttatctaaatctgtttttaaaccattaaatccaggatctttatttttcaaatggttttatgattttccgtttttcaacatttatcattttaatcttatggatactgcatttttgtgagcaaacaaaccttctgcttcagccataagctctatggtttttcctaaattctgaagacctttttttgaaagatgctgaaatgttattttcttcacaaagctatccagtgatactccgctgtaattctttgcataaccattggtaggaagcgtgtgattggttccgctggcataatctcctgcactctcacaggaatagtttccaaggaaaaccgaacctgcattctcaatcaacggaatatatttttcaaaatcggcgatagccagaataaggtgttcaggagcataaagattactgaactctaaagcttcttcgagagaattcactaaaataaaagagctgttttccaaagcctgagcggcaaattcatttcttggtaaatctttgatttgctgatcaacagcttctatcgtctcttcaaacactttaaggtccgtagtgataaaaaccacctgactgtcactgccgtgttctgcctgtgaaagaagatctgcagcacaaaatccgggcacagcctgctcatctgcgatcacaagaacctcacttgggccggcaggcatatcgatggcaactccataccgttgggcatattctttggccgctaccacaaactgatttccgggaccgaaaattttattgacagccggaatactttctgttcctaaagccattgctgcaacggcctgtgctccacctgttttaaagatctctgaaaccccacaaagatttgccgcatacaatattgccggattgatatttccgtttttatccggtggtgtgcaaagaacaatctctttacaacctgcaagattagcaggaaccgcgagcattaatacggtagagaataatggagctgttcctcccggaatataaattcctactctttctattgcacggttttcacgccagcaaacaacccctttcactgtctcaactttctgaatttcctgcttttgagaagcgtgaaatgttgaaatattttctttagcctgttggatagcctgtttcagttcattgctaatctgtttttctgcgttttcaatttcttcttcggttactgaaatgctttgagtgtctgctttatcaaattttttattgaattctcttaaagctttatctccgtttttttcaacttctgcaaaaatgtctgtaataagtcctgaaatttctttctgttccaaaacagggcgttttacgaggtctttccagctgtcttttgtgggatatcggtatattttcattgtattatttttaactttttttaaaccattaagattcttttaagttgttaagtttcattaagatcatagctgaagctatttattaagcgggcttattcctttcatctttgatgaatcttaactatccttaatatctttatggtcttaatggtttatatttttaaataaccattttatcaatcgggatgattaaaatgtcctgggcaccattttctttaagttcatcaatcacttcccagaaacgctcttcatcaatcacagaatgaatgctgctccagccttcttctgccaacggaattactgtggggctctttaatacaggaagaacacctgctactttctgaattttttcattgggaacattcatcagaatgtattttgaattttttgcttttaaaacagctttgattctgaagacaaatttttcaagaatagtttctttttctggcgacaactgaggcgtttgagccaaaacagcttcagatttcagtaaagcaaccgtttctcttaacccgtttttgaataaagtacttcctgaactgacaatgtcacatattccatctgcaagaccaatattgggagcgatttccacagaacctgaaatgacgtgaatatctgaagagattccctttttttctaaaaaatttttgagtgtattgggatatgaagtggcaatttttttaccgtgaaaataagagagctcatcagtttcaacctccttgggaacagccaatgagacacggcattttgaaaagcccaacttctggattgttctgatatttttgcccttctcaatcagaagattttcacctactatagcgacatccaccactccgtcttccaggtactgtgggatgtctgagttgcgcaggtacatgatttccatcggaaagttatctactgaaactttgagctggtcttttccgttgttaacaaagattccgcaatctttgagaagctgtaaagattcttcgtaaagccggccgcttttttggattgcaatttttaatttactcattttgccatttttgggtctgagcaaataaaactgatctgttgaaatttctgaggagaattcaggaaacaaaaaaaccgtctatttactcagacggtttttaattatttttgattttagcatatacttatatcaatcaattccgtctagcagagatgatgatgataatgatgtaaagctaaaaatgttggtttcattgtattgaattatgatgcaaatgtaggattattttttaaaatgcaaagttttttcagataattttttgataaaaattcatcagttggctcgcaatgggtttgtcattaaatttctgaacaaactcgaaacccttttcttcacggcgttttctctcggattcattttcccagagaaatttgagtttggcgcgaatatcgagatcgttatccggattgatgtacacagagtcttttcctcccgcttccggcagacagctcgtattgcttgtgaccacaacagttttagaaaaaagcgcctcaatgacaggaattccgaagccttcaaagaagcttggataaacaaaaatatcagcaattttatagattgcagacagctcatccatagaaactccttccagaaacagcacctgcttctccattttgttctttttcaggaaacgctctattttctggtaatatttggtctttcttcccacgaccactaatggaatttcagtcccgttgattgcttttacaacattcaagaggtttttacggtcttcaatagttccaacattgagtacaaatctttcgggaagcttaaacttttcttttacagcctgtatcaattcaggagactgctgttctttaaaagcatgatgacaaccctgataaatcacttcaatcttagtttcaggaactttcagaaactgaataatatctcttttggtctgttctgaaatagcaatgattttatcagctgtatcggccgcttttttaaatttccagaaatggattttcctgtcaaaaaaagaataatactgcggatatcttacaaaaatcagatcgtgaatcgtcacgacctttttaataggcttttgatcccattttaagggaagttcgccggataatccatggaaaatatcagcgccttgcttctgggcatctttacccattttaagctgacgggacaggttccctttggaggtttcaataaagtgaacattagaacgttccagaatttcctttcctctctccgatttgtttttgttgagcagcagatattcattatccggttcatattcagaaagaatccttacaagatctctagaataatttccgagacctgacgtattgtggaaaaaccgtttggcatcaaaggcaatcttcatcgttgaatctgtttttgaaattcctgaaatgtaccgaatgtatgtcctttttgtttcagccagcctacaaatgaatcaaatctttccaccatatccttccctgagttttttacggtaaatccaggaagtttaaaggcttcgtctttaatttctgcaaattcccacgggtggaaataaatattaagataatggtcttttttcaaggtatctgaagacagttttttatagaaagacaacgggaaattgtgaaagcttaaccaaaacagaggaattctgaaattaggagaaaccgaagccggaacctgcattacatttccttccttgaaataggtcctggaaactttcaaattattatatcttcccggcaaaaatgtagggttaatggatgaattgtatacatatcctgctttttctacttgtttttcgtctacaggcatcattctcggcattcttaatccggtcacctttgtagaaaataattcttccagtctttctcttgattctttcaggtgtttgttttcaaattctgaatgaaaccaggtatgggaagccagttcatgaccttcatttaataacctttcgataaggtgtttgctgttttctgcaaaaactacggtagaaaaaaaggtagcttttgcattatgttttttaaggatatcaaggattctctctaatcctgtctgtgaaattgaaatctgcttttcaaagggaatttcacccttatattctaatggcatatcaaattcttcgatgtcaaaactcaataaaaccattctaaaaatttttgtttttaataatataattaggtctgtctttcacttgtttgaatattttacctaaataaatccccatgattcctaagatgatgagctgaagtcctccaaagaaaacaatggtcatgatcagggacgcccaacctgaaatctccgttttggcaataaatgaatgaattacgtaggctccatatccgattactgaaagtgctgagaataaaaatcccaggtaagctgccagataaagaggcttcacgctgaaagccgtaattccggtgaaagcaaaagtaaacatctttttgatattgtaactgctttttcctgaaagtctttctgcggcggtaaagtcaattcctgtttgtttgaaacccatccagctcgttaatcctctgaggaacagatcatcttcattaaagtttctcatgacttcaactgcacttgcatccagcagtctgaaatctgagccaccacctttcgttaagtttacatctgaaaggcttgataaaagcttgtaaaataaatctgatgtttttcttttaaaaaaggatatttctttaggataagtcctgaaagtaaaaactacatcatagccttcctcccatttctttatcatttccgggataagctccggcgggtgctgaagatctccgtccattgaaatgactgcgtttccgtgggcattgtccattccggcttttacagccggctggtggccgaagttacgggaaaactcaatgaattttacttcgtcatactgattggaaagttcttctaatttctgttgtgtattgtctctgctgccatcattcacaaatatgatttcaaagtcataattgcttaagccatcaaaaacttctttgattttctgatggatcatcgctacatttccttcttcgttataggcaggaattacaattgaaattttcttcatatgtattaattcaggctgtaatttttctcaaaatctttagtcagaagttcataagtcactctcaaccagattacaatacaaggtacggcttttaatgaatatttaatgatataattctcttttacaaatttcgggaaaagatccgaagttgaaaaacatgtaaaaataatgacaaaaacaaggagtcctatgatcagcggtgttctctctttctgaaggaaaaaccagattaaaacgcccacaacagcaataatgtatgttggagattctgaacttgaactgaataataccaaaaacagtaatgttgacgctaagatcatcaattggaaagcataatgcttatattgcttaattctgatataaggtaaagcaaaaagcggcaatccgcctgctaaaaacacaagattggaaatggaggcatcacctaagattcttcttacaaatcccattaaagaaatgtcctgcatatttcctaacacctgattttcattatttttttctacaatagactggaaccagtctgagtagcactgaatcacaaactgcggacttgaatacgccattggaagcacgaaaaacaatacggcaatggctactcctgaaagaataaatttggttttgtttttaatgaagaaaaactgtgtcaatccgacaattccatagattttcacaaatactccgattaaaattgcggttacagattttacttcttttctttcgtaaatatatactgcagataacagcaaaaggcctgtcagcgctacattgaactgcaggcttaatgctgctgtaatgtattcctgaagacaaagcaacccgaaaatcgcttttttactgtctgaaaacggcagtttgtaaataccataaataaagataaaagtattggcaatgttccagagtgagatccccagccaatccggcatcatggcgaatggtgcgatcaatgcactgaaaaatacaccataatggttcagatcaaaataaagatcgggataatggataaataagtttttctgatgtatggtattaaagaatacatttttaaaaatcagataattattgatcgcataatctcctctcagatatttggaaattgcggtaacaaccgatataataagataaaccccaaatatatatttagggtttaatagtattttaagaaatttttctttcaagattgtggtattagcttaaaaaattaatcttaaacagctacattattgtctctcaatgcgtcattcagagatgttttcttgtctgtagattcttttctctgaccaatgatcaaagcacatggaacctgatattctccagccggatactgtttggtatagcttcccggaattactactgaacgtgcaggaactcttcctttgatttcaacaggtgtatctcctgtaacgtcgataatttttgtagaagcagttaatactacattagcacccaatacggcttctttttctacgtgaactccttctacaacgatacatcttgaaccgataaagcagtcgtcttcaatgattaccggtgcagcctgtaatggttccaatacaccaccgatacctacccccccactcaggtgaacgtttttaccgatctgtgcacagcttcctactgttgcccatgtatctaccattgttcctgaatctacatacgcaccaatatttacataagaaggcatcataatcactccgggagcaatataagctccttctctggcaactgcatgcggtacaactcttactcctttttcagcataatttctctttaaaggcatcttgtcatgaaattcaaacggacctacttcaatagtttccattttctggatcggaaaatacatcaccacggcttttttcacccattcatttacctgccatccgttttcagtaggctctgctgtacgaagttcacctttatcaaccaaagaaataacctctctgattgccttctggctgtcttcattctgcaataaatctctgttgtcccagatattttcaatagtttgttgtaacgacatgtttcttatttaaaattataccggccaaagatacaaaaaagttcagcaaaacggtttttaacattacggttttaataaaggttcagcattcgcttcaccctctttttataggccgtatagatttctccatgttctttctgcagatattcttcttcaaggcgtatctggatctgcattaacatccctccaatgatgagaaaagaaaaagcaataaccgtaggcaatacaagaaaaaatccaaacaggctcattgtcattcccaaaaaaatgggattccttgaaaatctgaataaaccccgggtaacgaagtctgtttttgttgtactgtcgattccgatccgccatgagtttttcatttgcagttgggctgtaatcacccaaattaaagccaaaatcatgatagcaagtcctgaatatttgactgcatcaggttccggaatattgattttaaaagctgaaaaaatgtcctccggaaagagtaataaaagcatcgtgtagataaacagagccgacaaaatcagcttaaagtagaatcccacaaggccgtatgcggaatcatctttaggaagaacgtcaggatttttgccgatctgttttgcaactttataacttatccccacaaaggaaactgtaaagaaaagaatgaagtaaaaaggaataaagaatctgatgaaatctgtcatatgattatagtttctgacaaatttcatgagttttgggatgcaatgctattgcaatgacaaggaactttagtttaagcaacagaattcctctccggcggaggggtgacaaaaattcagagaatttttgacggggtggtctctaaaaatatagttataagttttggctaaagccagttgattgttttatttatattaaacgggctaaagcccgtccctattgaattattgctcccggacattcattatccagcatcttaaacaatactttagagaactctttgtgcatgaagataggccttattccagtatttctcattcagggatgaaataatgactccttttgaagtagaggcatggatgaatttcacttccccgtcaggaccaatatcgtgaactattccaacatgagaaaccctgcttcctccggctgttgcaaaaaataagagatccccgggttttacatctttgatatcaatattctttccggcttcggcctgatcagaagatcttctcggaaggctgaaatcattttcttcaaatacttttaccgtaaacccggaacagtcaaagccagacgatgaatttcctccgaatttataaggcgttcccaggtatttttcagcatctttcagaatatcattgattgatttggaaacactgccattaaattttgaatcaagtcttctgagattttcagatttaacaaccgttttggtattcgattttttgctggcagaaacacttttcgaagagccgcaggaaactgcaaaaacagatgcaatcaataaaacaggccactgttttattttcatttttgtttcaaataatgccggtcccatatccttctgatttatacttgtttaacaaattttatacaaatatacattttatatttaaattatactaaaactatactacaactatattataaatatatgttaaaattttttattcatttatttattggtatatttgaatctattttaaagatatggcaacatatgaaagtctgatcaagatcacaggagctgttggcgacctggtattttataacctgaacgggaaaaatgtggttcggaagaaaagtggttttaataagaacgcttttaaaaagagcccaacctatgaaaaggtaagacaaaacagttcggaattcgggcattgttccaaaatcggaaagatcatccggaacagtttggaaaagtatatcaaagaagcaggtgatcccctcctctatcagaagtttgccaaggtaatgacagccattaaagattttgacaaggtttctgaaagaggaaaaagaagagttacagatgggttaaaaactgaagaaggaaaaatacttttgaaggagtttcaatttggtgtgattcctaatgtttcagattgtatcagaattcaggattatgctatatacaagaatgcggactgcacggcagacgaaggtgtcatattgactttaaaagtagattctgaaaactacattacggaaagtcatgaagaaataatcagctggaaacggcaagaggaaaagacttttaagcagtatttttccggggaagaagttctactttattttgtagtcctgaagaataaaaataataaaattacccatatgggatttgtttaaataaaaaaagtctgcagtagattctgcagactttcttttttatttcttttctcctttccaggttcccgattttgcaggtgttggaagtgagtttaaccagtttccgtttccttttttatctgtggataatgttcctttgaattctcccttcgaaggaagtcctaccgttgcgttcagatctcctgtttcacttaaattcccggaaatgttgtagttttcattattaacatcggaatgcattgttcctaccactttaccgctctcgtctaccacaaagttccagactcctttatcgcttccttcatacgaaccagaccatgttcctacataatcaaagatcgtatcatcatctgagctgcaaccgataaataaaaacgccgttaataaaagtaaaaaaagtttcttcatagtttcagtagttttataacctaaaatcctgttattcctgtacactttccttctaaaaatccagtcacagagaatattgtttaatatttattattttttgtttcgtgcaaatctactaattttttccttcagattatctgaattttaatcagcaaccaatatgtttgttaaaaaacgatatatttcggctaaaatacaaatatttttcaaacaaatacgagtgtaaataatttgagttattaaaaaatatcatcggaaatttcagaataatgaaattcgataggttttttaattaacagataaaattttaaatgatttatatttcagcttttaaagatatttcttaaattagtgaaaagtttagctttttcagatatatcatgaaaataaaaatttttcttttgatatcattggaatttatggcaatttaatagtacaggtagagatcagcacttctgttttcttacaaagggatgctgatgatctcatcatgttaagaggatcttcaaattctgttgccagcaagaccgctgaagtataaagtagagtctgtaaagcggaccatggtaccttgtgcaccttgtcaattcaccgctccggatctttataatagtcgatatttgatttcaaaaaggcagccacagttttatactgtggctgttttttgatacgaactctttaaataaaaataattttcatataaaaagcctcccaaaagaggctaaaaactattggatgaatgaaaaacttattctcaaatctaggaaaacattcctccggttctttatgagtacagtcataatgagatatttaatagctaattacctttatcttctgacgcatagctccatccgtatatccagtctagttgcttaatctgtttactgataaagaatccgataaaaagatcccggaaccaggccgttatcgggtttgtttttgttttggtatttccaacttttcttgcattttttattattttttcaactctgggctgccgtacggattgaaaggcctgaaaggcggcctcacattctttatttaattgtaattgttcagcaataacaacagtatcttccagtgctaacgaagctccctgtcctatatgtggagaaataccatgcgccgcatctccaataaggcagactttccctttataccatttcgaaagtctggggagatcatacaccggataagcaataatttcgtagctattcctgatgatgcgggaaaataaagggtcatcattcctatgaatatctgcaagatggtctttgatttcatctttcagtattttttctgtttcctgtggtttcggctcctgatctctgaaataattattaaaccaccacacctctcctttatctgaaaccgagtaagcaaaaaagcctctttctccaaatgtcatccttatcgaatcaagaggttctgagagctcagcaattttggcatatccgccgatagaaatgagctttgtatatctgataacacacttttttgggaacagctgattccttacctcagaaaacattccatcgcagccaattatcatatcacctgtaacggaagttccatctgcaaagtaggctgttacctgatcttctgattcattataccggacaaattttttattatattcaatctttataccggcttcagctgctgctgcccgggcataggtgttgagatttgccctctttaactgcaaggtctctactccgtacttctgtttttgataagcagttcccagctctgctatctgctttcctctggcattaaaaaatttcattgaacccggagtgtaatcttctttaagcttttcaagatctataaattctttcaatacatttaatccattaggcgtaatgcctaaaaagactccttcatttctgttattttcagatcttgcttcaaatatttctggctgaaaacctatttttttcaattgcaaagccagtatcgggccggcaacacctgcgcctattataattacttttttattcattgttttctatattacatcaaaggatatgtaggtttttcttttgcaagctattctctgttgaattttttctatctttaattctgataatcttgtgtagtaaaattatcacaccaggaaagaagaaacttgtaaaaaaaggagttaaactagcaaatcagggagtaatggggtttgaattgaaaaacagcgaaaggatatttacagcaggctttgatgaaaatgacttcaattcctatggttttaaagaaaatgtctttaagacagatattccttttgggcagataacgaccaaacaatggctctttgacggcatcagaatgctttattctgaaacagagcttgagaaatccacagagcttgactggaagggagatatggaactggtcacgatgcattttaatctccagggaaaaacttcaatacagcaacatggaatgaacagttcttttgaactgaatgggaatcagcataatttattttatggtaccggtgctgaaggtaaaatgaaatgggatgaaccgcaaatgaaatcatttatgattcaattttcaaaagaggcttttcttgcgatatcaaaagacggaaatgaatctctaaagcaatttgcagataaaatagtttcgggaataccagttgctttttcggcttcaaatttgaatatcggcttaccattacgtacctgcatcgattcaattttaaattgtgaattttcaagcggatcaaaacggttgtttcttttttcaaaaacaattgagctccttgttttacaggcagaatcgtttaatactgctgaaaatcagaagtcgaagtatataaaacatgattatgataaggatcgaattgtctttgcccgtgattatctggtgaaaaatataggatcaccgccaaccctaccggaactagcaaaaatagcaggcatcaatgaatataaactgaaacggggatttaaagaaatttttaatcagaccgctttttcttatttgtcggatttacgtttagaaaaggcaaagaatgatttgatggacggtaaaaaacaggcaacagaaatagcgctggagctaggctactgttctttgcagcatttcagcagtgctttcaagaaaaagtttggcattcctccgaaccaggcaagatattaatattagatatgatgtaaacaaaaagctgtaaagaatcaactttacagcttcgttttcatagtatgtttttagaatcttttttagtctgttcagactacatcttagttttggaactttacaaaatccaggtaaaaagaagggttaccaccattgaatgatgccggcactactccatttgtttttccagccaacacagtgtacgttcctggtgcagcaaaatataacaccctgttctgatctcttggaaacataaatgctgcagtatttgatccgcagtagcttctccagacatcaccaatgccattgatatagaaaaaataatcattacaatcagaattgatagcgatcccacatcggaaaaaataccagccctttgccggaatagtaacctgaattccggtattcaatccgccacctcccgttcctcctgtaaaaggatttaccaatgttccggtataaggtgtccagttattggcaaatgctgtagtaacagtggaagaccatgttgccaatccgttagcatcactggtcagcacataccccagctgctgagtaccgtctttgatctggagggcaccattggtagttccgttatcaataacaatttttgcactggctgctcctgcaggtactgtattggttcccactagaacttttcctgtaccgttgatgcttaaattgtttcctgctgtagcaatatctgtcggctgtgaaagtgttcctcctaatttaacatctgtaccggataaagtaagaccgttacttgccgtgatattattattaatgatcgttgtaccaccatttccattacctccggccagctcggtaaccgtcataaatcctattccaggatttagctgtgcggttccagcacctccgagccttacttttacagaggtatcaactgttggtttgtaaatagcataggcttccggctggccgccaatagatgttgccggataattgtttatggcatccacaactcctgttgtactggaaggaagaacggaattattggaagcatctacccattcgtacacaaagaatcctcctgccagcgaaaaatctgtagcatgcagctgacaacggagcacgtaggttttacctgctttcagattgaaaacacctgcgttataagtaatattgttggaagcaatgacagatccgaatgtcacatccgatcctgtagatactgattgagctgcatttggcttcacaataatatagtctcctgtagcagatgtccccgttgaaagaagttcccacgtagaattcgttccggtaagtccggtgctcaccagttccacactctgattggctggtaccgaaatactggcattcccgttaattgtttccggagcgacagcatttacggtgatcttaaagtttgtgttgtttttaattctgtaaatccttcctctgaagtttccaaccccactgatagaagctggtaagccgaatacagcatctgaactcccattatatgaaacatggaaatctgataatgttaaattataagtggctgtagtaaccgctttataattcgcggccaatgatccgttaatatccatggttgaacccggattgacagtattgaccccaacatttcctgcctgggcaaaggcaatagccggacttaaggctatcattgcaaagattaattttgtagaaattttaaacatttatcattattttatttacattaataaacccggttgtttaacataatgtaaaaatatcagaataaattctacagaaaacatcaccatgcgtagaaaaaaactaagccatttgtagaaaattttctacactcaaaaaatagctttcattcatagaaatcggtattatgacatatagacttcatatagtttaataaggtcggccagattacttgttttcagctttttatggattctttttttataagtgctgatagtggacatctgaatatccatctcatttgaaatttccagatttccgtttccttttaccatgagcataaaaatttcatattctctttctgataaactcttgatagcatccagtgcagaaggctgcaatagtttattgacaaaaccattagggtaataattcccttctgaaaacattttcatcacagcttcagaaatagtatctactttactgagcttattgatgtacccatctgccccttcttttatatattgcacggcaatttcttcctcataagctgaaaaaacaagtattttcaaggcaggatcaagctgtttgatttctgagatcatttttttatttctgctttcaggcatattgatatccaggataagcagatcaaatttttgtctggagattttatcgagggcttcgggataatctgaagctgtatctatgagaacatcaggaatacgtgattctaaaatgatagcggttcccgttaatacaatatcatgatcatctgctataaggatctttttaatcattttttgtttttttaagaattaattggaaagaggttcctttggtctcatttcttctgattataattttactttccagcatttggagcagctgcaggatcaggtgaagccccataccgtatttctgcaataacagtttttcattttcaatgttctcctgaagcttggtataatattcaatcttatggtcatccataccgattcccgtatctgtaatttctaagacaaccgcttcctgctcatctgatccggaaatagtaatcgttccgcttcttgtatattttacggagttatccattaaattatgaataatagcagccagaatatttttactggtctgtatcattaatcttttatctacattattaacaattgctgtgttatgattggctgcaatctcatcaaaaaggactttcttttcctgcacaagatcatagaaggaataccactctgtttcatcagtcctgtattcactatatatatcagcatattctttcagcgtttttgtgaaattgtacagctggttagatgatttgtagatagaattaagaattctttctgtacggtatgcattcttttcatcatagtccaacgcttctttactggttaaagcaataaatttcaatggtgtggtaatatcatgggtaattgttccgatgagctttttctgctgttcgatttcttttcccagctttatttgtgtcatctcgagatcttccactgtttgcgacagcaccttggttctagatcgtatgactgcttcaagttcacgatttttctttttatgaaaacttgtccgccatcttacggacaaatacagcagaagaagtaacaggaaaacgataattaccttaaaccataatgtttgataaaaaaaaggaggaataataatcttaatttttttgaaaacatattcctgcttatcagaaacaagcattctgaccacaagaaaatgggtaccatggccaagattgttgagaataaacttacggtcttttcctacagacagccatttactggttctgtcatcgtccacttttgcttcaatgataatattatcaggatttgcataatatgggacatcaataaacaattcaatccgtttgttttcctggctcagattcaggatattggtaaacaatctttctttatcatcaaacaaagccctttctatatacagagctgccggataataacttttaactttcaaaggattaaaaaatacaagtccgcttaatgaaggtaaaacaaaatcaccatttttcaacttgtttccatttatgttgcttcccccattaaattcattggtactaaaaccggcttcttttgaaaacctgtagtagttcagtttaaaattcctgtcttgtacatatttcaaaagcatgctttctcttattttatacaatccattattggtaggaatccagaagtaaccattaggatcttctagcagtgtatgcggtgacaaaagattgccttccgcatcaccaggcagctttataagatggtcgttttttaagagataaaagccttttccaagcgtggttacccaaacatttccatctgcagtatacacaatatcacgaactgacaattcatttttcccgtttaaattgtagattttattatgactgacggatattctgtacaatccttttattgtacccactaaaatatcaccggattttgttaataccactttggtaggttcgatggcaaacaggtattttttctttaacgatttaaaaggccagtcttcataaatgcttaatgtacctgtgaactcggtattcccttttttttgtttcacagccagcacatagtactttccattggcaaagaaaaaatctttcacagtgtcttctccggtggaaatgctctggaaatgtataaaatcggacggtttactgtatacaaaaagagtttgttctctccgggttacaatattgccgtgtttatcaaaatttaaaaaataagatatatttttttcgaagtttttgcttttaatgaatccgttccggttataaatttcccctgccggattaatgacacatgaatcattgtaaggctggatcgcataaaaaacggctgatgattttggagtgctttttttcgaagaggtgaaatctgttaaactcactattttgagtccgtctgtactgcttccaagataaagttttttgtatttttcatcatagtaaatgctcatcagattgctttcacttatatgctccagccggaccagttttgagagtgtaagtgctccgttattggaaattaatctataaagcatatcattattaaggacaaaaccctgtccattggttctgttccagaaaactttacttctgacatctgctacaacaggcaaatcataagaaccggtaattttcccctcctctattttttttacttttttagcattacgatcaatataaaacagtacatctcctatcgtaaaggcattcggattatttttataaagtggctttacatcaagtgttatctgtgattttgaacgaaaatcttcataaataaaggaattttgtgctattaaatatctcccttttctgaaatccataaaaaaataaactcctggagaaggactgtagctgtagtttgaaatacacaaatgataattgatgttgtctttaacaatcattgttggagatctttttacaggactaattacttttggaaacttttggtgtatcaacactgtttttccatgatctcccggcgtaaaaatgctgtctttagcaggatcaccgtaaaaataggtaaaccgctgactgttcagtggaaagtttttatgaacaaaaaaattaagtccgtcatatcttacaattccattttctgtagtcagccagataaagccatatttatcttttataatatcttttacactgttctgaggaagtccgttatctgtgttgaaaacctgctccgtgtactgttgggaataaaacaagagaaaagcaaacagaaaaccaactgtaagaatatttctacgcaacaaactaatcatttttatcaatagcgtaaatataattcatttaaaacactttattattaaattatacatcaatcatacaaaaacagctgtatttttttaccagatatttccgcggagattgatatttactttaaaaaccgaagctatgttaatgtttatacttactgtctgttgcatcttgtataaaatcaatcatgtttcagaatattctaacacacacatctccagtatgtttcattaattagtatttttgaagataaaatttttaatctttattatgattacaaagaaatcaatttcatctattgtattattcttatcaatatcattatgcttttctcaaaatacagtaagcaggcagcaggctaaagatgacattgactattacagtaaaacggttttggattctcattacagccctttcctgtttatatctcaaaagcaatacaatacggaagtggataagattaaaaacaaactgccggaacagttgtcataaggaaatgactttggtgatgtatcaggtaagtgctcttttgcaggatgcccattccaatccgggcatttcccagtctttcatgaaagaggacttttccaaacccattttctttccgctgttactcgtttcagatcatgaaaaaatatattcatcagcaaatacaggacaaatacctgcaggatcattaattatcagtattaatgggaaagatattgaatctttgttccagaacatgaaaaagaatatcggcggaaccagccagttcagagatattatatcccttaaattattcagccattttctatacctggaaaatgtaaccgctcctttctctgtaagatataagttacctgaaggagacatcaaagaaattaccattaatgaaggaatgaagttcagagatttcctggctttatcaatgccgggaattgcaaagccttatgatttcaaaatcatcaatcataaactggcttatctggacttcaggagtatgtccggaaatatggatgattttgataagttcctaagtgagacatttgcaacaataagaaaagagaatattaaagatttagccattgatctccggaataacagcggcggaaattctattctgggagacctgttgctgagctatattacagatcagaaatattctttacaaggcagcaaacgctggaaaataagtcagatttataaagataaactcatcgcagaccataataccgaaagtgaatatctgaaaatggagaacggaaccgtctgggaaacaggaaattgtaaaccggattttaataaatttaaaaatgatcctgtttttaaaggaaaagtatatgtgttaaccggtccttttaccttttcaagcgccaatcttgtagcagacggaatgaagcaatacaaactggcagagcttgtaggtgagccaacgggtgaatatacgaatgattttggggaagcctttatgtttacgcttcccaacagtaaaattcaaatgcggagtacttcatccatgagcttcggtgctgactgcaatacaagtagttatacccccgtagttcctaatatcctcatagttccgacattgcaggataagattaatggtattgataagccattggaatatatattaaaaacagtgaaaacaaataaggggactaattgataatctccccattgctgttttccagtttttcacggaatcgttgcagatcttcaggcgccggtctggtccattctgtaacttccccgataattttcaaaggcatttcggagcggtaagagcgggtgggatttccgggaaattttttatcggtaacattcggatcgttttcaaaatttcctgttggctctacaatatagacacgttctttatcttccccttttgccaatgcagcagcaagtcctgctccgttaaccaaagccgtaaaatagatgtgattcattttcagatcagactggtagttggagttccctcctgccgtcagtaagtctccaacctttaaatctgcttttgttccatgataaaaagggcctttatcagacggatggttttttaactgcaaggccagttcagcattcttttctgacatttccgtatctcctgattttccgtagcactgagcaattttctggtaaagagcaggcagcgcacttttaacggtatcatcatttatctttaaagcaaaatccaatgatgtttccagccattttaactcatctgcagttgtcttttgatgacgggcaacataatgagcagccagaaatttttcgtgatcatccgttgtttcattccaggcttgcaaaaacagtcttcctgcctcttctgacattccgttttcttccatggccatgccttgcagacatagtttaaccacattattaaaaggtgagaattccatgctttatttttttatcgttttaaaattgtttcggtagatctgacaaatgtatacaaatacggtgaaacggaaagcatagtcaaaaagaactttaaccatcttattgataaagatatttttatttgatttaaaaacagactatacaagcccttttcaggaaaggccattttttttcattatatttacttaacatcaagcaataaataaattaatttctataactttttactttcaaatgaacgaaattaatctagtttaatttcaatacaacttagccttattacatttgctaaagaattaagacaacacataattacaaaataacttaatcatcaacattaaaaatttaaagctatgagtacattaacattaaaagacggaactgaaattttttataaagaccagggagaaggacctgtactgatgtttcaccacgggtggccactatcgtccgatgactgggatgcacaggtgatctttttcttacagagaggttacagggttattacccatgacagaagaggccacggccgctcaagccagaacatttataatcatactattgaacagtatgcttctgatgctgcagaacttgttgagtttcttggtttgaaagacgttgttcatataggacattctaccggaggtggtgaagtgatccgatatgtacataaatatgctaatggaagagcaaaaaaagcagtcttgatcagtgccgttccaccggttatggtaaaaagtgaaacgaatcctgatggtgttcctatggaagtttttgataatatcagggaacagaccatgaacaacagaaaccagttttattatgatctgacattccctttctatgggtataacagagaaggtgccaatgtaaaagatggggttcagagaaactggtggagacaaggtgtgatgggtggaattgttgcccattatgacggtattaaagcattctctgaaacagatttcacagaagatctgaaagcagttgatattccggttctggtaatgcacggagatgatgaccagattgtccctatcgaaaattctgcgataaaatctgccaaattattaaagaacggcaaactgattgtctatcctggtttccctcacggtatgccgactacagagcatgaaacgattaataaagaccttttggaatttattcagtcttaaaaaactatacataaaaaggtggactgaattgtccaccttttttcatctgcatatttgtaaacaataaaaccgctctaaaagcggtttttattctgttatctcttttctaaaacaatctgttatgcagagatcttagggcttctatcttataaacagatggaaccagtaatgaaatattattttcacttcctccataagaaatcatacggatcggaatatgctttaccgcttcagagacaatagttgcgtatccgtgattttcttttctgaaatctccgacaatacagatgatcgattgctcattgtcaatttccacagctgagaagaactcaagttcttttacaatttcagacagctggtctgtctgatctatggtaagagaaacagctacctcagaagtcgtaatcatatctatcggagttttataacgttcaaaaacctcaaaaacttttctcaaaaagccatacgccatcaacatacgggaagactggatgcggattgccgtaatcccgtctttggctgcaattgccacaatctgattctgattggaaatttctcctgaaatcaatgttccggccgcacttggattcattgtatccagtaatcttacaggaacattatattttcttgcagggaaaacactttgaggatgaaggattttggctccaaagtaagataattcggcagcttcatcaaagctaagtctggcaatggatttggtattctgaacatatctcggatcattattgtggaagccgtcaatatctgtccatatctgaatttcctctacctgcaaggctgctccaagtaatgaagcggtataatctgatcctcccctttgcagattatcaatttctccctgagcatttctgcaaatatatccctgggttataaataaggtttcttcctgatattttgctatttcaagaccagcatgttttctgatgtaatcaatatccggttctttatcttcatcaatcagcataaaatctaatgccgataacagaacagaagagatttctttttcttttaaatgtaaatgaaacagagttgttgaaataatctcaccctgtgccaatataacacgctctgcactggaagtgaagtttttatttttgaattgataaaacagatcaaagattttatcaataaaagatgaagcttcctgaataccttcttctgttttaaataatttatttacaaagtttttatatttttcatatagtacatcaatatgtttgtaggctccctcaatatccttcttctcatacagttctgataactttaccagatcatttgttgtaccggatactgctgataaaacaaccaggtgtttatccgctgcctgagatctgataatgggtaataactgttcaatcctttccgggcttcctactgaagtccctccaaattttagtactttcataatttattaattgttaaatatttctcaaaaaaaaagagcctgtcgtgatgacaagctcctgatttattttagtttctaaccaaaggaaaatgactcacgacgttcgacgtaagtactgtttctttcccttttttaagttagataatatcattatttctttttttgctgggcaaatatacaaatttttgcaaataaaaaattaatttccgatattttctttatgatgttacatttcccatcctatcagattgttgataagatacttaagcattagattttcttttttactttattattcttatggttttaaatcttcaaattgtttgtcagcaggaagaatgtgctgtactttttcaactgataattcttttgcaacttcaaattcggcggtctgcctgatatccagcgatgaagctcctaccagaattttatacgttccggcttcagcaatccaggctgattttcccgtttcaaacgaagctaaatctttcttgcttaaagtcaaaataacagtctgggattcacctggatttaattcttttgtttttgcataagcttttaattcagattttggtttgtcaatggtctttccaggtgcagaaagatataattcaacgatttcttttcccggtacctttcctgtatttttaatattgacacttacttctattgaattattaaatgtctttgaactggttttaatatttgaatactcaaaatcagtatacgactttccatacccgaattcaaacgaaggttttattccaaaagtattaaaataacgatatcctacgtaaataccttccttataagttacctctgtaggattatccgatggttcacccggaaaattctttgatgatgcatgatctgaataatttacaggaaatgtcattgtcagttttccggaaggatttactttcccggaaatcacatctgcaacggaatgccctccttcctggccaggctgccaggccaataaaacagcatctaccttatctttccacgaagcagtttcaatcaccccaccaatgttcagtatagccaccactttttttccttttgcatggaaagctttggaaattttatcaagcatttctatttcctcattggccagattaaagtcattgttcaatactctatcccctccttcaccggaatttcttcccaatgttacaaaagcaatttcagaagtttccgcttttttagcaatgaaggcatcatccattttcatttctggaagcctctccggcaaagctaaaattccccgggcttttctcctttccttttctgctgcagcttctttttcagcatgcggtttatacaattctaccagctccttgtctaatttataccctgcagcattcagtccttccaaaagtgaaaccgtatgtttattgttgacactgccacttcctgtacctcctgtaatccacgcataggaagtcactccaaacaaggaaacctctttctgcctgtctgcaaaaggtaaggcattgttttcatttttaagcaacaccattccttctgctgccgcgcttctggttactgcagcatgtgcgttcagatccggtcggtcactatatttatagtgtgcaaatgttggtgtcccgaaaatatatttcaaaattctttttacgttcagatctgccacctcctgtggtaaccggcctgaatccaaagcttccagcaatacctttttctgtgccggaattccaggcatcaaaaggtcatttcctgcattcatctgcttgactacatcagaaattcctcctgttctgatggattcaaatccgggaaagccaccgaaccaatccgtcattacaatgcccctgaatccccattcgtttcttaaaacctgagtcagtaaatctctggaatctgaagtatacactccattcactttgttataagatgacattacagtccagggctgggattcttttacggtgatttcaaaatttctcagatataattctctcaatgctctttcagacacatgtgcattgattgttaaacgattggtctcttcattattggcagcaaaatgtttgacagaagttcccactcccagggactggactccgttaacaatagccgcagcagttttccctgaaattaagggatcttctgaataatactcgaaattcctcccatttaatggatttctttgaatattcaaggcaggcgccagcaaaacatcaacaccatattctttcacttcattacccattgcttttcctacctcttccaatagcgttttgttccaggttgaagccaaagcggttcctacaggaaatgccgttgcatagtacgttttggaatcattttctctggttggtgcaattcttaagcctgcaggcccatccgcaacaacagtagccggaattccgaatctgtccagattcgctgttcctcctgcagctccgggaaccagccctttttttgtgtctcctacaggtccggttaagacttcaattccgggcattcctgttccaaccaacagatcaaccttttctttattggtcatttggctgatgatagcatcaattctttgatcaaccggaagtcttgtatcttcccagatgtccagtttaccattcttgttgagatctgtgaacgtttttccaccaacggtaattgttggactattttgagcctttgtaaggggtgacacccccattaaagccaaaaacaataccgaatatttgttcccggaaaaaagtccgatcagtgttgatttattcttattcatatttagatttagtttttattaaacagagcataagcttgaaatatgctattctaaaaaacacagcatattctgccctgggacagaaaatgccatgaaagaaactatataaaaagtattaaattgattaaataactacaaaaagttatggaatctcagccagtcaagatatacatcagaccatttgtcgacgggtaaattctgttttcccataccaaagccatggcctcctttttcatagatatgaagttcagcgggctgcccagcttccagccatttgttatacaatacaactgattttggtgccagtttcagttgatcatcacttgcggcacagataaacattggaagaacagctttaggaacttcggtatttagaatttcctggcttggtccgccataaatggatgccgcaaagtttggcagcgttgaagcatctttactatgcaggacactctctaaaattacactggcaccagcagaaaatccgatcactccgagtttttcaggattgatctttagttcttttgcgtgcgttctgatgtatgagatggcagttttgatgtcctctccagtcatcactttaacaggagctgttttggcatcaaaagcatttctgtctttgatattctccatcatttctttggcagggtcattggacttcgtttccagcagtctgtattttagaacgactgctgtaattccgttttctgcaagcttttttgccagatcaactccttcgcggttgatggataagctttgaaaaccaccgccgggagcaataacaacaactgttccgttggccctggttttatctgcctcgaaaaccaatattgaaggctgagacacattgaaaaccacttccgttttgaacagctcactgaattgctgagcttctttctgcttccagttttctgttcccggtgcctttccatgatataaaggaatagatttctgtccatatgcatggtatattcctgagatgaataatgcggttatgaatattcttttcattttcaatttgtttatttaaataactgaggaagaaaatcattcagataggttctccaattgctccacgtatgaccgccttcggattctacgtattgatatttgaagttcatcttattgagtttttcacggtattctgtcacgtttttgtagagaaaatctgttttcccgatggcaatccaatacaacttgtacgaattggtttgctggaccttcagtttttgatctaaattctgataaacgggacttttcttttcatcaggcggaagaattgccggagaaaacagccctacataatcaaatgttttcggcagattggcagaaatatacaaggaatggaatcctcccatggaaagtccggcaattgctctgtttccggcgtctgattttacccggtaattgtgctctgtaaactccatgatttccttgaaatagttttccatatcaccgctgaaaatatcaggtgttttcatatcgattttataaaaacctttcgaagattcgcccggcgcggctgaattgcttgtatgaccatttggcattataacaatcataggttttgcttttccctgagcaatcagattatccagaatctgcgaagctcttcccaaggtcatccatgcttcttcgtcaccccccattccgtgtagcaggtataaaacaggaaatttttcttttgaattttcatatcccggaggggtgtacaccgttaatcttctgtcttcttttaatccgcttgatttgtaccatcttttggaaactgttccgtgcgggacgttctgaaccttgtaattttcagattgttttccatcaataaaaatcatactcatcactgatgaaacatcacgtacctgataagaattgttcgggtcattagcttttacaccgtcaacaataaaagaataggtatagatatcaggggccagatcatcttgagagaaggaccagattccatctgcacctttttttaattctacggttcccggctcccagccttttcccggcatccagtttccctggagttttactgttttcgcctccggtgcacgaaggcggaatgttacgtttttacctttgatctccggtgaaattatttctttctttccgctgaaatcaaggttttcctgggcaaacattaatgaacccagcattaatgaatagattgtgtatctgattttcatattaaatggtttttaccacaaaaggcaaattctgagcctgtaaaatacagacccagaattatcaattactttttatatttctctgttcttgcatctttaatcacaccggaccagttcattccgtatccgaaatcatagttatggccttcagaatctttatgggtttccatatcgtaaggaacatcttctttttgcttttcaacagttgccatattcgcaggcatctgaagcggaagtaatcctgatggttcgtattttccggttacgatatctacaatcgcctgattggaaacattaaagttcatcagaatggcatcagcatgtttttcaaattcgttgaaaaccatcggttttgaagctgttacagaaacaatgacaggttttccgttcattgccttgtacgtattttcaatggtcagcagatctgtaaagttggtagcggttgatgttttatttctgaatgtcctgtcgtgtacattcggagctacaaccgggtcacctgctgcaatacttttctcacgggcttcagttgctgtataggttttgtattgaagagaaatcggaagatatccgtttcctccttctgcagcatcaatatcgctgtaaccaccttcttcactgtgcggacttttcacaaaaaccaatgcgaaatcggctttagaaggatcttcggttacgttataatgctttttgattttttcgatgtcaacaggataatccagagaaggagctgtgtaaattccccaccagttaaatgttgccggagaatatctcttcggaatataaaccgtttttctttctttgataggaagaatattggatttatttttcaacatcacgatggattttacctgggcctcataccccgctttcataaattcaggattaccaactattttttttgtttcttcaatgttgacgtaaggattttcaaacaatcctgttctgaagaaatttcttaacaaacgaacggcagattgttcaaattttgcacgataagctttttcaccatgttctttcactcccatctgataggcttccaaaacaggtcctttatcattatttcctccgaattggtcaacaccggcttccagcactttatagtgacgttcggcaatggataatttctcagcgccccagggtttacctgcaaatcctcccggagttttgggttcatcagcggtaatcagccagtcggtacagaccacaccatcatatttgtattttccacgaagtaagtctgtgatcagatatttgctgtaaccgtttccgacattctctccgtttttcgtatcctgattaaagctgattgtataataaggcattaccgcagaagcttctttggttcctccgtttaatttgaaagcaccttcagtaaaaggttttacgtgattctggaagttatttcccggataaaccgcgaattttcccattgcccagtgcccatcacggccgccttcttcagggccgcctcccggccagtgctttaccatggcattcacacttttattaccccaaccagttttgcttccgatggttgtctggaaaccgtcaatatatcctcttcccaaatcagctgtcagttccggactttcagaaaaaacgtaagcgattctgtaccagcgaggctctgttcccaggtcgatttggggtgataaagccgttgaaattcccaatgccctgtattcctgagcagcaatatttccgaatttcctgaccagttccggatcaaaagttgcacccattgccaggccatccggccaaagtgaaatctggccgcctgctccttcattaaactcagcggttacggttgcagaatgtctcgggtctgtactgttattggctggaattcccaatcctaatccttcaatataagcctggatattgttgctccattgtgctgcaatttcgggagactcaacagttgttaccaaaacatggcgcagattatcttcttttaagaatttcttttgctggtctgttaagtccgaggcttttgccccgctttctttatacagctttccgttatatttacctgcccggaaaccgtctgcaggcgcaggaacagactgatggccgctgtacagcattaaccctgcaatttgttcgacgctcatttttgaagccaaatctttcgctctttcgtcaacgggaagtctccagtcttcgtattgatcaagctttccgtttctgtttaaatctttgaatttatttcctccaattgtaagaattttcacccctgaatctgcagaataccctaaaacaggacctttgggattcgtcaccatctgaatattctgtgaaaatgctgttactcctaaaaataatgcagcaatatttaaaaccgtccttttcattgtttatattttagaaattgaagtttactgataattggcctgtcaatggcataatgtacgttcctgtcaacagttttccgtaatacggacttgcatctgtaatcaattcagctccattgatagttccactggctcctctttggttcaggaagttgattaccgttgcacctatgttaatgtttttgtttacggtatagcttactcccccgaaagtttcccatctcggtgcaaaatatagtgcattggtaagattcgcatattgtttggagaaatatctgaagctcgcccagaatctccacttgtcaatagaataacttggatcgatttccattaaaactttagcaacccctaatacattgttgtcgttatagtcataatcttttccgaatgcattgaaattaaatttcttatacacaggattctggaaagtaaccagataatgtaaattaaatcctttgaatggttttaaaacaaaatccgtagtccagcccagcgtctgaatatcataataaacggttgtggtttgtgcctgagagctatttgcaggatttaccagattatatctgttaaggttgttatttttcttcaggtaggtagcctgggaaatcaactgaatccagttggtattccagaaaactccgaatgctcccaacggacttttaattttattggtattgggttcaaaagcctgggaataactttccaatcttctgttttcttctgtgtacaggaaattggctaaaaccccgaagttcttggtgatgttgtaagttgcgttcaaacttcctgcaatctgaaagaaactttgactgatatgattaaactggtcaggatctgtaaaactaaagccaatagtccttggagccaaagaatactccccgtcgatgatgtgatttcttaaatgtaaaccatagctcagattaaagttgtcggtaactttccattcatcaataccatacagtgaaaatttattctctgttccgctatggtattctccgcctgcattgtaattgtaaaaaccgtcagaatcagtattcggaccgatcaagcgttgaggctgcggctcaacagtctggaagaaaaaagtacggttggacgtatatttgttgacgtgataatattgctccaacgctccaaatgtcaaattatgatttcctacctgcttgttcagagaaaaacgtcctgcaatgctggtaatcggggtttccggtgtatacattcctaaagtagttcctacctgccctgaataagcctggccgttggaagccaaagtatatcctgctgaagaatctgcattgaaaatacttaaaggaatcatattggacattttcacttttgaaaaatgtgctcttgttgagaatttgaaattccatccgttgttcaaaagataattaccaaaaatatcaatgttatgagatttagatctgttatcatctccactcatagatgcccaataataatttcctgtaagaatatctttgactttcatctgtccgtctcttactacataagaatctcttccaattttgaaattatcaagctctgttacttttccgttttccccgtattggaaaacagcataattggttatgctatacgaatctgcatatttgtagagtgcggtgatctgtcctttattgtcgttaaaatacttggtcacgcctgctctgaaaatttttgtttcatcagcatttcttgcaaatcctaatttataggtgctcggatcatagttggcaaaagctcctgcggtatacgtccagccatttttggaaattggacctgagacattgacatcaccctgtaaccagccaaaattgctggtggtaaatttgcctttgatcttaaggtcttttgttcctgtctgcgaatatgaattgactgcaaaaccaagatctcctgtcgtattggccaactggtccatttttaaaagtcccgttctttccagtccaacactttgcctccatgttttattgggcagttcgggccagaaaaaataaacaactggcagatcattttcgagaatcgtaattcctccaactgtagaaggaagaccaatattgacatcacgagggctggtattattggcagcattgagcatgacattcctgttgttgtcttctttggaggaagtgatcgcttttttctttaaagctaagctgtcggcttgctgtccaaatactgctccacaagaaagcatgagcagtaaagtggaaattcggagttttgagtttttcataatgatcaattaatctgttttttgtttgggttgtgtaatgaaatgatgaatttcagatggataactgatttaaaattaaacaaatagctaactggattttatccttgtaatttttgacatcccgtggtatttttagttgcttcataatgaagcaactcaatattacattctttttctgatacagccaaataaatgttaaaaaaatattaacattatagtaaataattgattattaataaattataatcaatgaaatcaaaataaaatgataaaaagaccatttatttacccggaattgtaaattatatgttaccaaaaagcaatgctaaaaagcctgaatgtttgcaccttccttaatatcaccttaactttgttcagcgagaacaattaaaataaatatgaaccctcatcaacagattttaaaaaaatcaacagaagcctatcagttatatcttcctcatatttctatcgatactgtcatcttcggattcagtgaaaacgaacttaaggtgctggctataaagatgaagtttaacaaacaatggtttctgccaggtggctacctgaaaaaagaagaaaatattgatgatgcagcggtaagaattttaagcgagcgcgccggtgttacggatatatttctggaagagttttccgtttttggtaagaatggccgaagtgagcaagttttcagtgattatgatgacagcttgtggcataagcaaaggtttatttcgattggttattatgcattggtaaactatcatgacgtttctccaaaagcagacgaactgagcgaagaatttgaatggctcgacgttaataacctcgatcattatcagattactatggaccacaaacagattattttaaaagctctgctgacactcagggaacgaataacctacaagccaatcggctacaatttactgcctgaaaaatttaccatgacagaattgcagcgattgtatgaaacgatattaggaagaagtctgaacaggggtaatttctacagaaaaataaagaacctgggaatcctaaccaagcttgatgagcaacgcaaaggaggtgcccataaggcacaagatctctattcctttaatcaggaaaattatgtaaaggcactggaaaatggagtgaacagctggtaacgatgagaaatatatgtgaatagtaaacacaatataaaatcattaccagaagtttttctggcttgcaatcctgtttcctgtttttttaagtagattatgcttcgtctttggtatttttgacaagccctatcccggaaaagaagaatatgagtccgagaactcctataacgcccaatgtggtgtaagcagcacttttattgatgagctcatatccggtataaattaaacctgcaattcccagaatagtcaatatagttccaaatgttcgtttaacgttcatagccttaattttttattgttaaaaatctagtttaaaatttgttttctttatatagctccatcagaaactgatctaaggtatttttttaaattggttccttatccccaatatagatttcaaatatccttctgtaatagagtatttgtttctatgaatatatcaaaccaatacattacatgtaaaaaattgcaaaaaccaagccgtttagtgaaaaatatactttttgcaatacaataataagtttaacaatatgcaagccagattctcttacatttacattattttccatcagttgaaaatttaagcaggtaccacactgcgacagattttggccggatgtttgaaatgatattacaggtttcgagattttcagtagaatgtaatcaacaacatgtatggtcattatcaatagttttgaagaatataaggcatttgaaggtaagctaatcggtgtatcggactggcataccattgatcaggagcagattaataaatttgctgatgcaacattggaccatcaatggattcatatcgatcatgagaaagcaaaaaaagactgtccctttaagtcgacaattgcccatggctatctgactctgtcacttataccctatttatggaagcagatagcggatgtcagaaatgtaaaaatggaaattaattatggcatcgaaaatttcagatttgggcaacctgtccttgtaaacaaccgtgtacagctgcaagcctatgcaaaatctatctgtaacctgaggggaactgtaaaagtgattgttgaggccaaattaattattgaaggagaaacaaaacctgcctatgtgggtgatgttttatttctttatcattttaataattgattagtcaatggggtattttgttcatttacataacaaactataaaggagttaaaaatgaattgatgtctattttcatttgtatagattggggcattaaaaaaatgcgatgatcgcaaaaaatataaggagttgtaatgttaactaattacaactccttatattttttaagcgtttttcaaaaatttttatccttcacgctcagtggagaatacgggattcgaacccgtggccttttgactgccagtcaaacgcgctagccaactgcgccaatcccccgaattatttaagcgatacaaaagtaagtatttaaatgaaatctgcaaatatttatatctttttattgaataaaaagaaaataaaataataagtaacagcaagaagttttctatttctcgttggatagtacagataagattgacagaattaaataccaaactcttgcattagaaattgctgtgatctcttttaagtccaactacttatatcttatttccttctactttttgtcttcttcacaaaattctaaatcttttacttgtctgaagtgataataaaagttatttaaaaaatcaaacaattacaatagtaaaaatttatactttattttaaataataataaaataaagtactaattttattgcaaataaattcagttatgcaagaaaaatccaataacacaaaggaaaaaatagttgaactatacggtgactatcttttgaaatatggagaaaaaccgaaaaacatttatctgttcgctaaggaaaatgattttgaagaaaaagaattttatcactatttcgcggggtttgaacaaattgaaaaagaaatactgaatcatcttttcacaaaatcattgcaactttcttctgaaatcaatttttcagaccagttggctaccaaagaaaagcttctgaatgtctattatattttctttgaaaaccttaccatgaaccgctcattggtattattgattttaggaactgataaatttcaaaaaattaaggtgcttaatagcctgcgtgaaacgcataaggaattcatcagtactctggatttcgataagtgggaaatcattgagaaagcgaaacaagatattcaaaaactcagcgaaaaaacgagatatgaagctctttggcttcatttaatttcctcttttgagttctggataaaagacacttcccctgattttgaaaagacagatattttcatcgaaaagactatcgatacaggtttcacacttatggatagtgaaccgttaaagaaggtatttgatcttggcaaattcctttggaaagaaaaatttaccataagctgatgatagtttttattctcctggcttttaataaaggcgtcagagaaacagctgtaaaataataaaaaaatacctgacaaaaattaaaatgaaaacattagataaaattcccacaggaaaaattgaacgcacgggcagcctgctgaaagcaggtgcgaaagtgggtgtcaactacctgaaatattacggaaacaaaatcacgaaagatgaaaaaaaagctcgtaaaattctgaatgagaataacgcaacagatatttacgattctctgaaagaattaaagggctctgcccttaaggtggcccaaatgctgagcatggaaaaaaacattcttccggtagaatatgtagaaaaattctcgctttctcagttttcggtcccaccactttccggtgctcttgtgaagaaaacatttagaaaatattttggaaaaaatcctgaagatctatttgatgcgttttcttctgaatcagtaaacgcggcaagtataggacaggttcataccgcccgaaaaggtcatcagaaactggctgttaaaattcagtatccgggagtgagagaaagtatttccagcgatctgaaaatggtaaggcctatcgcaatgaaaatgttcaacataaaaaaagaaggttctgaatcttattttcaggaagtagaagacaaattgttcgaagaaacggattataatctagagcttatcagaagccagcattttgcggaagaatgcagccatcttccgaatttaaaatttcctaattattatccggagtattcttgcgagaaaattattacaatggactggatgtcgggaatccacttttcggaatttaccggaaagaacaactctcaggatgatctgaacaaaattgggcagacactttgggatttttatatgtaccagatgcatattctgaaaaaagtgcacgcagatccgcatcccggaaattttctgatttctgataataaggaagtactggtgattgatttcggatgcatcaaagaaataccggaagatttttacattccctattttgagctggcaaaagaagaaaatcttaaaaaccctcagatcttccgtgaaaaactatatgcattggaaattcttcggcaggaagattcatcacaggaaaaagaattttttgcccaactgttttacgaattattggaattatttacaagacctttcaatcaggaaaaattcgacttttctgatgaaacatttttccgggaaattgccgatctcgggcaaagatataccaaagccagcgatatgaaaggaatgaataccaatcgaggttcgagacactttatttatctgaaccggacgtttttcggtctatataatatgatgcacgatctgaaagccaaagatgtggtaattaatcattatagaaattatttaagaccttgaaatatgccagccaaattaccgtccaaaatctgtgaagtatgcggattgccattcaactggcggaaaaagtggaaaaaaaactgggatgaaataaaatattgcagcgaaagatgccgaaaaaacaaaaaatcaacatcctttggttcaccaaagacctgagaacccgggattcggaatcattatacaatatcatgcaggaagatctgccttttcttgcggtgtttgtttttgactctgatctttttgcccaaaaacaattcggtttcagaaaaatcggaaagtacagaacccggtttttactggaaagtattgaagatttaaaacaaaaattagctaaaaaaaatattccgttgttggtacgacaaaataaaacggaaaatgtttttgaagaaatagctaaagattttgaaatcgtaaaaattttctgtcagcaggaatggacaaaagaggaaaccgaccttcaaacgaaaattcgaaaaacggttccctatgcgttttgggaaaaatcttattcacagtttttactgcatcctttttttgtctgtaaagtgttggataaaattccggaccttttcactaccttcagaaataagattgagaaaaatctgctgattcgtccagaatttgaaacggaacagctgatttgttataaatctgaaattcatttcgaaagcgataaaattacgctccggtctttaggttttgaagattttgaaacagatgcaagaagtgcttttccctttccgggaggagaaactgaaggcttaagacgtttacaatcctatttaccggaaacccaacatctgagcaggtataaagaaacgcggaacggcctggtggggacggaatacagttcaaaattttcgacatggctgtcctgcggaagtctttctgctgtgacaatttatcacgaaatcaaacgatttgaaaaaaagttcggcagcaatgagtcaacctattggctgttttttgagctgctttggcgggatttttttcgctatgtttccttacagcataaggatttgattttccgaaaaaaagggattacccatagacaatattcggcatcccatcatctggagcttatccgaaaatggaaaaatggagagacaacctccgattttgtcaatgccaatatgattgaattgcaaaaaacaggctggatgagcaacagaggaagacagaatgcagcctcctatttctgcaaaacgctgaatcaggattggagaataggggctgcttattttgaggaaatgctgattgattatgatgttcacagcaattacggcaactggatgtatctcgcaggagtaggaaacgatagccgcgaccggacttttaatccggaaagacaggcagaactctatgaccccaaacaggaattcagaagactatggctaaaagtttaaaacataccgctcagctaatttttcctcatcagctttttgaggacacagattatcttatcaaaaatcaacctgtatttttggtagaagaattcctgtttttcaggcaatatgcctttcacaaacagaaaattgcctttcatcgtgcaacgatgaaattctatgaagactacctgaaaaaatcaggatttgaagttgaatatattgaaagttcctcgaaatactcagacatcaggaacttaattcagaaacttgaaaaagatcattttaaaacgatacaaacaacagatgtttgtgatcattggctggaaaaaagactgaaggaaacaaaactgaacctcgaaatgccggacagtcttctttttataaatactcaagaagacctgaaagattattttgaaggaaagaagttgtatcaccagaccgacttttacaagcagcagagaatcacccggaatattctgatgaaaggaggaaagcctctgggtggaaaatggacctatgatacggaaaaccgaaagaagtatccgaaaaataaaaaagcacctttcatacatttcccgaaaaacaatgagtattatcaggaagcgaaagcatatacggaaaaatatttctccacaaattacggcacccttactgatgaacagctctatcctaccactttcaaagaagctgagcaatggctggagcaatttctggaaatgcgttttcctgaatttggcatttacgaagacagcatcgtagaaaaagaatattttctgcaccatagtgttctttctcctatgatgaacgtgggacttttaacagcagagcatgttttggaaaaagccatttcattcgccagggaaaatgatattccggtgaattcggtggaaggttttgtgagacagattttaggatggcgagaattcgttcgtggtgtttatcttcatcagggtgtatatcagcggaataaaaattactggcaacacaagcagaaactcccggggtccttttataccgcccaaacaggaatcaggccggttgacagttcaattcagaaaattctgaaaactggttatgcacatcacatcgaaagactgatgatttttgctaatctgatgaacctttgtcaaattgatcctgatgaaatataccaatggttcatggaaatgttcattgatgcttacgattgggtaatggttccgaatgtatatggtatgagcagtttttcagacggaggtaaaatgagtacaaaaccctacatcagcggcagccattacatcaaaaaaatgagcaattatcccgacggggaatgggccggccaatgggatgcacttttctggaacttcatcaatgataacaagaagttttttgctaaaaatccaagattgggaatgatgctgagaacgttcgaaaaaattcctgaagaaaaacagcaacagcatataaaaacagcaaaggaatttattaaaaatctgaaataatgaaaaaaaatttcaacatacaggaaacagaccggattattgagatggcctgggaagaccgtactccgtttgaagctatagcatttcagtttgatatcagcgaatccgaagtgattgaactgatgcgtactgaattaaaagaatcaagttataaactttggagaaagagagtgaattccggagtgagccaaaaacacctgaaaaaacgaaaccaggaaatcaaccgctttaaatgcagcagacaaaggaatatcagcaacaataaaatttctaaaagataatataataatcatgaaaaatataatcatcgtaggatccggaaagggaattgggctggcaacggcaaaaatcctctccgaacaaaataaaatcataggaatttccagaacggaaaatcctgaactgaatcatcctaatatagagttccatcagatggatattctttccggaaatttagatgaaattacttttcctgaagtggtagatggattggtttatgctcccggaagtattaatcttaaaccgtttaacaggctctccatagatgatttcaggaatgattttgaaattaatgttgcaggagccgtgaaaataattcagaaacttttgccgaatcttaaaaaatctgagagtgcttctgtggtactcttcagttctgtggcggcgaaactgggaatgccatttcatacttccattgcagccagcaaaagtgcagtggaaggccttaccaaaagtttagcagcagaatttgcaacgcagaaaatcagattcaatgccatagctccttctttaactgatactccgctcgcctcaaacctcttatctactcctgaaaaaaaagaagcagcagctaaaagacatcctcttcaaagagttggaactgcggaagaaatagcggaaatgactgcatttttggtatcagataaatctccctggattaccggacagatttttggaatagacggtggtatgggaagtataaaactttaagataaaaagatatatttttagagtaaatttgtgccatgaatactgattttttcattgatctgcttcaccaggtaaaagaatttgaaagctctgagggctgtacatctcatccaaccgttgaggatttccggctttggatgaatgatcaaaaatatagaaaagaaagtccgaccaagcttttcaaaaacgaacagcatacggtatcctttaccgaaaatgaaatctgcaaacaggtcctgctcttagcaagatattctaagcagctcgtcagaaaaggattgaatgattttccggaattagccaacgaagaattcacatacctatatcgactgaaagatgagcccaatctgactaaaatccagcttatagaaagaaacggacatgaaaaacagaccggcacccaaatcatcaaacgtttattagaatacaatttgattgaagaaaaaaatgacagtgaagacaaaagaagtaaacgtcttaacattacaaaaaaaggagaagattatttccatcgctctatagaaaaagtaaatatgacttcaaaagttcttaccggaaagcttgacaataatgaaaaaaaagagcttctggaattgcttagaaagctgaatgattttcatgccaatctttactttcaatataaaaactccagcattgatgaaattactgaagtattttaaatagaacgggttctgaaatttattttctttatgatatgatttgtcaggttagattgtacagaaaaattaattgaactgagctctatattgttgaggactttgccgggtttttaatttaaacaatcggctaaaggattgaggctgttcaaaacctaattcgaaggcaatttcagaaatactaagatctgtggcagataacaaattctttgctctataaatcattttatcgtgtataaattgctgagtgttttgacctgtaaggtttcttaatagatcacttaaatatccaggtgacatatgcagctggtcagctaaatagttgacagttggaattccagcattcaggactttatcactgttaaaataatcttccaacaactgatcaatacgatcggtaaaactaggatagttttgttttcgggtcagaaactgcctgttataaaatcgttgggcataatttagcaacagttcaatctgggaaatgatcacattatgactcatgtcatctatacgattttccagctcttcttctatatctctgaatagcgacagaatggtttctttttctttggccgaaaggtgcagcgcttcattggcagcatatgagaaaaagtggtactgatggatcttttgtgccaatggatattgcagtaaaaaatcaggatctataagcaaagtgatctgcggactgagtattttttgttccgcagtttcctctttgtccttctcttctattgaagaaagaatttgctgaggagctacaaaaaacaaaccaccctctttaaaatcaaatttagtctgtccatacattaactctcccccggcatctggtttaaaagctattttataataattcaatacatgcgatttattaggtgcacggcctgtcagaggcttgtctacgccatttaacaaaacaattaaagggtgcttcggaggcggaaaaccagaggcctccataacatcggccagcgaattaaatctttttacggaatgatttgatttttttgaagccatggtataaaattctagattacaagttaagcaatattcgctttcccctgcaaaaagaaaagcgaatagaacggaaaggttgttaaaaactgcatagatcattaaccttgtgccgccactgaaataggtttccaggtttcccattcctgaattctttctgaatagatctgttggatatgtggcaaatcatttttacccaacagcaatctaagtggtgggttttcagcatctacaacagcaaatacagcgtcagttgtggccataggatttccccgttccagcttttgcaaatttttcatcagctgttttttcaaatcatcataatccgatagttttttgctggcgatttttagtgattcggtactgccaaattcagtattatatgcccccggttcaatcagcgttactttgataccaaatgctgcaacttctttagctaagctatcatgaatagcctcaaaggcaaactttgaagaacaataatacccaataagaggattactgtaaatgccaacggcgctggacgttcccaaaatatggccataaccctgcgcccgaagtataggtaaagctgcctgaatcacatgaaccggtcctataatattggtttcatacaaggcttttacctcatcggtgccactctcttcaattgttcctaccaatgaatatcctgcattattgaatacaatatctaatcttccaaaatattcgttggccctggtaatagcattttgtacttgggaaacattggttacatccaattcaagaatcaggacctgatcgccatatgtttcttttaatgtggcaatactactgatatcacgtgctgtggcagctaccttgtctcctcgtttcaaagctgcctctgtccatatttttccaaaacctcttgaagatccggtaatgaaccaaactttttctttctgtctattttccattttttaattgtattaatattacagcaaatttggttctaaatagacgtacttacgttgctaaaacaaggattttcctaaccaaaacgaagaaatgcgaactctacggagaaaagaggatttcccatgatatctaaagaaaaactgtttgaatccaataaaaagaactcaaacagtttacatttagtactacgctcctctgttatttgaatctaagattcagagaaataatatctgaactcattcctacagattttgtataatgaccatacctgatctccagcatattcagacgttctactccaaacaatccgtttttaggactcagcctgattcctgctccataaaaattactgttaaaagtagacagatcataattgcttgtataataatcatcaaaagctgtgtgctgttcataaggtgcaaaatattttgtccctttttgtgaataatacctatagaacgggcttacagaaacgaaaggtgatatttttaccggagtttcaatattgaaggtattggatctgatgccccagctgtctgtataataccggtaatacgtcctgaatataaaccggtctcccagaaaataattggcgcgcactcccaatggcagtttgaatcttttatccgggagtgtttcctggtgcacagaaccatctgtgaaatataccctatggaaaggcagacttagaaaacctgtctgctgtacagcatccgtcagaaactcaacctgaaaattctgattgataatctgggaatatgctaaagacaatgcaaaggtatttcgtccgctcgttccatagttttcgtgctctcttcctgttgaatttcctgtacgtaattctataggtgctatcagttttacctgatcaagataggtctgaaactttgcagtaaactcccccatccggttggcggttttctgagcaaaaccaatattagccccgtaagactgatagtcaaattctgtagaaaaagagagccctccgaagatggtacttcctttactttcattctcacggctccactgaagtgatggatatattctggtatctgcatgagaggccgaagaattggctttaagatcaatcatatctgatgaagctgaggtataatgatctacaccaacactcagattgaatttatttttacgctgcttactatcatattttaccatcgtaacatcaatcgtattggaaagatcagtaagcttctccgaacccgttcctccagtcaccgcagaattatttccatcctgatggtaatagctggatacaaggttggcttcatcaaaacttagttttttggacggtgctgtattgatattttcctgtgcattagcgcttaggaacccaaagagggtccatatgcttattacaatttttttcatttctgatttttatcttatatattgtaatacactcaattacacccgcatccccctcctacttttccggaattagcacctgaggagccttctctgtaagactggaaacttaactctgttttttctatagtcctgttgcccaatgccatttcggcatcattgagctttcctttttcatattctttcaaagcggtacaggagtgggcaagcattataatacctgcggccaccagaccgattcctaatttttttatattgtttttcattgtaaattaatgttttgagatgaatagactgtattgtcatcatcgataatgatacattccagctgatgaatctgattcaccagatccagcgctgcttttattcccataataccgacaggagttgccatggcatccgctatttctgcattcgggcagaaaatagtgacgcttttaactcctgagacaggcattccggttttgggattgatggtgtgagcatactttttgccgttgatcatgacaaatttttcgtaatttcctgaagttgctacagccatatctgtaatgttcatgtaagaaaacggctgttttacatgatcgggatctgcaattcctactgtccacggttttccgttgctttgcattccccatgtggtaagatcaccggaagcatttacaattcctgattgtactcctcttttctgaagcagcctttttgccatttcagcagcataaccttttcctattcctccaaagccgattctcatacctttttctttaagaaaaacagtctgatcttcaggattaagaagaatattctcataattcaccagttttaaatgatccttgataagatttggatccggaagctgcttcatattacggtcaaaattccagaaacttttatctattcctccataggaaatatcaaaatatccgtcagtaatccggctaatgcgaagacttctttcaatcagatcaaaaacttcccggtctacctttacaggttgtattcctgcgtaatgattgatcaggctggtctggctgttttcactgaaagtagtgagcagtttttcaattctctgaatttcggtcactgcagcttctatatgctgataagccgtattttcatgattatctactaccgttatttcaaaagcgtttcccatcagcttctgaggctttctgaattctctgagcatctgttcttattttctttgctgttggatatcttttatttctttactaaaagccagtgcgctctcagaaggcaggccttcccagcttttcagaacttttccgtcctgatccagcaaaagagtataaggaaacagtcctttcgaattgtatatatcggcaagtgctgcattttcctttttcatttctacggaaagctggttctttttgtttcttggaaagtcagcgttaacatagacaataacattttctgtctccagctttttgaaatcttctgtctctataatattcttatgaagcttgatacagggaatgcaccagtcagatccggagaaattaagtaaaataagttcatttttggctgcagcttcttttttggcattttcaaagcggttctgtgccgtgatgccaatagaaaacatccccatgatcagggataaaaatagtgttttcattattttaaaatggataatgattaatataatacgtttgaacgctgtatatcagcttatgatatacagtatatattggctgacagtggctgacagccttttttgtttaaaatatcaggaaaataaatactttggtggttcccaggcggttctaagaaagcctctgtagcagaaattatcatttcttgatggcattttccgggattttatttgtttaaaatgatcgttctttatttcaaactgaaaagtatctccaataataaaaatcaatgccaggggtgtgctgtgaataacaaagggtaatttctgatctttaccataatcaccatctttaacgggatgatcatagtgtgttttcagaaatgcagtgagagacatctccggattcaactttttgtgttcccaataatgttctatcaaagtcggaatttttaacagttgatacacttcggttgtagaaaccaaatagagtgacagcaacaatatggaaatcaactttttcactctatcaaaattataaaatatttcattaagaatgattttaaataaaatttcttttagtctgtttttaatcaaatttttcaaagaaaaaaggtaataaaataccggttcaactccggaaacagttcttcgaaataaactagtataattgaaaatgaaagataaaaaccagtttttaatttcttatgccagcagccaaaaaaagtattaattattactcatttaatagtatattgtaaaacaaatctgcattattatatgtctgccaaacgttacgttcaaacccgagccaggaaaatcagaaaattctttggattattaggtcctggattaacgaccggtgctgctgatgatgatccttccggaattgcgacatactctcagacaggggctcaattcggttatgggcagctatggaccgcactctatatgctcccgtttatgatcgcagtgcaggaagcctgtgcaagaataggactggttaccggtaaggggctgacgggagtaattaaagatcattacagtaaaaaaatactatatggttcagtaggattggttgtgattgctaatactattaatatcggagcggatatcggagcaatggccgctgcagcacaattaattattcctgctgatattgtcatactgatgcttgtttttaccataagcatattaacattggagatattcaccagttacagggtatattcaaaagttctgaagtggctggcattatcccttctggcctatcctcttactgtattcattattgatcagccctggaaagaaatactgaaggcctctattgttccccacttcgaattgtctttcaactttcttttcatcataaccggagtgttcggaacaactattactccttatatgttcttctggcaggcctctcaggaagtggaagaagaaaataaaaaaggattgattcaagatggaaaacccaaaatcggatggtatcatattcatgcgatgagaaaagataataatataggcatggtcatctctgaatttactacatggtgtatcatcctggttggaggaaccgttttgcacaacgctaatataacagatattaatactgcagctgatgcagcaaaggcattagaacctttggttcagtcattcccagattccggattgatatcaaaaatcatctttgctatcggtattatcggcttaggactgcttgctgttccggtgctttcaggatcggcatcttatgctgtttcagaagctctcaactggaatgccagcttagacctgaaattcagaaaggcaaaaggcttttatatggttattatcatttctacccttattggtctttgtatgaattttatcggcattaatccggtgaaagcccttgtatataccgcggttctcaatggtgtagcagccgtaccgctgttgtttctgattatccgcatatcggcaagcgaacgcattatgggagagtttaaaagcagatggctttccaaaagcttattgtgggccacttttttctttatggccaccgcttctgtggcaatgctgtttaccatttaaataacaattccctgttccacctgtgctaagattatttcttcatcttttttaggaatgttaacaggtatctgaagctctgtctgaatttttaccctgagtgcttccaatgcagaaggttccccgtgaacaagcatgatctgcttgggaggaatttcatattttttaacccaatctattaattcagactggtctgcatgggcagatagtcctgtaatttctgcaatatgggctcttacatcatagtattttccatgcattttgagttcatgagactggttgagcaaagccctgcctcttgtaccttcagcctgaaatccaacaatcaggactgtatttctacggtctccgatataatgttttaaatattccagcactcttcctcctgttatcataccgcttcctgcaataacaattttagactgtttttgtgcaattatttcctgggtttcagtataatcttgtgtaatgtaaatcttctcaataatatcattccacttctgtctgtcgactaacgtatagtctgagtatctgaccataatttcggtagcggaagctgccattggactatccagaatcaccgggacgccggccggtattttattactgtctttcagttcctgaagcatataaatgatttcctgagcgcgtcccacagcaaaacagggtataataatatttccgcctgcttttatggtcagattaatccaatgttccagctgatcagacaaatctttgtgatcatgaagcctgtcgccataggtagattccatcaccagaaaatcagactgtgtaaaaaaaatcaggaggggccagaacagcactgtggtttcgtccgatatctcctgagaaaactattgtttttccaaagcaggtaatttttacagaacaggctccaataatatgcccgcagggcttaaacatacagcttatatgatcgcccagcttaatttccttattttcatcaatcacaaaaaactgtttaaaagatctttctgcatcatttaccgtatacagaggttttgccggatggtgccttgtataatgatgccggttggctttttctgcatcttcttcctgaagcttggcactgtcaagtaatatcagttttgtcagttccttagtaggaccggtcatgtaaattttgcctttaaacccattttttacaataagtggaatatatccgcaatggtcaagatgggcatgggtaagaataatggcatctatttcagaaacatcggtattcaggggcagccagttttgctctctaaggtattttatcccctgaaataaaccacaatcaattaaaatagtaagttcaggagtttttaataaatgctttgatccggtaactgtttctgcaccaccaagtgacttgaaagtaatcgtttccattttaatacaatttattggacttttatttttttattcatcttctttactgtatttgccttacccatctttatgtaaagccgtccgtttttgtaccgtgctttaatatcacttacatcaattccttccggaagcctgaaactccttgcaagggaagacgttaaaaattcttttctgacataattttttttaatttcttctttttcatctgttgcgtaagcctgaatgttcaaaacaccattttctactcttatcctaaaatcttcttttttaaagccgggagcattcacctgtatcctataattcccgtttttatcaatgatatttacggaatgttctattttaccaggttggttaagaatttcgtttttactccagaattcttctgttaatagttttaccggagtttgttttggggctgaagttttcataataaccatttttggattagatatcaaaggtaccctaagacgtatttggaaaccatgacaatgatcgtatttaattgtgatcgtcatcatctttctgccatgtgttgatgacgctgataacttcataagcatcggaaggattagtgtttctgatatgtgtccattgtaacctgtcatgctttatttcaggcagattacctgtgaaaggatctttaagccatgtgattatatatctgacgcctaatgaaacaaattttttaagaatagaacacgaaacagagcctccatcaccagtaatgataacaacatcttttgaacgggcaaaatacactgttatttcatctaacggaacattgatgatggtaattttatgtcttttatgattggctaaagcaaggaattgtttatcaatctggcttatctggtatacgatcactttcatagcttctgttcatacatcaaatgtattgaagatgaaaaaagctaaccgtgtgcaaaatcattattaaagatgatctgtattttaatttttcattttctgtaatcgggtaatgtccaaaattgtaattctgccggcatttctgtcaataagcccctcttctttaaagtctccgagtatcctgctcactgtttctatagccatgccggccatagaagcaaggttctctctggaaatttcgaaatttcctgtcccggaatgagccttgtatagcttactcaggacttctgccattctttttctgactgaaaaataagcaagctgcaaaagctgttcttcatggctgataacattttgtgccagaattttaataaatttttctgccacatcaggatatttgcagaccaactgatccatcacctccctcggaatggaacataaggcagcatcttcaagcacttcggcggtttctttatattctcttcctgtaaacaatgaggtgattccgaaatattcgtcaggataatatacatgtgtcatcaactctttcccttcctcagtcatttttgtggtttttactgatccggaaaggatcaggtatacagcactcgccgtatcaccttcattatagataacctgcttctttttgagtgttttgattttacggtcatcaaaagattttttcagttcttccaggccatttacagattgaaacagatgattcatctggtcatacttactgctgtaaaactttttctgatgttcttttttcctgagcctgctctcaattgcatttaaaagttcgatatcatcaaatggttttgtcagataatcatctgctcccatttctattcccttacggacttctgccctgtctgcttttgctgtaataaaaataaaaggaatcaatgaagtttcttctctcttacttaacagatagagcactccatatccatcgagttcaggcatcataatatcgcacaatataatatcaggtatgtgtctgatggccagttccacgccttgtttaccgtttttcgcctgcaaaacctcatagtcagccagctccagaatttctgaagtgctttcccggatgtcatcatgatcctcaatgattagtatttttgtttttgtcatgaataataaacttttattttcgcttaaaagacaatgtaaactgagttcctttaccaggtgcgctgttaaaatctatatgcccgttcatcaggttaacatatcggagaacaatatttaatcccagcccggttcccggaatattaccaatattatgagccctgaaaaaaggctgaaaaagccctgaatgatcttcttcaggaattcctattccattgtcttttactgtcatcagataatattctttatttatttccgtacaaaactcaatgagcgtattttccccggaatatttgatggcattactgatgaggttcataagacagttccttaataaattctgatccagaaataccctgttttctattccggtatgctgataaattatgatttgattgtctttggtaatcagctgcatttcttccacaagctcttcagagaatcgtataatgtcaaactcatgataatccggcgttacaatacctgcttcaagcttctccaaagaaagaaagtcgttaagaattccgttaagacccgtgattgcattttttattttatgaaggtgtttcaggatctgggaatgatcagcaagctgaaggtatttttctataagaactacggaaagctgcatggagcttaaaggggtacggaattcatgcgaagccatggatacaaaacgacttttcatccggttaagttccttttctttttcaagggaaatgttcgcttcttcttttgccttttccaatgcacttagcatctcctgaagagattttgttctcttttcaaccaggtcttccagctcaatggtatactttttaagaaactcttcggcttctttttctttcgaaagatcatgaataaatccggtatagatcaccctgtcattaagctgaacttcacttaccgcaagcctgaatggaaattgggaaccatcttttctaagtcccttcacttctctgcctttaccaattatttttttctctcctgtattctgatatcgaagcagataactgtcatgcccgctatgatcaggttccggcattaacatagaaatatttttaccgattaactcttcttctgtgtatccgaaaatctttaatgcagaagggtttaagttttcaatcctgcctcggctgtcaatggtaataataccgtcaatagctgtttctatgattgcatgtaagagtctggaactttccataaaaaataaatacttacccttattaaagataagtattttaaatcaactttctacgaaatactgtaatatgttagtaaaatagcattttttaaaagggtgtttcatcaatattttttaactctaaaaataaatatgacctccttcaggaataatcaataaagggatctgtaaatcctgagcctgtcttgctgcgtggctgcctgcaatgagcctgcctataaaacctttctgctgatgccccataacaagcatatctatatctttctcttttaaaatattcaatcctgtatcaatattctcgctttcgatatagttgtagcagattttcccctcaaggtctttaaagaaagcatctttcttctgttgataggatgtattttctataagatcaacagcagtgtctgtgatatgggtaataagcagttcagcattgaaatacttcgcaaatttgatcaatgcatgtgatattttgatatccatcttattcagatctgtagcaaaagcaatctttttcagttgtttatattgatatcctgatggtatgagaagtagtgggtattcagtatgctcaatcattttgatactgttgcttcccagaagaaatcgtgcaaggttgcttgctcccttcattcccattactaccagtaatgttctgtttccggctgctgtatcattgatcagccggatggtatctcctgtttcgcaggtgtaatagatggaaggatgaaaaggaaaggaatcatccccccacaattgtttttctttatattctatatttttaacttctttcttcatttcatcctcgtattctttctttaatacgggatattcatacaaagcccatgcggtctgcccgagcataggttcttctataggaatcctgaaggcatggcagagctctatattgctttttaatgtatgtgccaaatgcagggcatattcagctgcagttctggctggctctgaaaaatcagtgggtactacaattgttctcattattttagttattaaaattgaatttattctccaaaacaggatcaagattataaatatcattataaaacaccacctttccgttttttacaaggcaggtaaggtatgtaatcatgatgggaaccggctgttttaaaacaaaatcttttctttcgtatcgatccataaaagatttcatcagcgggatctcatcttcagttccatcatgtttaagcagctgcgccgccagatctccggcattttctacacggatgcacccatggcttaaggctctctgagttttttcaaataactgtttctgagaagtatcatgaaggtataccccataggaatttgaaaacctgaaaacgacagctccaagcgcattatcacagccggaagactgtcttatactatattgataaggatttctgtagacctgtttcaaatttgctgatgtaacaggtactatcttccctgacctgtcatacaacgaataatgatgttcctcaagatactggctgttctttactattttaggaagcatctctttgatgaagatattctgaggaaccttccagtcaggagcggttgtaaaataatcaaccctactctttaaaacaggacttggcgtagagggctttccaacaatcaccttataatggagtgtcttgtctttctgaacaaaatccagagaataagcaggaatattcaccaacagataagcatcactgcttatgcccatccagcgcaggcgctccatattaatagctacctttttgatttctgcttcccgattttcagtaccattgctgtagattgtattcagataatcctgaaattcaacatactcctggattttaggctgcacatcaaaagcaacttttggcaaatcatctttctgtagtgcctgatacaatatctcaccggctttaaaaccttctacatcattaccatcaataaaagacggactgtaaaaaggattgtactttccaaagtgtaagtaattgatataagtgataagtgcatctgtcattacaatatcagttacagcattttctttagaatctgtatatttagtttggtctgcaacagtatttaaaatttccggagtaaggctctgctcatggtaatctttggaagacaatccccttttacgggtatctttcagtaaaagaactgcatcctgaagcagactgtgcttaacagagggattgatccaagcatattcaaacccatgttgattgtaaaactgttttactgattttggaaaatgcagttccggaagatcatctttactattcagtacaaatgctatttgactggcagcatttacatcttgtccgtgaagcattgcaacactgaaaacaattacgatccaattcaataaagttttcataatcctgaatttattgatgtaaagttccaatttcatcacatcataaataatgacccttatcacataaaaaaatgatataatcctgtagtatagttttcttaacaatctgtttcttgatcaatcagcttaaaaatcataaacacaactatcatatgatcaacatcatttttcaaaatgacagtcatcattcctttaacaggaagtctttctgaactttgaactataaaattaactacagatgaaaacaaacgagcaattgcagaaagatgttcaggaagccatcaaatgggaaccgctgctccaccctgcagaaataggagttacagcagcagatggagttgtatccttaagtggtacggttgatagttttgcgaaaaaaaaacaggctgaaaatgcagccagaaatgtcgccggagtaaaagtactggttgaaaacatccaggtaaaacttccggattcaaaggcaaaaactgatattgaaattggcgcagaaatcatcagtgcactcacttccaatgttattattcctcaagataaaataaaggttaaagtagaaaacggatgggtagatctggacggcgaacttccatgggattaccagagggaaattaccgaaaatgcaatacagtttcttcccggaataaagggtatttttaataatatcacaatcaaccctgacaccaatgatactgtcagcaaaaaaaaagttgaggaagcattgaaaagaagtgctgttgacgagagagaaataacggtctctgtaaatgataccactgtaacgctgacaggaactgtccattcatggcagcaaaaggaagaagcaggccggattgcctggaaaacgcctggcatcaaacatttaaaaaacaaactggaagttgattatgaatacaatttatagttaaacgattccggttagcagaaactaaacagaatattgtggaatcttttcttaaaaaaagctttactcttgctggcaatatcgcctcattttctgcccggtttttcagggagattctgaaatccggttttgaatataaagagtttaccagacaatgttttgttgtgggataccagtcattacccctggtaacggtaacagcttttattatgggactggtacttaccattcagtcacgtccagcaatgtccagatttggagccgaatcctggataccgggcatggtttctctttcattaataagagaaattgctccggttataaccgctttaatctgtgctggcagagtttcatccggaattggtgccgaacttggatccatgaaggttaccgaacagattgatgcaatggaggtttccgctattaatccttaccgttatcttgtggtgacaagaactctcgcaacaacattaatgatacctgttctggtaatttttgctgatctggtcggcattctgggaggttttataggaatcaatattcacggagacaatagtatcagtcactatttttcccatgtttttgaatctctggaatatgccgaccttcttccggcaaccctgaaaacattttttttcggcttttttataggaattattggctgttatcatggttttaatgctgaaggaggaacaaagagtgtaggaaaagctgccaacacagccgtagtttcagcttctctgatgatttttattattgatctgctcgccgtacagattgcggacttattttttgaactgtaatgaaaacatatgaaaactttaacgctgaatttactttgcccctgattaatcaaccgcttatcgaatttaaggatgtatataaatcttatggcaataataaggtgttatgtggaatcagctttcaggttggaaaaggagaaaatctggtaatattaggaagatcaggttcaggaaagtctgttacggtaaaatgtctcgtaggtcttaccaaaattgatgaaggtgatatttatattgccggaaaagcaataaccaaccttaatgaagaagaactcaacaaggtcagaaaaaagatcggttttctgtttcaaagtggtgccttatatgattctatgacggtgagacaaaatttagcattcacgttacagcatcataataaaaatctaagcgaaaaagaaatagatgaagccattacagaagcgctaagcaatgtgggccttgaagaagccattgataaaatgccatccgaactttcaggaggaatgcgcaaaagaataggcctcgccagagctctgatcataaaacctgaaattatgatctatgacgaacctaccggaggactggatactattacagccaaagaaattatagagttgatctgcagcattaagcagaagtttaatacgacctctattattataacccatgatttattatgtgcaaagtataccagtgaccggattattgtattgaaagatggaaaagtgaatactgaaggaacttatcaatctattgaaaacagtacagacggttggataaagtcattttttcaaaaataaacagaagaataagtcatgaagaatgaatcatcaaacaatctgaaattagggatctttgttacggcaggaattatcctgtttatagtgaccatttatttcattggtcttaacagaaatatgttcgggtccaattttattttacgttcagagtttgaaaatgtaagcggattaaaacaaggaagtaatgtacggctttccggaatcaatatcggaactgtcagcaggatagactttatttctgattcattggttatggtaaaaatgagtatcaaaaaagatgttcagcaatatattaaaacagatgcagttgccagtatagcctcagacgggttggtaggtgacaaagtccttgttatctctccgggaactggttcttcaacagtagtaagtaataatgctgtaattgcttcatacaaaactacagaaatagaagatgtgcttttcagtatcaagaaaagtgcagacaatatccagactgtctctactgaactggttgatttcacagcaaaaatgaataataaagatggtttattggtaaaaataatgaccaataaagatttcgcaaaccgtatagacaaaacaatacagaatcttcagacaagcatgaatgatatcgctgcattcactcctgttcttcacaataaaaatggtgtaatttataagatatttaccgataaagatctgagtgagaatattggaagcagtattcttgatttaaaaaacagctcaaagcagattagtctttttgctgcgaaactgaatgataagaacaatatactttcccaaatatcctcaaacgacactttagctatttcattggaaaaaacgctgggtaacctggaaaaatcttctgaagaccttaaaaaatttacctcaaaaatcaataatgaggaaaatgtggtttccaaattagttgataatccaggattaggcaggtctgtagactctaccatcaataatatcggtaagggagttgatgagcttagagaattagaggctgcagcaaaaaacaactttttattgagaggttattttaataaaaagaagaaaaacaataaaaattaattatcttagttttcaactatgcgattaaataatatttctacattctccttcataaaaagtcctgttccttcagccattgcagtggcagacccacacgcaattcccatggacaaaacttctttataatccccaccttttacgaggacggaaagcataccggcaaccatactatctcctgcacccaccgtacttttcacattcacagcaggtgcattcatttgaattttttcggttgctgagaataaaacggcttctttctctcccaatgatacgaccacaatctgagcattgccatttgagattataagccgggcagcctgatctatatcttcatcctgcagcctttcttttccgaccaaagaagctaattctcccagattaggttttaataggaaaacgccttcttccacagccatttttaatggttctccagaagtatcaatgattattttacttccgtttgctttacaaatgcggacaatttttttcataaaatccgtatttgtatctggtggaagacttccgctgatcactacaaaatccggagaagaactcattgtattgatgctattcaaaacactctcctgttcttccattgttaacttctctccgggaaagccaaagcgatactgattattattggatgtatccagaacaacgaaattttctcttgtttccccggtaacatataaaggctgtgtattcagattttcctgtgtaagcaaatcttccagtaattttccggttcgtcccccggaagtaaaaaaagtttccgatactattcccaatctttttaatgctctggaaacattgattccgccacctcccgcttcatatttaggagaatggcagcgtaattttttttcaggaattatgttttcaacgctgctacttttgtcaactgacgggtttaaggtaattgttaaaacagattttttcattattcctattgtaaaattaattgtttgatgctattctcaatctctcctattcttttctggtctactgtatcattagctataattataattcctaatttgtcatcaggatataaagtacataaagtgttgaatccgatttttgtattgccatcatggtagatatacttttgctattatcagtattcagcatccagctagtttggtcctataaaattaatgaaaagatgaactattgatatcaacaacttctattatttaatcatttaattctttaaattttatagttttccaattgaaccgaaataagcctatttcattaagttcattgggaataaaaagatctggatctttttaatttgctaaataagagctgatgaatattaattttttacgacctttaaatgaccaaattgggaatattatgataaataaattgttacagacgattgaaaaagcagtcgatgtagatcaggatgaaaaagaactcattgccaggcttttccatgaaaaaaaatatgctaagggagaatattttctgaaggaaggtgatgtatgtcgaaatgttggatttatcataaacggtgtcatgcgatattatattaacgatgatggagaagagaagacttacggctttgccgaagaatccgatttcgtttgcaacaatgaaagttttctgccccagcagccatccaggcaaattatccaggcgttggaagactgtactttactagttatcggatatgatgatcttcaaaaattttatacttccatcaaaagcggtgagcgtttcgggcggcttgttattgaacaggtttttattaagactttacagggactgaattctttctatacagattcacctgagcttcgctatgaaaaatttgtaaaagaatatcctgagttgcttcaacgcattccgcaatattatattgcttcctatgtcggagttaaaccacagtcgctgagccgcatccgaagtagaaatatccgcagaaaatgatttgttaacccaggtgcatgaaagttgaaaaggatgcagataactttgttgtcaacttaaaaaacaaatagtatgacaacaagaatttgttacatcatttcatttttgaccgggataggattgttatttataggtctgagatttttgatttcaccggttaaagccgaattcgattttggtattttcaccaatacccataaagattattccttccactatatcaaagggaccagagatatcttttctggtattctgcttctacttctggtattggcaaagcaaaaaaaggctctgggaatagcacttctctcagcaactgtggtgcccttgggagatttcatgattgtaatgggcaaaaatggaagcgattggcagcatgcgatagctcatttgatcgctatagcaatctgtattattacgggcccggcactgttatggcaaaaatctaaaaagagcagttccggcgaacaaatgtccttcaatttaattcattcagcagctgatggcggacctacagtaacagagtgtgatctgctccctggtgcaaaaactccctggcattaccatactttattttcggaaaagtttgaaattctgaaaggcgaactggaagttggaaaagctggtaaacgttatcaactcaagcccggtgatgagattgttatattggccaacgaaacacatctttttcataacagatccgggagcgtatgtcgcatacggacaaccatagacccgggaaatattccatttgagcaggcttcattaattctattgggtctcgcgaaggatggttttaccaatagcagcggaataccaaaaaggttttcagacttagctttgtttctttatttgaataattccaggatgacaggagtaatgaaaattgcagaaccatttttaagacttgttgcaaaaatcgctatacataaaggccgattgaaggttcttgaagatacttattgtaaaacagccggattatattgaatactccagactatgcctgacaggaaaataaaaaaaggaaaaattaccccaaaaatttaatattaattctatcagagcaaaaacgcgctgtcccgggctgaatatatgtttagacatgaccctgttttttttgaacagaccaatatcattaaccttaataatcaataagttgtttttctcgaatatattcactatcttgtaagtatgaaaaaaaataaaggtcaggatagtataacacacgctggcaaaattaacgaacggacaaaagctttggaagttcttgaacaggctaaaaaagtacaaggaaaaataacatttctccgtcagggagtcgggaggaattttaaaccgaaaaatgaagaataaaacaatattcctgaaagaatgttttgaaaacagcagcaattgctgtaaacaaaaaccctgcaaaataattatttgcagggttttttatatttttgagggtatgctgtattgaatgattaaagatctcagaacagtttcagcctttcatattcagtctttcctcctgcaaatccaatagccgtaagtgtttcctgatgatattttcatccagtaacagttcttcacggtttttagcgataagccagtttctttgggtgtcgagaatatcaatataaatacgtctgtattcctcatagtttagaataatttcggaactgttcagcagattttcatatttctgtaactgatctttcaacgccggaaagctatctattttatcagcatagtcacttttgattttatcaatcgctactttagccagactgttctggatatcgtaatctatctctttcacgcttcttacgaaatcccggtctaccggaggaaattttctcagtaaaaatggaagggtaagtccttgtaaaagcagcgttagcaaaatcacgataaatgtaataaacagaatcatatttctttgcgggaacggagacccatcatctaaagtcaagggaatagaaagcgctgctgccagggaaactactccccgcattccggtccatcctataataagaggagttttccagcctggtgactgaggatcggcaactgtgataaaatttctcataattaaagtcgtcaccaacgcaccgtagcctgctaaaatcctgacaataatcaatactacggtgactgcaattccgtaaccaatggctgtataaatatctgtatcacctaagccagaaacaatttccggcagatccaaaccgataagtataaacactactccattcaagagaaagcaaagactttcccaaactgttaccgtacgtattcgggatgcactgcttaaaaaatcatgactgcgataagaaagaaatagtccgcctgttaccactgccaggactccggaagcatgagcttgttctgctgccaggtacatagaaaacggtgcaataaaggtcagcagaatatctatatttgaatcggttggcaacattttatgcagtttcagaaagatatacgcaataacaagtccgattcctaccccaccgaaacacatccagataaaacttcctgctgcttcatgccacacaaactgcccggtggcagcagcaatcatcgcaaaccggaaaataatcaaagaagaagcatcattcagcaaactttcaccctccaatatggaggccagccttttcggaacttttacaaatttcagaatggctcccgcactcacagcatccggcggcgaaacaatacctcccagcaaaaagccaagagccagagaaaatccgggaataaaataattggcaaatacagctaccgagagcgcagtaaagaaaacgactacgaaagcaaagctgaagataatccggcgccaacgccaaagctctttccatgaggttgaccatgccgcttcatacagtaaaggaggcaaaaaaattacaaataataattcgggttctacttttatgggtggcacacctggaataaaacttattagaagtcctgctaataccaacagaataggatatgcaactttaattttattggccagcatgatgagcatggtaattaagaaaaccaggaagagataaaattcaaagtctttaagcatgtgcaaattttagatatttaaatatattaaattctcaaaaactttattctttttataggaaatttacatcattataaaattgttaatttttctatactcataattcagtagtattaatacttctttctctggcagccactaaaataaaagaatcgtttccatattaaaagccccttttacaattgttgtaaaaacggctttattttcagcttcttcccgggtgaggaattgaaaagttctcttttatatttgttggtaaggtctacggctggccttttccccctgctgctccatagatctgccctgtcacaaaactggcatcatctgctgctaactgaacaaatatagaagccagctctacaggctgtcccggccttccgagaggtgtatcaccaccaaatttcaccagattttcctgagtctgccctccgcttacctgaagaggagtccagacaggcccgggagccacgccgttaacccttatacctttcggtcccagctgcttggcaagagatttcacatagttggttgttgctgccttggtttgcgcataatcataaagatcagcggacggatcataggcttgaatagacgatagcccgataatagaagaacccggtttcatatggggtaaagcagcctttattatccaaaaaggtgcataaatattcgttttcatggtccagtcaaaatcttcagaactaagatccagtatagattcattggctttctgatgtcctgcattattgataagaatatccagccctcccagttgctgtactgcctgactgaccaattttttacagaagtcctcactacgaatatccccaggaatggcaaaccctttacgcccttcctttctgatgagctctaccacctgcttggcatcatcctcttctgcaggcaggtaattaatggctacatctgctccttctcttgcataagcaatggctgcagccctgccaataccggaatcaccgcccgtgatcaatgcttttcttccctccaatcttcctgagcccacatagctcttttctccgtggtccggcaccggtgtcattttacctgccaatccgggaaaaggttgcgactgtttattaaaaggcggtttgggatatttgtttcgagggtcagtgagctctttagcattcgtttttcttgtgttgctactctgtgactgtgccaaagcacctggggcaaccgcagcaacggcaacggttgcggctatttttccaatagcgtctcttcttgttattttactttccatatcaatataaattatttggtgtttaagaattctgtaatgataaaagatcagtacgatccacgatatttaaagcccattgtcttccggatactgaccggcaactgttagggactaaagctaaactgctatctcacttaccaatgatgaataaagatgtaattgatctgacgtaataattataagtgaagtaacgtctgtaaatgtaatggattgaataacaaaagttttatgagacaaatcataaatttatctgcgtttgacaaatatggtgcaaacaatagaacaagtacatcattaaacggtaaaaaaaatataccataacaaaatttctcgctaccttaaaccgtttaactaaatatctgaagattatatatttattagtatgaaaaatcataagttaacagcacttttaattatcataacaatactattttcctgcaaaaatgaaaagaaatcggacattcatccggtttctgataattcaggttttgataacagcaatattgattctactaaaaatccctgtactgattttgatggctttgccaatggaaactggaagaagaaaaacctgcttcctgctactgaaagcagatggggtgccttcgaaattcttgaccgcgacaacaaagtgaaactgaaaaatattgtagacagcataagtaaactgcctgacctcaaaccaggttcagaatctcagcagatagctgatttttacagatcttacatggatactgctactatagaaaagttaggactttcaccacttcaaagctattttgagcgaattgaccatcttaaagattataccgattggataaatttctccggggaacttcaaaagcttggcgtacccactttcatcagttataaggtagaagccgatgctcataataatcagatgaatattctttcgttagggcaaggcggactcactttgggtgataaaagctattatactctaaaagaatctaaaaatgccaacctaaaaaacacaatgatccggcacatcgacaatatgtataaaatggcaggtattaaagagctctcccccggttctaaaatttaccaattggagcaagacgtggccggtttgcagctatccagtctgatgttgcgagatcaggtaaaaacctataataagatgtctgtcccggaacttaaccgcattgcaccacagcttaattggaacgtttttttaaaagcgcagggaattaatacacagactgttattattgaagaccgggcttatatgagcaatttaacagctcttctgcataaaacaccattagctgtattgaaattgtatacccggtggcagcttttatctcattttgcaccttacctgccgcagaaatacagcaaccctcacttcgctttcttcggaacggtaatggctgggaaaaaggaacaaaaaagccgtatagatacagcaattaaagagttagagcaagcactgggcatgcctctgggtaagctttttgttcaaagatattttcttgaacaggataaacaaaagattggtgaaatgattgaaaatgtgcgccgggtttatcatcaacgtatagacagcttacgctggatgagtaacagcaccaaagcttccgcacataaaaaactaagcacaatgactttcaagatcggatatccggacaaatggcccgactattacgggatctccatacaaccatctcgtttgatagacaatgttatttctgtagcagttttccatcataatgaaaatatcaggaaaattgataagccggtagataaaggcgaatggcacgcaacaccgcaaaccgttgatgccttttacgatcaatataccaacagtgcttgtttccctgctggtatcctgcagccacctttttataaccacaaagcagatgatgctataaattatggtgccatcatcgcagcgataggacatgaaataacccatgcttttgatgacagaggttcgaaattcgatgcgtcgggaaatttaaataactggtggacatcaatagacagacataattttgaaaacctcaccaaacaatacattgattattttaaccaaatggagggtcagccagggttacatattaatggagagctcacaataagtgaaaatatagcagatcttggaggacttacactggcttaccatgcacttgaaaaaagttacgataaaaagaagcagccttcccccattaacggtttcacctggcagcaacgtttctttttaggatgggctcaaatgtggcatggcaacatcagtcctgaagctttacgtaatgaactgctgaccaaccctcatgtacctttcagatttaggataaacggcccactggcacaaatgagggaatttaaacaagcatggaattgtgataaaaaaggttcagctaatttgaatggcaaaggaatagaaatttggtaacctccttattccggctgtataattacaaaccgaacgaatttaaattcatttttaatatctgttcgtatacgttgtatagcttcggtgatctcttcagtatcaaggtgttcttccaaatcgatgatcagcatcaatattacctcttccggcgactggtaagtggataatatattttttacttttacgacagcagcatccttttctgcaagtctggtaattttgtctcttgtctcagaagcgattccttctcccataagtaaacttctgctctcccttgctaaaataaaggaaacaaaaaccagtaacaatcctacaattactgacgccaatccatccagttcaggaatttgcatggaatggctgaaccacatcagtatcattactataataagcccggcaaccgcagctccgtcctcgaaaacaacaagaaagctggatggatctttacttttgacaattgcatcccaccatcccatcccattacgggtttggttaaatgcttttattgcaataataaaagaagttccctcaaaaataagtgaaagaaacagcacgatatagttccagaaaggatctttcattatttcaggttccattatgtgtgctactccctgatagattgataatgccccacccaggccaaatattaaaatagaaactacaaaagaccaaaaataaagttccttgccatatccgaacggatgcgattgatctggtgcttttttactcctttttatcccataaagtataagcagttggttagcggtatcaactgttgaatgaattccctcagagatcatggaagaactgtttgtaaagcttccggcaataaactttgtcagcgcaattaacagatttgcagcaagagcactataaatggacttctgattattgttcataaattacttttatagatatgaaaagattttttctaaagcctgctttcgtagtattagcaattgattttcgtattaattgccattggacttgctgcatttgttgttttcatttcacaacaaaatccggcattcttaaaacttaaatttgatctgtattttagttttcctatttgatcatgttacaaaaaccaagccgccggaaataaatgaattgaggatctgacccaacatgaagtgtcggtatttattttgtttacaattccgaaaaccttgcacaaactctaggttttgaacatacagaatgatattttgagctttcagcaaatcatttggatcaatcttcacaacgtcaaaacgctcatcaagaactctgaaaacttcctgttgcaaaaaacatcggattagataattctattaaatcacaatcagatatgtagtagaatatttaatgattatacagcctgagaatctccaccaattcaggtatagaccgtattttaagtttctcaaacaacctgtttttgtatgtactgatcgttgatgaatgaagattcagcagattagaaatttctttaagcggaagaccttctgcaagcttattggcaatttgcaattcgcggtcagatagcgcttcaaggggagaattttttgctgcaccagttaatgattctaaaaaaatcgcatcttttatattatcactgacatatcgccctttattgagcatcgacgttaaagcagtctcaatgacttcagtggagcttagcttgcttaaatagccgccagcgcccattttgagataacgcatcccatataactcttcatcctgtgaagaaaatattaaaatttttaatcccggttggtgaacctttatgtaatctattgcttcctgaacagtaccattaggcatattaacatccataatggccagatccggtttttcattcagaattaatttgtacaacgatttatagtcctctacttctgaaatgatggcagcgggcattaatcgtttgattgtttgtattaaacccatccggacgataccatgatcatctgctactacaatacgaatgtctgcttttaaacccattattctaaaaatttatgtaaaaaaagggaaaccgtagtacctttatcttcatcggaaatgatttggatgtttccatgcagcaaggatataaaattttttacaattttcaaacttaatcccactcctttctcgcctgcagttcccagaaatacagggttaccatacgtgtagatcataggtaagtacttttcatttattcctgttccagaatcaattacagaaagcacaacctgatcaccctccgtaattacctgtaaacaaagctcctgcccaggaaaagaatattttaccgcattgttaaaaatcttgtccagaacatattcaagcaacagtcggtcacttgtgaggaaggcattgtggtctcctttaaaataaaattgaatgtttttttcttttaatttaacagcgtatttttcttctaaatagtgaaaaagatccatcaccataatggtaacgggtttaatcttaaattccccgtattgcgttttcagccatgcaacgctgtcctggatagtttgcagattcttgtgggcatctttttttatctgcggcaacagcttaaaaaaatcttcctcacttatggtcttctgctctagttcttctataagccacagaaaagttccaaacagttcttttgagtcatgagacaatatcgaaatcagtccgttcttgaaattgatctcattttccagtctttcaatttttaattgtagttcattgataaaatcattcataaaatccgtttcaaaggttttagaagctgtttgaaattatttttttttgaaaaaagtcagaaagggttatattgtttaaatgtgaataaaaacatatcgttcagacctttcttccgggaactgccaagttataaaaaatatcatattagtaaaaagaaaaatcaaatagaatttacctgaaataacaattctcctacttttttcaactaaaaatgaatttgtacggcataatattccaacaggctttcacgctgaaaaacggtcacttgcattacgaaaaatggctaaaaggtgaaacagggacaatatcaacagaatattgatcgtaaaaatccgaatgatacagaataaaaaataacaagctaaaacagcaatacctgatagacaaactacccaaaacacctctacagatattgccaatatagaggttgatagaacaaaaatcatcaaaggaagaaacgtttgtatatagaaatacgtcaggaatcctctggaaagttctgtagcttcagccaattgctatgacggaatcacagctataaaaagaaagtaaaagctatttcagaaggcatcgttaaattgtcgtaaagctataatacacattgacagagtaagtggtattctccttccctaccaaactttgggcgcccgccggtggtatggtgtatcttatgttcagtccccggtccagaaccggtgctccgttaaaaagtattttttgaggagttttggataagggcacctttacagaacctccatccactccaatttgtaaaatgttcgaattgatatcggtctgcaggccgcctttcttaaaataattttcgtccgattttacatagagctcaaaattttcattgttggaaagcataatctggttgggaatcatttgtgattgtccatcggtatattgggctgcggtattaaaattgaagttgacagtgcgtccggaacttggaatggtaatctccgacagaggaagcaccttcaactgcacagctgtattctgcaaactgttaatagagttatctgtacttcctgcattgaagttcaattcaaaagtataagttccggcttcaaaaaaaaagtttttaaaatcttctgcagatacataaagctgcggaatgaagctgtttctgtttcctgctgtaacactgaaattagcagcagaaaaattctgaaaatcggcagataaagctttggttgtgaatgcagatccattactacccagtttaatacttgctatatttctggtccctggaacacctttagaggaagtgaactgaatgtttgcggaagcagctttggctaaaaaattaaaatcaaccgtattcgcaatttctgtattccccaaatcccacaccttcatgtttgcattgcggtagtcattcaaagaagatatctctatgtattttgttaaagagcttgtaatccatcgtatggatgaaggaatcactaaaattgttttaaaattacgaggagtgaaatcattataattctgagtaatatccatagagtaattcccggcccggaaggcattggcagtaaattgtgcagcaggaattttaaatgtaaaattgatatttccgcggttgaatcctcccccgatactgatggatggcggttcaaaccattttatagcgcttgtactgaatgattgaaaacctggcaaatacccggaaagtccggtagatggcagctgcccgcccatactttccaactgccacaaaagagtggatccgggtaaagtagatgaggaagaagaatgagtaaaagttgatccggaaacagaggtaaatgtaggagctgtgggcagtaatcccaaaaaggcataatcccagtttgttctgttggcattcgtcattacccttgtaggtactgaggtaaattcgctcctgttaaaaatattattttcaggaacagacaggtacacatcctgagctttcatgaatgcagacccgcagaacacggtaaaaattcctattagaaaaaacctcttctttttcatacttttaaatttaaaactttttcaccttaatggtggtgtctttcttcttatattcaaaaaccacgctttttgagtaaccttcttttgtcacctgaatagtttggctcggctgtgtatagctgtatttatcattttcaatatagaggttatactttccggctttcagaaaaaattcaaactcattcttctggttaaccacggcggtatagattgtgccatcttcactttttgcatatactactattcctgttacatccgtctccaaaacatcataagcttgtttgatctctgttaattttccgcttaccctgatgtttttcaccaagcctactttgcggttaatattgttatggaccataatgacaggatccatcatcaaccgggcacccgcactttcattcaccttcagagtgtaattaccttcaggcacattctgaaaaaccactttcccattcttatccgtcatcgctacataattgtccagttttataatttcgttagcaagtaccggttcaccggactccagaagtccatcagaatttttatcttcaaagaactggaacgtcactttatgatttccgaaagctgtagccggggtaaaatattttttaattcccactctgaactggtaataactgccactgattgaatattcagctgtagatttatagccagaaagattaaaataacctgttgtggaccaggaaggtgaaaccttatactccagattaccggtgatattactgttcaaatttttataaagttccgaatagaaggttcccgctgaaaaagatcctgtaagattatgattaaacatctggaaattataagaagcgtatacattgtaattagcgaaattacggcttacatcataataagaatttaaatcaaagacactggttgcattccattgggctgttccgttgagagagaatgacttatatctgtaagataaagtagttttcagactgttgaaccagtccgggttattattctctttagaataagaatattccgctgtcaggttgaatccatgggcacctaaagtagtgctgatattggcttccaacctgtaagagaaaagttcctgtgaggtataaaaattagctgttttttgtttctcaacttttggagacagtagaaaattccatttctttaaagaaaactgataccctagtcccaaagcttctgtactgtttaaataatagcgcaaatcagcagtattcccagattggacaggggcaccctgatagctcaggaattcaggatttacctgcgaattctggtattgtataaaagcccgctgagaggcagaaaactgacgaccaatacgctgatttgagaaaaacgatccccgtttgatccctgcataacttttggtggcaaaggaattaacagattgtagatcccattttcctattttcccttcgtaattggctcccattgaagccccggcgttttcatcatgattcaaaagtcctttttcgtgacttacacccaactccgtgcggattgcgtttttatcgttaattaacaatgatgtaactgcgttcgctatctgtgtatctacattaaaccgcggatcatgttcaaatatataggatactttcccgttgaaagattttacattgccaaaagaatattttgcacccgccatggtagatccttctgtttgctggaaatatgtaccatacagattataattattttccagcgcaagaatttcaacctgattattatttccgaatctggcagaaattttcccacctcttccgaaaaccgggtaatcgtaatcgctgctattaacatttcccacccgtaatactgtattttttctctccagctccagccatgtgtcatataagttataaagaccatcttcatgatagtaatctgcaccaatattgaagcgtgatttcaggttatcagttacccggaacgctgtatttcctctcaattgaagataattgaaacctgagctgttttcattatagctcatttcagcaaaattacttccgctcaccgcttcgtttccacgggcaatttgtctgttatgtgataaaacgaccaggtaaagcgtgttgctacccacgattttattatccagcaggtctgtgacgatcgcattaatattaaattccggataaagtgtattctgttttctgaccgcaattttgatttccaacgtttgtttttctaaaccttccagagatacagtctgttgttttggcattacttccaaaccatccggaatggattgcaaatcaatcttaacggtacgtttactgtaaccctggttttctacggtaagcagaattgaggactgtggtaaagcggggtcaatgaaattttcgtatgtcgctgtataaattgcgatgtttttgttgtctcctttagcaacgaagaacgaggcgttttcagttctggttacggttggggtaacgtaagaaacctggaattggatcttattggatttcagtttcataaaatccacgttggcaatcagttttaccggaagagttttagactgacccgcacctaaggttaattcatttttgggatagaaaagcaatcccggatagttttcctgaggtatgatattctgaatggtaatctcttcagaacttttattctcaacgaccaggaaattagtaaacgtagaacctttttcaacagttacgctgtcattttcaaaatggatgctgatattcttattttcctgcgcaaaggccaacgaaaagtgcagaagaacaaatacaaaaaataagattgttcttcttagcactgatatcgatattccattctgtggtttcaaggcttaattttaaaatttaaagtttttttctcctacacgtaaatcattggattctgccattttaacaatagccacacccaggaagtttcctgaaatattctctggtaaagaaaattgaacaacctgattggtatccggaaacatagagattgaaattgcgggtaattttatttccttaccactgtctgtgttggtaagttcaaactcaacagtggcatcattaatcgtatttccatcattatggatgcttactgcgacttttctgttcgctgcattctgattactcacctctgcaatattggtaatatccagacttttcacatggttccccggtggagtgtaaaagatatgaagtcccacttcaaataaggtgataataccaattccattctgaacacgtgccttatctgcctgctgaggaagctgggtgaaaaacagcatgctgtttgtaacggcagatggtgatgcatttgcaggaatctgcatggttactgcaatctcctttatactttttgcaggaacagttacagtattttctaaagtggatacccaggaagcattggaagtttttgaactgcctgcctcaagataaaccttatttccgtcttcttctctataccagtctttatagttgagattaaaaacataatccttatctgagctgttttgaagcgtgactgtctttgttactttttctcccggattacctgtaaaaaacaagcgtgtaggcgacatagagatgctttgtgccagaagtgaagaagatcctgtgagaataaagaaaatgaaaaggtgaataaacttgtgcatggtgtaaatagtttaataataaagattcccaaaactactgaaaacattgcaaaaggaacctttacaaactaaaaattttattataaagccgtcgcggtataagttactgtctgcgtatacgttccggccggttttcctaaaatatcagatgatgatgatttcgccgctggaatagtatagtctaaattcagtgttaatgcacttcctagcggagcattggataccaaagtctgatctgttgcagatagcactacagcagtttttgttccccccatacttccggcagcagtagaaggtttgattgttaaaacattcacaggaatcaggttcgttccattcataaaattagcacctcctgcttttacctttacattaaagttctttgtagaagtaacttttaaagagttggctttagtaactgtttggtcagaattataatctgctgcagtaacgtagttaaagtcaactgtattacctattgcagtacttcctgcatcgatagagattacatcattcagggtgatgtttaccgttgtggttgcagtggtattttgagcttgaacattattagttccaaatataattgctccaaaagttaaggctgtgattacgatttgttttttcatgatggtaatattttattgttatttttatttaattgttctcttttgtatactgcaaatttatagtggcgataaaagtttctttgtagtggaaaaaggaagttcatgtagtaaaatcactacaggattgctcattggctttacatagaaaaaaccctcagcacttccaggtactgagggcagatatattgatgtgttttttttattataaagcagtggcagtataagttactgtttgtgtatacgttccggccggctttcctaaaatatcagaggatgatgatctcgctgctggaatagtgtagtctaaattgagtgttaaggcacttccaagaggagcattggctaccaaggttctttctcctggggataaaaccacttcgtttttggttccgcccatacttccaggagcttctgcagctttgattgtcaaaacatctacagggattgagtttgaaccattgatgaaattcggaccacctgcttttactttcacattaaagttctttgtggaagtaacttttaaagagttggctttagtaaccgtttgatcagaattatagtctgcggctgtaacatagttaaaggcaactgtaccaccaattgcagtacttcctgcgtcgatagatattacatcattcagggtaatatttacgtttgtggttgcggttgtattttgggctttaacattattggttcctactatgattgctccaatagttaaggctgagattgcgatttgttttatcatgatagtactatttaattgttattctatttaatgttctcttttgaacattacaaatctacagctactacaaagccgtcgcggtataagttactgtttgtgtatacgttccggctggcttacctaaaatatcagatgatgatgatttcgctgctggaatagtatagtctaaattcaatgttaatgcacttcctagcggagcattcgatactaaagtctgatctgttgcagataacactacagcggtctttgttccacccatacttccggcagcagtagaaggtttgattgttaaaacattcacaggaatcaggttggttccattcatgaaattagcacctcctgcttttacctttacattaaagttctttgtagaagtaacttttaaagagttggctttagtaactgtttggtcagaattataatctgctgcagtaacatagttaaagtcaactgtattacctattgctgtacttcctgcgtcaatagagattacatcgttcagggtaatgtttaccgttgtggttgcagtggtattttgagcttgaacattattagttccaaatataattgctccaaaagttaaggctgagattaagatttgctttgtcatggctgtaatatttaattgttatttttattttatttaattgttccttttgaacactacaaatctacagcggtgataaaagtttctttgtagtggaaaaaggaagttcatgtagtaaaatcactacaggattgctcattggctttacatagaaaaaccctcagtactttggaagtactgagggcttatataaattcctgttataatatagattctacatcacagctgacagatacctattcccggattttgaatttctctataacgatatcaatacataaaaatcaaaggcctcccgtagaaagccttcgaaacaccaaatcacaaaatattaatatgaaaaatttatttataaagctgttgcagtataagttactgtctgcgtatacgttccggctggcttacctaaaatatcagatgatgatgattttgctgctggaatagtgtaatctaaattcaatgttaatgcacttcctagcggagcattggataccaaagtctgatctgttgcagataatactacagcagtttttgttcctcccatacttccggcagccgtagaaggtttgattgttaaaacattcacaggaatcaggttggttccattcataaaattagcacctcctgcttttacctttacattaaagttctttgtagaagtaacttttaaagagttggctttagtaactgtttggtcagaattataatctgctgcagtaacgtagttaaagtcaactgtattacctattgcagtacttcctgcatcaatagagattacatcattcagggtgatgtttaccgttgtggttgcagtggtattttgagcttgaacattattagttccaaatataattgctccaatagttaaggctgtgattacgatttgttttttcatgatggtaatattttattgttatttttatttaattgttcttttgtatactgcaaatttatagtagcgctaaaagtttctttgtagtggaaaaaggaagttcatgtagtaaaatcactacaggattgctcattggctttacatagaaaaaccctcagtacctgaaagtactgagagcttatataaattcctgttataatatagattctacatcacagctgacagatacgtattcccggattttgaatttctctataacgatatcaatacataaaaatcaaaggcctcccgtaggaagccttcgaaacaccaaatcacaaaatattaatatgaaaatttatttataaagctgttgcagtataagttactgtctgcgtataagttccggctggcttacctaaaatatcagatgatgatgatttcgctgctggaatagtatagtctaaattcagtgttaaggcacttcctagcggagcattagatactaaagtctgatctgttgcagataatactacagcagtttttgttcctcccatacttcctgcagcggtagaaggtttgattgttaaaacattcacaggaatcaggttggttccattcatgaaattagcacctcctgcttttacctttacattaaagttctttgtagaagtaacttttaaagaattggctttagtaactgtttggtcagaattatagtctgctgcagtaacatagttaaaatcaactgtattacctattgcagtacttcctgcgtcaatagagattacatcgttcagggtaatgtttaccgttgtggttgcagtgatattttgagcttgaacattattagttccaaatataattgctccaaaagttaaggctgagattaagatttgctttgtcatggctgtaatatttaattgttatttttattttatttaattgttccttttgaacactacaaatctacagcggtgataaaagtttctttgtagtggaaaaaggaagttcatgtagtaaaatcactacacggttggttcatctgatttaaaaagaaaagccctcagtactgtggaagtactgagggcttatatacaattgcttttcgttttattataaagcagtcgcggtatacgttattttttgagtgtaagttccctgcggttttccaagaagtaccttggatgctttttccgccgaaatagaataggcaatatttaaagactgtttggagcctaaacttgcattactcaccagcacctggtccattgtagataaagtgacctcattcagagttcctataagacttcctcctggtaatgcttttacctgcaatacatctacaggaattaaatttgctccacttacgaagtgtgcaccttcagattttactttaacatcaaaatttttggaggaaataatgactaaactattgggaacggttatatttttagaagaattataatcttttgtgctcccatagttaaaatctacagcaccttctgaagcaacagagccaatatccattgcaataacatccgataaaataatattgaccgttgtactcaactgctccgaattttgtgccttaacccatttggttcccagggcgattgctcccagagacagggcagcgataaagatttggtttttcatgattaataaattttaaaaaggtgtaataaaatattgtcactcaggaactcattataaagctaataacattatctgacattagcaagacttttttcatcattgcgtgtattatcatcataaagtttaaagttaattaaccagattgccattatcaggatgtttaagggaattgttaatgcccggaaactttacttaaaaatctattttggctatggatctggtactgtagtaaatgcaaaatagaaatattatgtactcatttgctgattttgaagaattatgagatttctttatctttgaaaagaatataattacaaggatcaaatattatttcctgccagataagtaacaaaagactgtgacgaaaacatggtggttgttcttcaagatggaaatatggataatatacattaacttaataagtcctgcaatttttagaatattgcaggatttttttgtctttcaattgcagattgttcaaataaatttgtaagaattttgattaattgtgataatatttttaactaaaattacaatacatgcagctttatacagaaagattacttctgagagatattactattgatgataaacatgacattttcgattaccgttcggatgcagaagccaataaatttcaaagctggattcctgaaaccctggaagatgtggaaagttttatccaaagaaacagtacagagttcaatcagcccgaaagctggtaccaactgttaattacggataaagaaacaaaaacagttatcggagatatcggaattcatttcttcggacatgaaaatgtacagacggaattaggaattactttaaatacggctttccaaggcaaaggctacgcctccgaagctttaaaaggtattatcgatttcctttttaatgatttgcataagcacagaattactgcttctgtagatcctggtaatacagtttctattcatttactggaaagaatcgggctgagaaaagaggggcattttgtgaaaagtctcttttggaaaaacaattgggtggatgatgttatttatgctgttctacgtgaagagtggcccgcaaaatagatagcatatttcgatctcaagagcgacttttttagtaaccggcattaaaaaaacaaaaataaaacctcctgaatgatcaggaggtgaaaaagtgtaaaatgaattataagttatgtgaagtggtgtccgttaaagcttttctcaacacatcaacgagcatgccaaattactcacttgatattgaataatatatttttgtggtacttttttacgaaaaaccttacagataaaaatcaatgagtgcaaacaggcaattactagagtactgtatatctttcgtaaaacggagtgatttttgtctttacaatcactaaagtaaccatatcattgcatatcatatatgatacaaccattgttctgcaccacttcttagtgataacagtaatccagccatccttttcttcccattggtacatttcttttttaaaatgcataataacataatccctattcttaccgtttaacgaaaataagtcttgcataatctctgataatttattttaacaagcttttatgacagcgcgttccatggattagttttattattccaaatatagtgaaatagttgaaattatactatacagttgtttgattttaataattttaacagtaattttagaatattcctgtaaattataaagagatgaaattacggatcactatctttaatgaaaaatcacctctctttccgattactttagaagacgcacgatttattgaggaggtacccggctgaaacagatttcaaatcagagttttattcatcatgcttccctgaattttaaaggaattgtaccacaaaaatatctaaaagcaaattcaatcgtattaaatctatattaactttatcccaaaaataaggctaactttaatagtgagtatcaactttagccctcataactttctgccattctatataaccggagatggccactatgaataaaaatgaggttaaaacagcatatagatataattctttatgcagtaacagagggatagaaattatattgctgatattgaggattacccagttctcaatttttcttcttgccataagccacatgccagcccatgcaaaagcgcttaccagagaatcccagacaggaacatccgagtcggtaaaatgagtgagaaaagaccagaacaaaatgaatgttcccagaacaattcctcccgcaatccatttttctgtcgtggaagtaactgagatttccatttcagatttctgctttccgaatttccagtaaagccatccatagatgctcatgatcagataatagaggtttaatataaattcagcataaagcctggaagtcagcatcacatatagtgtaagcagaatgcctgcaattccgaaaagataattattagaattgtttttacgggccagtaagacctgaattaccgaaaataaaaccccgaaccattcaggccaggtaatttgatttaaaatgtcctgcatcatgttaattttggaaatcaaatgatgagatgatcagtaagcaatccctacgccggcattatccggatcaggtgtggaatatatcctgggtatcatctcagccaccgttaatttgtagcaccccattgttgaagcaaagttgctgttttttttcggaaaaagaaaatacatcatactttattttagaattatatgaccaggattataaagaatccgtcaggcaaattataattttatgcttagtctaaaaaaaatatattatgaaaaatcaggaagaaatcgcagtattaaatgacctacttcacattaccaacgacagaagggaaggctttgaaaaagttgaaggaaaagtatgggaaatgtatcccgatgtaaaagatgagtatgaccatatgatttcacaatcgaaaattatgaaaaatgaactgattaacctcatcacagaaaaacatggtgttcctgatgactccacttctatggccggagctcttcacagaacatggattgatattaaaagttcatttaccatgggaaacctggtagagtctacactggaaaacgttgtttttggagaaaaagcagctatagaaacttatgaaaatgccctgattagcgggaacctcagtgaaaaaagtaataaaatagtatccgaacagcttcgcagcctgaaaaattcgtataaccagttcaggaaaattgaagaatataaaaagaaagagtaaatccataaaaaaacccctcttaaaaaagaggagcttattaatcaagaacaaaataatatttaatcctttcaaaaatatcaaatatatggtgctctttttatgatgcaggtcataagatctgcaaatcattatttcactgcattttttgctttttcagattcgtgcaaatgatgttctaatgtaggaagggtcttgccggcaaacgctttaagagaagcgtcttttccttctgaggattctttccggaatgcttcaatatcttctttgtgatcactcaccataagatctgtatactttttgtcaaagtcttttccttttttggctttcagatcatcatacatcttctgcttttcggcatccaaggctgcaggcaaggtatagccagctcctgaagcccatttcttaagttcgtcatttgctttgctatgatctgtaaccatcattgcacccagggatttcacaactgaattctctgcattggttgcggccagttttcccatcatcacttccataagtcctcctatggctgcggcatctgcaaattttttgtcctgatcattcagagtaccggtgtcgttctttgtttcaggcattttagtggagtcagttacggtcgtacctgattctgcaggagcagacattgatgtactttcatgcgattgggtacttgatgtcgattcgttttttttgcaggccatcaaagcagcagctgcaaaaattgttactacaaaatttttcataataataaattttaaatggtgttatcaataaagtctgtaatgacttatttatacaagcaacaatttatctgccaaaaaaagaacaaaccttaccataaaactttatgaatgaatattttaagactgattaaccaatcgaaatgtcagattaatacgctctttcatagcagttacagatttagcaatacggtgctcccaatgctcctgcaaatctcctttcataatcaataatgaaccatgaggaagcgggagactgtatttactctgatgatggtctttttttctgaaatcaaaatttctggtctgtcccaagctcaccgatgcaatcacgggacgtttgccatatctgctttctttgtccctgtgccaggcaacagaatcattatgatccctgtacaagttgagcaatacggaattgaactgatacccgaatgtctcttctattttttgtttcaaagaaaacagctcaggtgtccagtaacaggtttccagttcaccgttccccgaaggatagactgtctcatcatctccataccatgcggttaaccgcggcgttaagacagtcttatcgtacattttctgggttctttgtttccaggaaaccgtttcaagcagatgagccctaagctggtcagcttcttccctgctcaggaaatgctctctgtactccagaagatctttcggaaattcgtacagatcttctgtattaaataaactaagctgctccattgttgttactattttcagtcaaaacatataatcctttccacatatcgatacaaaatatatctgcaaatatattaaacatgatacataaatgaacattattcttttcacaaaaatctgaacaatttgttttcagcatttgttactatgtgattcacatcataaatatttctctttttgatcattaagtttgatataaccaaattgattattatgaaaaaagcagcattatatatgttattattgctcatgctgtcagcatgtacaaaatccgaaactcaatataccgatcaaaataacagaaaagaaacggtaaatgacaaggcttcagatacgatccaaacccttaccgagctttcagacaccttgcagcaggaaaacgacagtataaaagtaagaaccggcaatgaataaggatcattatcctgtgaatccaaaaggcaggctcatcattattggagacagcactccctatacttgtctggaagtggaacaggcaccggatattaatcaaattccttctcagttgttcaaattattatcagaacataagaacatccgtattgaaattatcatttcagattccatgcctggatatacagaaaagtattctgctgtattacagaaatatggatatataaacttagggattattcatgttcatcaggaaagtaattttaatgattattatgccagaatctcgcagtccggaatagtttttatcgcgaatgagaatccggaaatttgtgaaatgctgaaaaaatctgaaatactaaagcttttacataagaagtacattcatgaagaagattttacaattatcggaatgaatgccgcttcaatgtatattcctaaaattttggtgaacgaaaaaggaattcatcaaggtttcggatttatcaataactgtatcattgatacaaaatttgagtgcggaacaagatttaaaaagctgatcagagccattatgcttcatcctgaatgtcttggcattggccttaataacggtatgttgatggttattgagaaaggctacaaagcttcctgctacggcagcagtacagtaatggcagtcgatgccaggcatattaagaaaagcaaagcaggaaaaggaactactgtttttataaaaaatctcaggggacatattcttaccgaaggatcaggtattaatgtatgtaccggagatcttattaaagataatcagtttcataacagtttaaattttacccgtagaaatacaattcaatgattttaaccttaaataaatttacatatgatacccaaaggaaaattacttattatcggcggtaaggaagacagagacggcgatgaacctgatatggaagaaaaaaacaataatttttcacccaacgagattcttaaactgctggtaacctctaaagatgaccgtattgaagtaattacaacagcaacttccgaacctgaagaaatgcaggaaacttacaccagaacatttgaagaaatcggatataccaactttggctttctggatatttgtgacgatcaggtacatacagatttttacctgaaaagaatagaagaagcaaaaacgatattctttacaggcggtgaccaggataagatctgcagatttttgcagccctctgtttttacggatattttgaagaaaaaatataatgaagaagaaggctttatgattgcgggcaccagcgcaggagcaatgtgtatgcctaaaatagttattctcgaagcagtaaacggagaagcaatcctcgaacatgacattgagctggattccggattgggattcattgaaaactgtattatagatacccattttgcacaccgtgcaaggttcggaaggcttgcacatgctgtgattttacatcaggaatgctggggaatcggccttggagaagatactgcgcttcttattgaggaaggacataaagctacctgcagaggatcgggttctgtatggatcatcaatgctaaggaaatcagacagacaaatactgaaactgctaaaaaaggatttcccgtttatgtagaaaatctaaaggttcatattctaacagacaactgtaaaattgatcttatgaataatatatttgaaggagcaggcacaggagaccaataagacgaaaaaggagacccgaataaaaaccaggtctccttttttataaagattgtatgtttacattgctttgctgttaagattggtatcagcaacttttgtaagcagttcatcacattttttttcttcttccaatgtgcttaaaaagtttttaagacactcttcttccttcaatacttttgcgaatgctgccagtgtaccatacgtagcaatttcataatgttcaactttttgtgcagctgcaatgattcctgcatctcttactgcacctggttctgtctcttccatgatgcttttcccttcatccagcaatccctgcatggcatcacacttttttgcctgggcttttttacccaatgctttaaaacattcctccaatctttccacatgaccttctgtttcggtgatatgcttgtcaatgccttttttaagtttttcatcggtagcattcttcatcattaccggcagcgctttcaacagtgctttttcagcccagtaaatgtctttcagtgcatcttcaaaaagatcttccaggctcttggctgcattttttttagccggcgttttggctgttgttgtttttttggctggtgcttttttggttgccgttttagtttccataatataatattttagtgtttgattggtgataaatctgcaactataagaccatttttgcctgaaatacgaagatgtggtatctaaaacttccggagatactattgcaatatataataagaacagctgtatgcagagaataagaagcctgcaaatccgtaaaccattacggtgtttgcttttttacccatacacttaccgaaccggaatttacccggaatacagcttttccgttctgatcagcagcaatttcttcgtggcggttcttcaagaaatcaatatagactgaatctgcatgttcttttcccaattctatttctttatagccttcttcactgttggacatgatcacaacacagcccggatgcttttcatctcctgtccgaacaaaagctatgcagttgggatgatcaaaataatcaatctgattaccgtatgcaaaaagctttcttgcttcaaggagtccgggaagttcttctaccttcggcatgatgatatgtacttcctgatcttcttttatatcaatatattctgcaccaaaaaggtcaggataaaatacacagggataagcctcatcagtaaggagaataatagcataagccaaaggcttgaaccaatctttcaccgcagactcaagagcctgaagctgctgcgtatcatgattttccacaaaggaaaccgagaagacgggtttcttttccagaaaacttccttttaatattccactcagatcataatttttaccttcgtctgaggctctgaagaaattataatgcagcggcgcatcaaaacaggaaatgagaccagtcatctgatcagaaaaatattcaattttctcggcttcgtctttccagaattctcccagaatataacattcagggttaatttctgtctttatgtattgagtccagtctttcaggaagtctgaagaaatgtgttttaaagcatccaggcgtatcccgtcaacctttgtggtttccatataccatctgatccagtttttcatttcctgcacaacataaggattacggtattctatatcagctcccatcaaataatcataattaccgaactggtggcttacggcatccgtccactcctcaccatattcattgtggattttaaaaacacccttcagctcctctccttctctgatcacataatcaataccactgaaacagtgataatcccatataaagtccgaatacactccttttcttcccggaaaagtaaatttcgtataggccgaaacctccatattttctgagattctttcattacggttttcttcattcagctgatgcaccaccagcttttcttcttcatctcctcctatcctatggtttaaaacaatatctgcgtacacagacattcccgcgtcatgcgctttctctatagccattaaatattcagctttcgtcccgtaacgagtgggtatacttcctttctgatcaaactctccaagatcataaagatcatatacatcatagccacgcccttccatattgagactgcatttattggctggaggaaaccagacggcagtaaaccccagttcttttaaatattctgctttttcagtaaactcattccaaaggtttcccggatggtaccaatggaaaaactgaatcataaccccgttcatatattatgattaaccgttaacaatcaagccgccattcgggtgaagaacctgcccggtaaactgtgcggaggcctctgtagcaagaaataaaaagcttgctgccacttcttcagtagaggcattacgttctaacggcggtttatcctgatcctcatcctcttcgccgaatgttttttccgtaagcggtgtggctacaggcccgggtgctacggcattcacgcgtattcctttcggtttagcctgaagtgcgagtgagcgagtgaacgaaacaatggctcctttagtggctgagtaatccagtagttcttcatgtcccatataagcagtggcagaggttgtattaataataactccacctttttttaaatagggaaatacaaattttgtcagcaggatcattcctataatgtttgaatcaaaagtctttctgatatcttcttctttaaggtcctctatcgcattgcacggaatctgtgtaccggcattattaatgaggatatctattccaccgaatttggaaacgacctcatcaacaacagttttacagaatgtactgtcattaatgtctccttcaaatgagagaactttgtgtcccagtttttcaatttcctgacttgttttctgagcatctttggcgtcatggtagtgtataaatgcaatatcagctccttctttggcaaataaaagagcgatggctttaccgattccgctgtctgctcctgtaataaggacagatttatttttcagttgtaaatctttcataagtgtgattatagtatattattgaaataggtttattctttgttttcatgacgtttatcgagttccagcttaaagcatcccagaatgaattcactgtaataaagctgagcattaacagactttgttctggaatgcagatctaatttttcagaaagaacaacctttcctttataagcaatggcgaagtaagcgaaaagctttccatgtgattcttccaccggagtagcatatcccgttactccgatagaccaatctgttttgtatattttacctgcctgtaatgccatgatctcagcaatatgaggagatacactgttatattgcatggcttcagcagcatctacatcaagaagatttactttttcttctaaagtatacgcggtcattccccctttaaagaattgagaagcatctttcatctgggaaaacgaaaactgcaggaagccagcagtaacactttcggctgttgaaacagtttcatgccccgaaagcagatattctcctatacgcttaaacagcttttccagttctataacgaaatgcactaaggatttcactgataatgaatcagcgtgagcaatttgtgaagattttaaaatcattgattatattttatatatcaggacttcccaactattcctctttcgcagaatccctggaatcttgttgttctttggactgcttgctaagcttctcataatatttgtggagtttgtccagctcttcttccgtgagatcttcaatatcaaccaaccggttgctggctttttcataggatgcaatcagttcattaagctttatctgaatcgccttggaatctttgttctgagttttttgaatcagaaataccatcagaaaagttacaattgtggtacctgtattgataacaagctgccaggtttcagaataattgaaaagaggtccacttacagcccagacaataaccagtaaacttgctgtaataaaagcacctggacttccggttatacaaacaacacgatccgaaaacctttcaaaaaaattttttttcataaataatacgatttgaataaaatgatgatacaagttatcgaaacaacagtataataattatgattcaagtcatctacggcttttattacttagctattattataatatattttccaacaatatttggttttatttaaaaatgtgaagaatcgcataattatttttatccgttaaaaacaagcggtttttgtcatcatttcctgtcttaacaaattgtaaacgaaagaggtaaaacaattaacatattcaaaaaagtgagcaatacagcatgattcaaaaactgaataaaatcacttcgttaagatttaatacttaattaaaaaataattattcatctttgcagccttaaaatcaaacacgctagtttatttcatgagcattatttttaaaaagcgtctaattatagcgcttgtattacctacggcggccttgtattacgggcagagtacgaaggattcattagaaaaatccaaatctattgatgaggtgatgttggtgggtagaaacctttcccaaacagccaaagagagaaaaactcctgttgcagtttccaacatcaaggcagcagaaattcaggagaaactgggaaacagagaattccctgagattatgaagtctactccatccgtttacgtcactaaagtaggtggaggattcggagacagcagaatcaacatgagaggttttgatggtgccaacattgcggtgattatcaacggacagccggtgaatgacatgcagggaggtactgtgtattggtctaactggacgggattggcagatattgccagcaatattcagatccagagaggtttgggagcttctaaatttgtagttccgtctgtaggaggaacgatcaatattgtaacaaaagctaccgatgccgagcaaaaagcaatgatcaaaggtgaagttggaaatgacaactactccagaatttctgcgatgtattcttcaggattaaaaaacaaatggggaacaaccgtattgctttcccgctggcaaggtgacggatacatcaacggaacgaaaggagaaggttactcatggtttttctcaacaggatttaagcctaatgaaaaacatgctttcaatttaatcgcaaccggggcaccacaggtacacgacacaagaagatcttctgccaccggagcaaacgtagcaacactgcagcagtttgaaacctatggaagaagatacaacccgcaaacagggatgttaaacggttctcaattcaacctagctcctaacttctaccataagcctatcgcatctttgaactgggactggacaatgaatgataatcttaagttatctacagttgtttatggttcttggggacgtggcggtggaggtaccggacttaacggttctatcaagaacgccagcggacaaaccatgaatttcatgaattatggtcctggcggagatggtacgatcaactgggatatgatttaccgttacaacagaggtggtatggtaactgattataatggaaataccttccagaagtctacctttactgcacctgcaggttctcccggtgattacaacggacaatatgtttctactctgaacggaaccagcggtatcgtaagaaagcagagtatcaatgctcatgactggtatggagtgattgctgaccttaattacaaaaaaaataactggactttcaacggaggtattgatcttaagacctataaaggcgcactgtacgatattgtaacagatatgttaggatctgatgcgttatttgttccttccaccgccaatgctccgaaaggatattacattaatcaaactgtaaagccggagccgcttaccaagcttaaagatgctcagaaagtatctatccacaacgaaggtctggtaaaatgggcaggtatttacggaatggttgaatacagctctgaaaagctgagtgcatctgttcagggatccgtttccgagcaatattataagagaagagattatatgctgtatactcctggaaaccaggaaacaaaatggtaccacaaaacgggttatattgtaaaaggaggtgccaactataatattgacgatcaccacaatgtatttttcaatacaggggttatctcaagacagccgttattcaacgcgttattcccttcaaaccagaacatctacaatgatgcgaagaatgaaagaatcttttctgtagaattaggttacggtttcaaatcccgttatgtggatgtgaacatcaacgcttacagaacgcaatgggatgacagattcatttcaagaacattcaatgctactgctgcagatgttgccaaattctctcagttaacccttggaaatgcttacttctataatgcattgaacgtaggacaattacaccagggaatcgaattggaagcaaaagcaagacctttcactaatcttagattaagaggaatggtatcattggggaactggaagtataaaggaaacgccaacttcaacattcttgatgttcagaacaaccaggaaattgcaggagcaaccggaacgatcaatatcaaagacctgaaggttggggacgcagctcaaacaacagccagcatcggagctgattataatattaccaaagctttcagtattgatgccaactgggaatattatgacaagctttatgcacagttcaacccgatcaatttccttacggaagccgcaagagaaaaaggaattgtaaagttaccaagctatcatttatttgatgtaggagcttcttacaaattcaccttggatgcgaaaaaatctttaacattgagagcgaacgtatataacttattcaacaaatattatatttctgaattaagctccaacatcttcgcaggcgataaaattgccaatggcccggatgccggaaaaacgtatcaggaagctggcagagtgtatcagggtattgcagacggtaatacaggattccttggttttggaagaacctggtctgttgcagcaactttgagattctaatacaatatcatttcaacaatgaagtaatatgcaggctgttcctttttggaacagcctgttttatttattaatcagcaataagaaacttaaaagtttttaggctttctgttctgagcagcctgtcttgcaatttcatcaatacgatttttccgggtttcaggtcttttggcaagcacaatccattgcagcatcattttttttatggacttgctcaaactttgaaaataggcttcagagccttcatgaattttaaatgcttcactcagatcttccgggattacaagctcttccacactgtctaaaatattccaggagccattttcttttgccattctgatggtttcaaatccagctttcatcatcagattattttctatcagcttctgaactttctccttattaattttagaccatgtactgccgggcttacgtctgctgaataactgtataaaggatccttcatcaagggtctttcttgtactgtcaatccagccaaaacaaagggcttcatctaccagttcactccaggaaacagagggtaaattggattttttggtattgcaaataagccagacagactgttctatatgatgattttcttccagccattgccgccagtcctcccttgttttgacatgaaaagtttttttctcattcattttcccgtagtttagttttactatgatgtaaagttagaatactttggcgacaatagtttgtcagtagtaaatttctatttcttaattatcacaatccataatgtaagtctattttaaagaaataaatgataaattagcccaaaataaataattaaatatttatcttgttcagtcagatatggatagggaaactatagattatatcattaggtatttcagaaggttaatgacggagaatgaaacattagcattgaatcatcatatgtatacttacaaaagttctgatagtatttatttgaggaatataatgtttgaacgagggtggattaatactgaacctgaaatcataaagctattggagaacggatatgaagcttttgaacaaaatacagtaaaacggatcatgagagaaactcctgaaaaagtttttttcaattattgtccaaattgcaataaattagcccgtactccacaagcaaagcaatgcagatattgcagatatagctggcatcatttgacggttgctcaatttaagcttaataatgcatttcaacttaccggaagaaactttttcttaataggacaaattgcagaaggtaaaataaaagaaggacaaagaatagatttaagaatattgggactcaataaaaagcctaaaattcaatccattgaatttgcccttacacgtaaaggaggaaaagcatgggaagatattgcactgggtatagctgaattaactgcaaaagataaagaatatttaataggtatcacacctgtcagagatccgcttgacataatagtggaataaaaatctacttatttctcattcttcacctgcagcgccctctgataaaaagactgactggcaattttctcttctgcttcatcaatggcagtcagcagattatttttattgtctgcgatatctcccaaaacccgggacatcagttcccaaacgggtttcattttttcaataagctcgttcccttttgaagtgagcttaaacagtctttttctttcgtcctgcttatctttttcccactgtatcaattcaagcttttcaagttctttaagcaaggttatcgttgatggatgtgtatatccgatttcattggctatttctaccacacttgctatttcttttttgtaaatggtaaaaatgaccggaaaccacttcaattcaaaatcgattccgaatgctttatagatcaatgcgccatcctttctcaattgctcgcttaggcggtgcagccttgttgatatggcaagaattcctgcttcgttgattacattcatattcagtcaagatttaaatggtaaaaaacatcatccgcactcattaaaggaaatttcgcaggaagattgcttttttcaatctttacaaactgattcctttcatagaaacgccgtgctgctttcagtaccgttatggttcccaaatatagatcatcaattctgtttttgcgacagaaagaaattaaaacttccagtaattcctgtgcaatattcagttcttttcctctgaattcctttttcacaaacatttttctgattgctcctgccctttcgtcaaacttaaccaaggcaatggaacctaccagttctccgtttacaaaagctccccagaagttacctccggcttccacataaaagctttctatctgtaaaaggtcaggctgatcttctatagtaatcggaatattaaactctttctgctgaatcgttaaaatcaggtcaatagcctgctccgaataagaatttcctatgggctgtatttccaatttcatagtgtttgtattttaaagtataaaactacgtagttaaatacatatttacaaattaattttatgctttaaagaaatttaacacaaaagagcaaacctgaattttatctgatgatatttatgtaattttctgatcaaattaataccacacaaaaacatcactttaaaaatgaaaatagaaaatttaaaggcctttgacggacagcactgcgaaactactgcaaccggtactctacttcggcaaattggaattgaactttctgaaccaatgcttttcgggttgggtgaaggtcttggttttatctattggaatatgaaaacgatggacttacctttcatcggaggacgagtaaaacctgatctgctcacacaaaatttggccaaaaatcttaaccttgaactaacggttaaagaaacctcttcacaacaaaaagcatgggatcaggtaaaagcgcttcttgataacgggcagacagtgggattaaaaatggattgttaccatctggagtatttttcaaatcctttccattttgccggacattatgctgctatttatggttatgatcacgaaaatgcattcctggttgataccagacaacaaggcggtaaagtaacaacttcattaaaaagtctggcaatggcccgtgctgaaaaaggcccgatgtcctctaaaaatatgtattatactatccgaaaaacagagcgaaaattcgatctgaataaagcggtaatcactgcaatcaaaaataatgctgcggagtatctgaacccgcctatcacaaatatttcttataaaggaatcctcaaaacaagtactgaaattgtcaaatggttcaatacaagtaaagatattgaaggagaatttaagcaagcagctttactcatggaaaaagcaggaacaggcggagctttattcagaaatttataccgtgattttttgaaagaaagttatgaactgcttcaacttgatctgttaaaagctggttatgaagccttcaaagaaattgctgaactttggacaaaggtatctcaactgtttgaaaaagtaagccagacaaaagaaatgatctatattcatcaggcttcggatattttaaaaacactttctgaaaaagagaaaaaggctatggaaacattggccatgttgtagggattttatcatttctttccataccataaaaaaaacgtatgccattgctgacatacgtttttatgatattatattgctgaaacggttatttccagcctccgcctaaagcctgataaagctctacagctgctttcattttactgtatcttgcattggaaatgttaagctctgcattcaatgaattcacacttgcattcaacacttcaagatagttagccatcccatagttaaccaattcctgggaatagtcaacagattttttataggcatccagttctttttgcttcaattcaataaatgaatcctgtacagaaaatactctgatggcatcagaaacttcttttcctgcagttaaaactgtttttctgaagttcagataagccgtttcctgattggcaagacttacgtcatagttggtctggatctgtcttttatttaaaatcggctgtgccaatcctgccacaacatttgcaaacaatgaatttacactgaataaatggtcaatatccacagactgcaatccgccgcttcctgtcagttttaaagtagggtaaaactgagctttggcagcattcgtcagttggaaagcattcattaaattaaattctgctctcatcacatccggacggttggccagaagctgagtcggatatccgagtttcagatcgatcggaagtttttgtccttccaatgtagatctttcaattgagtgagagggctctcccatcaaaagactcatggtattttccagcagctggatttgtgtatcaatatcaatcagtaatgatttggcattaaaaacaagcgcttcgctttgctgtacggctacttcagtaagagttccggaagcttttaaagcttttgtggcttcaagatttttctcccttacggcaattgtttctgtgataattcttttctgggcatcaaaagtcagcaactgataatacgcagaagcaatggaagacaccaagctgcttttaacggccttatgagcggcaacagttcctaaataagtcgcaagctgtgctttctcctgtgcttttaatttaccccagatatcagcttcccatccgatacttgccgtaatgtcaaactggtttacataacgtctttctccaatgatctgtccaaactgggtgttgatagactgcgtctgaaatgtatagttgggcccgatagaaagtgtcggctgataggctgctttactctgtttaagataggcttccgcagaattaatactttccaaagcaatcctgatatcaaggttgttctccagtgccttggaaatatgcccctgcaatatcggatcagtgaatatttctttccaggaaatatctgcaatattcgtactgtctgaaggaagcatatctgtacggaaaagcttttcgtccacaacgttcttcggtctttcatattcttttctcgccatacaggatgaaatggctccgagtatgaaaactgaaaaagtgatcccttttatgatgtttaataaactcttcattatttttaattagaagttagagtttagaagttagaagttagtttttaggcttatagctaatctctaacttctaatttcttaaatcttaattttattctgctaaattgatatcttcttttttgataggtttgattttttcctgcaatgtttcaaaaatcacatacagaaccggaattacgaataatcccaaaacagttcctatcaataatccgattgccgcacccgtagcgatagatctgttacctactgctccgattccacttgccagaaccaacggtaataaaccgaaaataaaggcaaatgaggtcatcagaataggtcttacccttgctttcgccgcattgatggctgacatcacaatcgtttctccgtgatgccttctctgaacagcgaactcgacgataagaatcgcattcttagccaatagtcccacaagcatgatcagggcaatctggaagtaaatgttattttccagtcccataatcttctggccgaagtaagctcccattaccccaagaggaagggaaataataacgatcagcggaagaatgtaactttcatactgtgcagaaaggataaagtaaacgaagattaagcttaatccgaaaatcaaaagcgtttgagatccagaatttaattcttctctcgttaacccggtaaattctaccgcgtagttttgattcagggtttcatctgctacctgctgtacagcggcaattgcatctccggaactgtatccgtcagagttcgctcctgttacttttactgaagtaaacaggttataacggcttacagattgtggcccgtatgcttttgtcaatgtcacaaattgtgaaatcggagacatgataccagatcctgttcttacataaagctgattcagattttcaatattctttctgttttcaggaagagcctgaaccatcactctgaactgttttccatatttggtaaagtcagcagtataaatacctccgatgtatccttgcatagtacttagaatatcattcacagaaactcccaattgctttgctaatggaacattaatttccatctgatactgaggatattttgtattgaatgaagtctgtgcaaactgaatttccggtctctgcatcagcttaccgatgaattcattggttttcgcatccaggtcagcatattctcctccggatttatcaagcaataccatttcaaaaccggcactgttaccaaatcccggtacacttggcggctggaagaatactactttggcatcaggaacagatcctacaattccgaataactttttagtgatatcttcagaagtctgtccgtctttttttctttcttcgaatggtttcagtttcacaaaggcaagaccgttgttacttccgtttccggataagaatcctctacctgttgaaatcgttacgttctgtacgcccggaactttcaatgccttcgcctgaagggtttttaaagcattataagttctttccatggaagctccaggaggaagctgtacgtcggtaaagataatccctctgtcttctgtaggtacaaaccctttcttcatgctgctgcttgcccagaataagatacctccggtaacagcaaaaatgattagagtaacccatttatgtcttaacaggaatacaaatcctcttccgtaacgctcagtagttgttttgaaagcaatattaaacttatagaagaacttctgtagcaggtttaggtttttatattctgcatgatgtgcttcgtgaggtttaaggaataatgaacataaaaccggactcagcgttaatgcattaatcgcagaaatgatgatggctataatcagcgtaataccaaactgctggtagaatacccctgtaggtcctgtaatgaacgttaccgggataaatactgctgccattaccaaagtaatcgaaataatagctcctgtaatttcatccatcgcttctaccgtagctttcttagcatcagaaataccgtgctccattttagcatgaaccgcctcgacgacgacaatcgcatcatccaccacaatcccaatggcaagtaccaatgcaaacaaggttaagaggtttaatgaatatccaaacaagttcaggaagaagaatgctcctacaatagataccggaacagcaatagccgggatcagtgtggatctgaagtcctgaaggaaaatatatactacaataaataccagaatgaaggcttcaataagtgtgtgtaccaccttatcaatagaagcttccaggaattcgttggtatcaaagttgaaagtatacttgattccctgcgggaaagttccctcagctgatttcagataggctttgatatttttaataatctcctgtgcattggatcccggagtctgaaagatccccatactgatggaagggttgtttccgttctccccgattcctgtataagactgtcctgccaattctactttagcaacgtctttcagcatcaggttttgtccgtttgcaagagatttgatgatgatattatcgtactgctctttatcgttgaatttacctacatatttgatgatatactcaaaagagcttccgctgttttgtccaatagaacctgccgcggcttctctactctgttcattgatggcattggtaacatcagtaggtgttacgctataagcagccatttttgcaggatccagccagattctcattgagtagtttttacccccgaaaacgttcgcatccccaacaccatttacccttttaaggttcggaataatattgatattcaaaaagttctgaaggtatacatcatccaggtccttattttcagaatagaaggacatatacatcagggcactggtctgctgtttctgggtaaccacccctgaacgcgttacttcagcaggcagcaaaggtgtagctcttgccacacggttctgtacgtttaccgctgcaatatccgggtctattccctgtttgaagaaaacctggatttgcgcagaaccgtcgtttcctgcagtggaagtaatataatccattccttccaccccgttgatctgttcttccaaaggtactacaacacttttcattaccgtctcagcgttggctcccgtatagtttgtggagacacttaccgtaggcggtgcaatatccggatactgtgtaaccggtaacgagatcagccccagcacaccgagaatcacaatcaggattgagattacggtggataaaaccggtctgttaataaagttttttatcattagaatttcggttttattgattgaacaagactatccattttgatgggcttcggcttcactgctgttcccggtttcaaacctccgataccagctgcaataactttttcgcctttattaactcctgatttgatcagcgctaagttgtcgattctgtcaataacattcacaacaacatttctggcagtatctcctttatctattttgtatacgtagacaataccctgctgttcgtaagtagcactttcaggaactacaagaacattatcataatgctgagggaatctgatcgttccgctgttaccattacttaataatttctgagcattggagaacgcaactctgaactgaatagtcccggttgtaggatcaatctgtccggtaatggcttcaatttttcctttttcaggataaagacttccattagccagctgaagttcaaccattggtaagtttttgattttctcaggcatagaggctcccggagatttttcaaggaaatcaaaatattctttttcattcatggcaaagtaagcatagatctcagatgtatcagaaatcgttgtcagaggagtctgatcagacgggcctaccaaacttcccacttttaatggaagctttccgattacccccgaaataggtgcacggatgatggaatattcgatgttggcttctactcctttatagttggcttcagcctgtcttttggctgcattggcctgctgaagctgggcctgagcctgagctaactgagcctgcgcagtctgtaactgtacgttgctgatgatatttttctgaaccagaggttttagtttgtttacttcaacctgagccgcatttacagaagcctgagccgctgcaacactggatgctgctgcaccgattcctgccttggaagccgctgcattttcgttcaggatattggtctccagacggaacagtggctgtcctttcgtaacatattgcccttcatctaccaatacctgggtgatatatccctgtatttttgcacgtacatcattgtttaccctaccctgaatggtagccggaaacgtctgataacccactatattttttgactccactgagataacaggatacggcttggcaccatcctgtttcggagcttcttttttgcacgctgtcagtgaaagcgctgcaatggaaagtataactagcttattattcattttatagtttattaagagattcctgaatattttctatgtttttatttaagagtgctttgtaaacttctattctttcgttgtatccatcgtctttacttgttttaaaattgtttaaatcctctaatagtcttaattcgtcctgcattttctggacaattttctcgaatcgtattttttggtattcatcattgatgaaaaaataccgtttccgctcatctattttgttatggtctacgataagctgagcattgagcagtaatgaaatactggtggaaacagagcttttgcttgcagagagcacttcaacaaattcgtcaaaagtaattcctactttctcataatcgaaaagaaggtaggaatagatttttgatgctaaagggggtaagctgaacacggtgccataaaattttacggcatcctgaaaaattttctcatcaatttctatactttggtgcataatataaaaatttgaacaaaagtagaaattagttcagaaccaaacgaacaaacctgatagagtttataaatacacgctcttttaaaaattcaatgaaagttgatttaactttttacctaaattataatcttctcaaaagctttcctcatgccatctcgtaacagaacttctccacaataagaatatcctctcccttcaaggattttcagcatagcgatattgtcatggttcgtatcaaccttaatactctgaatgccatgggattttgtaaactcttcgatatggtcaaaaagttttttcaccataccctgtcccgcaaatttttcatcaactgccactctgtgaacgactacaaattcaccatcactcagccaggctccttctatggtactataggcaggttcgtcattcagaatcagggctgcatacactgcaatctctccatctacagtcaaaacatgtccgaatcctttggcaatatcactttctaccgttccaatattagggtatccgttctgccattgggtgcttccgtcctgccttcttctttcaatagattgctggatgatttcccaaataatgttcctgtcttcaatttccgcttgtcttagtttaatttctggattcatgttgttgattttgattgattaaaaagtataaagttaaaaagctaaagtctgaactgcttctctttgattatatgaactaaaacctaatttttattaacgcaaagattttatttataaaaacttaagattttaagtgagcaaagattgcgactccgtcgttgaataagcgaatggctacccgctcgcttaatgagaatataatatagagttactaaaactttgcatcaaatttaaaactaaccaatacttctggttctgatataaaataacagttcttcaagtcatcttttaaacatttagtttttcaataaattaaagattattttaattaaaaaaccgaaaactaattaaaattaattttcggttcgaagtagtaaaatttaaaattatgaaattgtttattgattttcactttgttgaaggtaagcatcaataatttcaaatgctttggattcatcttccagatctaccattactttcagcgaagttgctgtgggtgttgtagtaaatgtaagatagttgttttcaaccgtatttgtaatctgtgcgtcatccaatttagatttaaccaactgaatttctgaagggttatcactttcataaactgatactctcgtacttctttccatatttctaaatgtttgagtatctaaatgtacaacgttttttttaaaattacaaattccaggttttaaattttattaatattgctctcaattttatctaaagcaagctggatttcttctttcgtaacattcagatgaggtctgaaacgaagagactgatctccacaaggaaggatgatcaatccatctttgaaaagctcgttcatcaggtggtttctttgttctgccgttggcagatcgatcgcacacatcagtcctcttcctcttgcatttgaaattttttccggatatttttcagcaagaacttttaaactttccaacaggaagtctccaacaactcttgcattctccacaaggttttctttttcgatcacttccataacaagctgaaaacgcagcatgtcaataaaattccctccgaacgttgaattgattctggagctttctctgaaaacattgttcggaacctgatcaaatttctctttgttggcaaggacaccgcaaacctgagcttttttcccgaaagaaataatatccggttttgctgtaaaatgctggaaagcccacatttttcccgtaatggcaatccctgtctgaacttcatcaaaaataagtaagatttcgttgtcatcacagattcttcttaatcccagtaagaattcgtctctgaaatggttgtcacctccttctgcctgaataggctctatgataatacaagccactttatccgggtgcatcaggatagcctcttcaatctgaagcaaagcaaggttttcgtttttgatggtttcttcaaggttctcttctgtaatcgggaattttaatttcgggtttaaaattctcggccagttgaacatcgggaaatattggtattttcttggatcagcagtgtttgttaagcttaaagtataaccgcttcttccgtgaaaagcctgtttgaaatggatacagattccagcttcagtatcaagtcctttttcaaagtttttgcgggttttccagtcgaagcatgctttcatcgcattttcaacgcccaatgttccgccttcgataaagaaagcatattgtaattcctcaggaataaccactctctcaaacacctcaaggaaatgggcgtattcttccgaataaacgtcagccaaagtaggtttgttcacagccattcttcccagccattctgatctttctacaagataagggtggttatatccgatagacgccgatgcaaacatagaaaacatatccaggtattctctgtctgtaagcttatcgtatagccatgaaccgtgtgatttttcaatatccatcacaaaatcgaagccgtcagccagtacatgtcttcctactgtttctttaactttatttacttttatatctaatgtttgttccataataaattgtagtgtgatttaataagtgaatgattaaatgatccaaagaatgaagcatttaatcattcaggttattaatttttttgtttttaattactttaaagctatgcttttataaatcaaatttaattccttgtgccaaaggaagttgagtagtataatttatagtattggtttgtcttctcatatagtacttccaggcatctgatccggactctcttcctcctccggtttctttctcaccaccgaaagctcctccgatttcagcacctgatgttccgatattaacgttggcaataccacagtctgaacctgcgtgagaaaggaataattccgcctctcttaaattctgggtcatgattgctgaagataatccttgtggaacatcattctgaatagcgatcgcttcttctaatgttttatatttgataagatataggattggtgcaaaagtttcatgctgaacaatctcataagagtttttcacttctgccacacaaggcttcacatagcatccggattcataatcttttccagataatactccgccttctacaacaaattttccaccttcttttttacatttcttgatggctgcttcatattgattcaccgcatcagtatcaatcaacggacctacatggttggtttcgtccagaggatttccgattttcagctgaccataagctttcgccagtcttgtttttacttcgtcatatacactttcatggataatcagtcttcttgttgaagtacatctctgtcctgcagttcctaccgctccgaaaacagctccgatgatcgacatatcgatatctgcttcttttgtaatgataatcgcattgtttcctcctaattcaagaatagactttccgaatctttctgccactttggaagaaaccattcttccaactcttgtagatcctgtgaaagaaacaagggcaactcttttatcgtctactaatttctgtccgatttcgtggtctgataccagtacgcttgaaattccttcaggaaggttattttcctttaaaacttccatcatgatattctgacaggcaatagcacaaagcggtgttttttcagatggcttccagatggtaacgttaccacagatccatgccaatgctgtattccatgaccatacggctaccgggaagttgaatgctgtaataattcctactactccaagcgggtggtattgctcatacattctgtggccaggtctttcagagtgcatcgtatatccctgaagctgtcttgaaagtcctgcagcaaaatcacagatatcaatcatttcctgaacttcaccaagaccttcctgcagtgatttacccatttcataagaaacaagtttaccaaggtcatctttatattctcttaattttaagcccagctgccttacgatctctcctcttttaggagccgggatcagcctgaattcctgaaatgccttttgagcagtttcaattactttgtcataatcactttctccagaagtttttactttagcgatcagttttccgtctacaggagaaaagctttctattacctttcctgaagcgaaatattttccgcccactgaagtccctttgttctcttctttgataccaagatttctaagtgttttttcaattccgaaatcctttactttttttgacataaaatcttacttttcgttctctctaaagataaaaatattatgtgaacctcaaaactttaatttttaacaagctttttatttggactaattataaacatgcttatctttgcagagtaatcattttgataatcaccaatggaaaattcacaagaaaataactcaaagcttaaaaagtggttcaagcgtgtgggatgggctggattagctttctttaccattaaaggcttgatttggctggtcatattctacgttggagcagatagtctccagagttgtatacaataaaaaagcagagaaaaatttctctgctttctttttggtataaggttaagtgaattgttatttctttattgaaaagctaaaaaaagaggtcttttttatgttttctgtaatttaaaaaaaagaggatatcataaattttattaaaaatattccccaaaaagattattctttttcttaattcttccttttaaactactcctttttctttctccccgcattcacaaggctttgatgcaacaggtattctatctgtccgtttacacttctgaattcatcattggcccacttttcaaggagtttataagtagactcatctattcttattacaaaggattttttgcctttgctttccgaagagttctgagctttttctgatttcattttctatttctctagcattattcttactatttcagtggagaaaccctctgcactaaaaccgaattattcaatttcacttcttaattataaagtgttccagcatttaatataggagttgctgctttttcaccacaaagaacaaccattaaattgcttaccattgccgcttttctttcatcatcaagatcaacaatattttcttcggatagctttttcaatgcaaggtctaccattcctaccgctccttctacaattttggttcttgcagcaacaatcgcagttgcctgttgtctctgaagcattgctccggcaatttctgaagcgtaagccaggtgggaaattctcgcttcctgaataattattccggcttttgaaagacggtctgtaagttcctgctccaaaatagaattgattttatcccctccttctctcaaggtaataggagcatgatcatcttctaaattatcatacggaaagctcatcgccaaatgccttacagcggcttcactctgcattcttacaaagtcagaataacgttctacatcaaaagcagctttataagtatcccccactttccatacgataaccacagcaatttcaatagggttacccattttatcatttactttcaatgtctgtccctgtaaattttcagaacgtaaagaaattttctgtgacgaatacaagggattgataaagaataatccgttctcttttacacttccgacatattttccaaagaagttcagtaccctcgaatggttaggctgaataatcattaagccctttaagaaaaagcatgacagaagaaagcaaagcattgagataacaacataggctatactttgatctactccgctaacaaagaaatagacagccgcggcaaacaaggcaagacagataaccagtgtaagatagcccgacatgggttttaatgttttttccatgatataattttattttgatattattttgatatcataaagatagtaatcaattttgaattatgaatgataaattttgtttttttgaggtgcgaggttcgaggtttggggttgcgaggtgcggaatataggattcggtattttagataacgcaaagttcgcgaggttaatctattaggatgcattatatttttgttcgcaaagccacttcgtttagctaagatcagtaatttctttgctgagtaaaacgtctttgcaaacgatatttatcatcataaaatcattgcgaatcttggcgttagaattcgagttctcagtatttaatttaacgcaaggatcacgaggttaattttattgggatacatcatatttttgttcgcaaagccacttcgtttagctaagacaagtttatttgctgagtgaaacgtctttgcgaaagatatttatcatcataaaatcattgcgaatcttggcgttagaattcgagttctcagtatttaatttaacgcaaggttcacaaggttaattttattaggatgcattatatttttgttcgcaaagccacttcgtttagctaagatcaataatttctttgctgagtgaaacgcctttgcgaacgatatttcatcccaatacatgctattgcgaacttagcgtttataaatactcatcttaaagctggaaacattatgaacaaaaaaaatcccggaaaacgaattccgggatttgaatttatatgttcagctctttatttctttgttaaagttttaaacttccagtaagaaacagctgataaaataatcattgtagagattccgatgtatacccatgccggtaccggtaccggatcccctgctgcatatgagtgaagtccgctcaggtagtaatttactccgaaatacgtcattaccattgagcagaatgcaaacatcgttgctacatggaatgcccatctgcttcttaatcccggtactaatctcatgtgcaatacaaatgcatataccatgatggaaatgaaagcccaagtttctttcgggtcccagctccagtatctaccccatgattcgtttgcccagattcctcccaagaagttacctaccgttagtgcaaacaatccgattgtcaatgacatttcagaaacaatgaccaattcctttaatgttgtatcgtggtgaatcttataagtttctttatttgaaataatataaaacaccaaagagattacagcaataatcatcgacagtgcgaagaatccgtaactggaggtaataattgctacgtgaacaatcagccagtaagacttcaataccggaacaagcggtgtaatttgcggatcaagtgctgaacctccgtgtgcaaatcccatcatgataaccgctaccatgaatccggctgcaggaatcaacgcattggcatttctgtacagaattaaacctgccgtgattcctacccaggagataaagataatcgcttcatacccgttactccatggagcgtgtcctgagatataccatcttgccacaagtcctaagaaatggcacagatatccgattaaaccaatcgcaatgattactttaattactttgtttaatactttatttgatttgaataattcaacaaatcctaagatcagaagaagtcctccgacaagcgtgtagaagatcaacaatttgaagttaatatctactttattcatgaatacttcaagatcaaccttggattttgcaggaactactgccttaccccatttctgctgatagtctgaaagctttttcaattccgcatctgctttgctccagtctccggttttttgtgccgtaagagcttccgcaaagtatggccccattacctgctgagattccatatccggttcaaatttctgatccagccacgagtgccatgtatgattcgcatcatttttcacaggaacaattctcataaactgaccgctgaagaactcattgaagatctgtactctttcgtttacagcaattacttctttatcgtaattcgtttgttcagccggtttcttacggaatgcggtgttgtaatcatgttcaagaatgtaggtaagattaccgtttgcatccgcagggaaaagattcatcagagaagtataaccatcttcatccgcttttgttttattcttcagctcatcacctcctttagttcctactttaataatcggaaccattgtccagcttggggtgtctgtattgatggaaaggaaccattggttggcagtaagatacttcccgtctgttcctttaaatttgtcttttttgtatagttttcttaaaatatctatagcctctgtattgatcggaacaattcttccttcataattctgtaccagaagatatccgaatttatcagcatgttctttactgattttgtttcttgcaataatctcatccggggaaatcattctcattttccccattggagttgccagagagttttgtttcggagcggcaccatcaagaggctgggcagacggagccggagcatgagtatggttatcaccttctaaatggatatgctctctgctaccatcagttgttccgtgagtttcaattttctgagcatttaaccctaagcttaagaacaataaaagtacacctgctgctttctttttattaacatcagcaagcattttatttagtttccagaaatgagttcctttccagaagaatattacaaacatccctaagaataaaagtgcatatccgatgtaagaaatcaaagttccccagtaatcgtggtttacagaaagaacggttcccattctgtccgggtcaaagcttgactggaagaaacggtatcctttatggttaagaacgtggttcatatagattttataaggcgtttcttttccttcatcaatgatcttcacgtggctttcataagcacttggcgaagaacttcccggataagtttccattacgaagtcatccagtttcaaggcgaaaggagtgttgtatattttaggtccgaaacctaccataatgtttaagccatccatcgtaacctgcttgtaagcattcgggtttcctttttctacagaaagatctaccagctgctttgtttttggtccctgaagctcaacctgaagcatatccggtacgtttgcatctttttttctgtctccttcaatcgccatcagccttccttttttaagaccttcaggaactacaagcttcagctcattgatcgtatataaacttcttaatgccagcggctggaattcatcttttacagtagttccagttgcctgggtagccatggtcatatagcttgcatctacaggcgttttgatgaatagttttccaccttcatttttgaactcaacagctccgtcaatcgctctgttgaaagtcaccaaagttccgttgatcgattttgtctctcccggtttaatataaatattctgtcttccggtgtttccggtagaaacgagatgaagatactctgtaccgtttggctcagcaacaaggctgtccttttttctctgaatgtattccttggcaaacactttcacttcttttccgtggaagtcataagttgcctggaaatctttgtgtaacggcgacatcagataaggaacatcctgatagttaagaacatctcctttttcctcaatctggattttaaagaaatttttatccgttacaatttcgttggaggtttcaccctctctgatatgcatttggccttcgaaactgatgtatctggtgattgcacctccgataaaaataaaaacaaaggcaaggtggaaaacaagaaccggccatttatcctttttccaaagtctgtatcttccgatatttcctatgaagttaagaataagcaggaccatgatcagttcgaaccacttggcctcataaattaatgcttttgctgtaggagttccgtagtcgttttctaagaacgttgcataagccatcgcaaatgcgtacaccagcaacaatacagccattgtcctggttgagataagaatatcttggagcttcttcatgatttattgtacttgacatgcaaaaataagcatgataaaccataaagagcttaaaaaaagctgttttttgtcactttggccttggttttgcttattttgaaacgttcttaataagcttgaaaatattaaggaaaattcaatttttaaaaacctcagaattcagattcatattacctatccgggtaatcgaagtattctatttaaaattcatctttattttaaaacttctgaaaagaaatgtgttaacaattctttattgatctccggattataaatgaaagcatgagatcctttctccagggttttaaatttccatcctgttgccttggatttattttgattataaattttaaagacattttcatagctgaaaacatcatcatcttttgcattcacagtatacaacggatgcttttttgtgatattctcaaatgaaacatccccgatattcaatacagggttgggagcaaaagcataaaaagcccggaaaggtgtctttttctgtgatgcaaaccagaaggtggcagttccgccgttagacattcctccaaggtatattttattccggtctacattatattttttctcaatatcatgtacaattgtaaatatatttttaaatgccttcttctggtcaacccatccaaaatcttttttagcaaaaggataaacaataatggcattaaaattttcccctactgaaaaaatgggttctgttttgacgtcagtatttttatagtaaaaatcattcagtgaatttactcctccatgaaggtaaaagatcactcttgtttttgcagaagctttataactcttgggaacgaaaacaatatatggaattttcataccttcagtttcagtaaaatacagggcaaacccgggtgaaggctgattgaagggtttattttctgtaatctgattacggataatctcctggttccacagctctgcttcttttcttttatcctcttccttttgagccagtttattttccatacctgttataatctgctgaaattccgtatcagaagtaagatttttaaatctttcattggttttcagatagattatttcatcacggttttttcctaatccaagctcataacttttttttaaccactctactgctgtttttgtatcactgcaattggcggccgctgaagcaccacttacatattcatagactccaacttttgcctgcgggccaaaagcgtttttaaaatctgaaagtgcagcacaatactcctttgcttttaattttttggaggcatcctgcataaaactttcataagattgagaaaacatactcgaaaaacaaagcaaacatggcaatactaaagttctcatggtatttttttatttcaaaaataaaaaatattcatattcaattcattgacttgaaattttctttcttattttacttaaaaactcatgggtaattcccagataagaagcaacctgctgctgggtaattctctgttccagtcccggatacttttcaagaaattcaagatatcttttatcagctgtttttcctgttaacgaaagaattctcctttgcagtgctaccgaagatttctgattcataattctgaaaagcttttctgtctttggcattgtttcgtatagattttctttctcttttttggaaatcatcagcacttcactgtcttcaagagcttcaatattcagaatactgggaacattattgataagactgtcaatatctgtaatccaccagccttcaacagcaaaatataaggtttgctcaaaaccgttttcattaagataatagattttaaagcagccactcagtacaaaaccctcaaaaaggcagtaatcaccttcttggagaacaacctctttctttttaaacattttgagtttaaaaggctttacaaactgctgaaaatcctcttctgaaagattgatgtattgactgatatttctaaaaagtaaatcggacatggaattatttaagcaaaataaaggtatcaaaattattgacacctttattgataaagttatgttaaatcatttttgtttggtaaacgctaaggcgcaaagttttatcatacatattgtttattttaagacgcaagaaaatcgaaggttttcagcaagatgacttgtttttaaattttatcggagataaaatctttgcgccttatagcaaaatttttaatatcattttgcacctttgtgtatccaaatatgcccacttttaagcctatttacttaaaaattcttttgtatttattactcgggcataaagatttccaagagcagatatcgccgccaggaaggatctttgaacttcttcagcctttagtacttccccattcagttcacgatttctggttgcagtggcatcaccaataacggtattactgaatccgaaatcaaaagccgctctggtagtagattccacacagacatctgtcatcattcctgtgattacaagacttttaattttctttgactgaagatagttcagaaggtcagtttccctgaagctgttgggaaaatgtttggtaattatcttttcattctccttcggtaaaacccgattattgattttaaccccatctgtatccgggagaaaaaaagtagccccttcgttggtggagatatgctgaatatgaatgacaggaagatgattgttcctgaaataatctaatactttccggatattttctgcagcctgttcagacttttccagggtcatttttcctcccgggaaataatcattctgtacatcgataattaatagtgccgtgttttccattttttgttgttgtgcgttcattgtaatcattgaaattaatatcagacctgaggtcagaataattttgaatttgtttttcatatatgaaatcttatgagacaaaattactcaggtctcagctgctggcctttgaactagttcaaaaaacacgattgcatattatattatcaaccagatattcaatattgttattttttttcagctatatatatttagatcgaaaattttattatcttttttaaagaaaaacgaattataattaattaatagtatttaacggtatcagatttggataagcaaaaaaaataaccttattttatcgtattaaaacataaaataatttttgagtaaaaattttaaataccctttataaaagctggattacccaaatgttttttggataaaaaagattcatttaatgttgaataaaacattaaatttgcgacattgatattatggataaaaagacacaaaaaaaaccgactgaaatgcctgaaaaaggcagaattttatctaagccacgtatttttttcgggcttacctttatacttttatctgctgttcttgccttctcattcatctcttacctgatgaactggaaagcagatcaaagccaggcagggactatgctggacaagagtataaaatcttccaatatctttggtaaggtgggtgactggcttggtaatattttcatttttgaaagtattggtatagcctcatttatcatcgcatttttgctgcttgtagtaggaacactgatccttaagaagaaaatattcaagccatggaaaaccattggccactctctgttttttatctgctggcttcctatttttatgggagcacttaccaaaggtcagggtgttttaggaggtgtctatggatatcagattatggattatcttaattccatcattggctctgtaggtctttggaccgtacttgcagcaagtatcctgttatattttatccttgaatttaatcttcgtcctagttcaatcaaagcgaaactgaataaaattaatgaaaatacgattggaaaagtaaaatctatgatgccggactctaatgaagatttcgaagcggatgaggaactgaaagaagaagctgaggaaacagaagaagaaaaagaagctgctccccgtgttacagtaagtgatgttaccaataacacatccaatacttcagtgaatgtgaaaaaggagccggagccggtaagtgttccgaaaggatttcctgaagttcccgtttcgtcagatatagaaaccattaccactccaaatcatacttcttttgatacttttgatacgaatccgggcaatacttctgagccggtaagtttaaacctgtctacaaaaccagttgttcctgtatcaactcccgaggaagcatttgacatcagaccttctgctccatctgctgttatcacaggttctcaggtgaaggaagatattaagtttaacgtagaagtcgctcctgttattgatattctggatgattccgaaaaaaaatcccaggacctggtagaaaagcatggtttatatgaccataagctggatctggccaatttccagatgccacctgtagatctgctgaaagattatggtaatgaagagatctccatcaataaagaagaattagaagaaaataaaaataaaatcgttggacttctgaagaatttcaacgttggaattgcagagattaaagcaacaatcggtcctactgttaccttatacgaaattgttccggaagcaggaatcagagtggcagcgattaaaaaactgcaggatgatattgcattgaacctttctgcattaggaatcagaatcattgctcccatgccagggaaagggacaatcggtattgaagtaccaagaaaaaatcctacaatggtttctatgcgttctgtaattgcttcccagaagttccagaatacagatatggatcttccggtggttttcgggaagaccatttccaatgaaatttttatggctgacctttcaaaaatgccacacttactgatggcgggagcaacgggtcagggtaaatctgtagggattaatgccatcctgacatcccttctttataaaaaacacccaagtgaactgaagttcgtaatggtggatcctaaaaaggtggaactttcattatattcaaaaattgaaagacattaccttgccaaacttcctgatgcggaagaagcaatcatcacagataccaataaagtaatcaatacactgaactccctgtgtattgaaatggatacccgatatgaccttcttaaaaatgctttctgtaaaaacctgaaagaatacaataagaaatttgcagaaagaaaattaaatcctgaaaacggacaccgttacttaccttatattgtactggtagtggatgagtttgccgatctgatcatgaccgcaggaaaagaggttgaattaccgattgccagacttgcacagcttgccagagccgtaggtattcaccttatcgttgccacgcaaagaccttctgtaaacgttattacaggtatgatcaaggctaacttcccggcaagagctgccttcagggtgatctccagtgtagactccagaacgattcttgactctccgggagcggatcagctgattggtaaaggtgacatgctttatttcaacggaaacgagatcttaagacttcagtgtgctttcgtagatactccggaagtggaaagactggcagaatttatcggagaacagaaaggctacgcttcagcgttattacttcctgaatatgtttctgaagattcaacaagttcagtaggcgcttttgatccgaatgaaaaagatgccctgtttgaagaagctgcaagaattattgtttctacacagcaagggtctacatcaatgcttcagagacagttgaaactgggttacaacagagccggaagaattatggatcagctggaagcaagtggtattgtgggaggattcaatggggctaaggcgagagaggtgctgatcagtgatctacattctttggaacagttccttgaagatttaagaaactaatcattatattataacaatcatcaatacaaagattaatcccggatactcctgactgggtaccgggatataaaaaattcaactcaaactattaccatgaaaattaccctaaaacaaactattacattgagtctttttgcatgtacattaacattatcatcatgcgccttaagaactgttcccagtgattatgcttctgtgaaactggatgttattgataataacactctgggaaatggtaaagtccttatttataatggcgccggaattctccataaaatggataacacagcaagattgaatatcggacttgacggcaaatcattaggacagataaggcccaaagaatatgttattgttgatttagcaaaaggaaaacatgagtttacagttcttcatatagatatggtgaatatgagaagtaaacatccggttgagattaatgaaaacactaaagtaattaaaattgaaccaaccattacttctaataaattaactgtcaccaatatgctccctgaaaaatttgatcagtacattgaaagaccggagacaaggtaatctgtaaacaatatctgtcatacagtatccggcattgaaaggtggattttggaacagtttttggaagatctgcgtagttaaaggaaaaacacatcgttttaaccttaagaattaaagtaaatctaacgattattaaattaagaaaatgaaaaatattatttcaaaagttatattgggaagttttgttgtaggtgcagtaggtatggccaatgctcagaagattgatgctaaagctaaaaagatattggatgatattacagccaactataattctaaaaagaattcttacttcaaattttcttttggaagcggtcttaacggacaggtgacaaaaacagaacccggtatttattatgttgccggagaaaaatacaaactgaagatcatggatacagaacagatcttcgacggtagcaaaatttacaacatcaatgctgatgatatggaagtaaccattgccaaacctaacggaagcagtaccatgttctcccctatcaattatcttaccacctacagaaacgattataatgtaacctacaacggtaagaaaatggtaaacggcgttaatgctgactttatcaaactgaccccggtaaaaacaaacggtataaagtatgtttatctttttgtagattcagtaaagaagcaaatggtaaaacttgaacagcatggaaccaacaaagatgttgcagtaatcgctattaaagaatacaaagaaaaccaggagctggatcctaatatgtttgtttttgacaagaataaattcaaaaactacattataacagaactttagaaggtaaaaggcaaaactgcttatccgcaaatttgcatttttacgatttagtttaaaaaaaataacaaaatataaaaagccacaagtaaactttgtggctttttgattaattttggcgcatgttaaaaatactagaccgatatatcataaaaaccttctttggaccgtttttctttatattcagcgtattgtttttcatttttattgtaaacattatctgggttcagttggggcagtttatgggaaaaggattaagctactggcagatcctcaaacttcttttttatcttggggtgaacgttatcagtatggttcttccgcttactatcctcctggcgagtattatgtctttcggtgaatttggagaacgttatgagcttgcggcaatgaaagcggcaggaattcctttgaccagagtaatgactccccttctgggaatttcaacagcgcttgctattatgctgtttttcttttccaataatatcattccggattttcagaagaaagctaaaaacatgcttttcaatattgcccagacaaaaccggccatcaactttactccgggacagtttatcgatcagattcccggctatatggtaaagtttgacaaaatatacggggaaaacggggaaaatattgaaggggtttttgttcataaaaaagccaacgcttatgaaaaccagcaatccgttgttgcagaaaaaggaaaatttgttcctgccgctaataagaattacctaaagcttgtgctgtataacggatatgtatttgaagacgcttttgccggaaaaggagataatgtaagacagaaacagcccgaccaggccattaagtttgacacactggtttcccatttcgacatcagtgaaatcatcaataaagccattgaaaaggaacagattacggacgactaccgtttccagacctataaccagctagacggaacgattaccaaaaccaagaaagacaataagcagttctttgataatataggctctgaagtccttaatcagaccaattctgttattacctatatggataaaggtaataaacataaagtagctcctaaaacccagatcaagctggatacagtaaaaggtgaaaaaaaacttgaaatcatttataattcctacaacaggctggataatcttaagtctacgctggaatctaaaaagaatgagtacagttccaatgtaaaatacttcagtaaagtggttatttatcagcaaagaatcgttgcgtattcggtaacctgcattatcttcttcctgatcggatcgagtttagggtctattatcagaaaaggaggaatgggacttccggtaattattgctattgttattttcattatcttttatgtaatgaatgttggcgtggaaaacatgtcatggagcggaaaaatgaatccttatcttgcagcctggcttcctaacctgatccttcttcccttcggagtgtggatgacgtataaggcgcttacagattcgcaattgtttgatgcagaaaaatacaaagcattattcaaaccgattaccaaaaggtttacaaaaagtaaagaacatcagaggtatcaataaccctgatatcaatataataaaaggctccggagaaattccggagcttttttgttgattgttgtaaacatattccgtttcgtattattttgaatataaaaaaattatatttgtggaaacttaaaacagaaccatgaagaaattactacttattggcttatttagccttgtgtctctgaatgcttatgctcaggatgaagagaacggtacctacaacggtgaaaaatacggatacatcatcaataaagccggaaaaaaaattgaaggggttgtgcatctgcatggcggctactccagcccgtggcaaaatcagttaaaagtaaaattcgctgccattgctgatattgataaagtaaaaaacaggattaagtttaaaacttatgatactgacgatatcaaggaatatatgctctatgaaggtgatacgcccagggtttttaaatctgtaaaatactctaatatgagagaagccttaaacagttctgaaagctcaacagggctcgctgcaggctttaaggcgatcaataacctttcaagaacggaacagtttgcagaagtggtaacagaagggaaaatcacagtgtataaactttacggctaccctactgctctttccgcaaacagtacacaggctatctctcaggcagaaacagaccggttaagagaaaatcctaattatatattttcgaaaaaaggaggaaaagtagaagaactgactccggcaaaggccaaaattatcctggcagattgtccttatgtaaaagccaaaatagcaaaaggagaatatggttccctgaaaaatgaagaaaagaaaaggtccggttttgggaaatttatccgggatgaaatcagcaatgctacagtagataaactttcaatcatcaatgaagttgtttatgattataacgaaaactgtaaataaatactaaaataaaaaaggctgtctcctaacaggaggcagcctcttaattttaaaactgataaacaaaagcattaatgttcattccagcccctacagacgcaaataatacgatatcacctttgctgatcttatgatgttccagctcatcctgcagaatcattgtcagtaaagaaggaatcgtagccacactgctgtttccaagtttatggatcaccataggcatgatgttttccggaaccggctttccatataactggtaaaatcggttaacgatggcttcatccattttttcattcgcctgatggataataattttattcaattgctcaatggaatatccactgttatcaagacattttttcatggcatccggaacatttaccagggcaaattcgtagatttttctgccatccattttgatgtagcgggtatcaggacatctttcgttgttgtaagattttccaaaatacagataatctttttcttccaatgtataggaagcggataagtgagctttaataccggagtcatcatcattattgacttccagaacggctgctcctgccccgtcagcatagatcatgctgtccctgtcatgaatatctaccacgcgcgaaagggtttctgccccaatcaccagacacctttttgccattccggatctgataaatgcatgggcctgtatcactccttcaatccaacccggacatccgaaaaggacatcataagccacgcagaaattatttctgattcccaataaatgttttacccttgctgcaaggctgggtaccatatccgactgaaccgttccaaagcggacatctccaaagttgtgggcaaagataatatagtctaaagtttccggatcaatttctgaattttctatagccttctttgcagcaatatatccaagatcagaagtaacctgtgtattgtcggcataccttctttcttcaatccccgtaatcttcttcagcttatccgtaatggaagcattattctcttttaatacgactccttcttcattaagaaaaacgtgtttatcaaaaaataaattggttatggtttccgatgggatgtagtttcctaccccgataatttttgtcatcattattgtaagtttgttacctgttttttaatcatatctcaggattatttattaaatataatgaatgaacgtaaatattcatcaatatcgtatgaaataagaatgtattgcattataaaaaatgaaaaagaacaggaaataaggagcacagcaagaaaaaagaggcttcctttcggaaacctctcttattattttatttttcaaaactgaaaattatactttcataatttcagcttcttttgtcttaagatgctcatcacaaagcttaacatatttatctgtatacgtctggatttcttcttccacacctttgataacgtcttcagaaactccatccagttttttaagttctttcaaaccatcctgtcttgcgtttcttactgtaactttagtttgttctgcttcagcttttgcctgctttgcaagctcttttcttctttcctctgtcaaaggcggaacgttaaggatgatattttctccgttgttggaaggtgcaaaacctaagttggaattgatgatcgctttttcaatcgcattgattgcagttctgtcccaaggttgaatagagatggtcatggcatccggaatagaaacattcgcaacctggttgataggagtcatagccccgtaatattctaccattacatcctgaaccattgttgtagaagcacgtcccgctctgattctttgaaatgcgtgatccaggtgctttacagctgcatccatgtcttgttttacagattctaatataagatctaattcttccattattatagtatagtttgataaattacacatctattaatcagtctgaatactcattaaagccaaaaaaacctgtaaacatcagtgtttctcattacttctaatgattttttactattcagtgctgcaaaaataatgattgttttcgatattttggtaagacagcattctgtattttgtaaaacgttgatatttttaaaaatgacggtatataaaattattttattaccagtcgttacttgtttcttgttttggtcatgtggatttaagttgtgcaattagggagatgattttttaatgagttttttgttttgtatcctgccaagtattattattttaatcttcaatcaattccaaaacatttctttgcacttaaaggaaaagaattaactttgaaataaaacaaactaatggaaaatattgaagctaaattagacattattgaaaaatggttttctgtcccttcaaaaaaacttattaatgtttacaacattgtaaaagaaaaaggcattatgagttccgaggattaccaacaaattactgatattggaatcccgattattaacaaactatcaaatgctacaggtttatcaattgagaaagtacgcactacaataatacaaaaaggaatttcctttaattatttccatgaggcaataatatcttactctgaattctgtacaaaagaaaaataaaataaagccccaattaaggggcagtttttattctataaaatcaacaaactcgatattacttgtgtttaaaattttacttttaccttcaataatttcatgtagatgttttattgggatagcaataccataacctaagtcatcataatcatcttttaaaccaggaagattagttgctattccgactacattgcctttgttatttataattggcccaccactattgccgcctttaattttagctgtaattaacataagatcttgtctaatccatagatcttctgataaggacgcaatagtcccaacagaaggagtgaatcgtgagcttattgttgctttttctgcggtcataaaagtatgaaagcctatcacctttggaaaaccaagtgctaaaacctcatctaatacttgaccttcttcagtttcaataagagtaaaatcttgatcgaatccttgtggaaatttaataaacattaaatcaattttttcattttcgtgaaccagaaactctgatgcttcaagtacttcctttgggatatctttaatggatagttttttcgcatgctcaacacaatgcttagcagtagcaattccgtcatgaaataagaaacatgttccaattccagggtctttatctaagtaatgacatattgggcgtacgatgtccttgtagctttggtttatatatttaaaaccataaactaaacagttcaatctttcattgactatgttttttagagtttcatttctaaaaagttttccctccccatcagctggtagataaatatatgtatcatcaaaattgtgaggagtatctttaacaacaactgataaatatttatttttaacaagtatctcacatattccggcaatacttgaaaagggaggcatttcatcaggattatattttgaatggtagtattggcaaaattttacaattgttcttctttcattattttccacagttcggccaatatcatggtgtgcagaaaagtactctaagatttcaataagcaaattttcgtacttgtaggggtattggtcaaattctatcatcttttttggttttagtttcccacaaatataacaaaaagccctctcaaagagaaggctgtagatctaaattcttgaatgtttaagagtaaattttttgaacctacttccatacacaaactttaggtgatcacaacattcatataaaaatttgttatcatcatcccattcatcttctgggcctaattgtaaaaaaccatagatttttccacctacatctgaaacatgtaaataatgtttcgtttcattaccatttttaatggttctatatattatcatttaaacaattccccactgttatacgggtactatctctaatataatgattttacttttgaaccacaactaattataaagttttttatattttttttgcatgaactggcatctcttacttgagctccatatagatttgtccgcttatcttttcttgaaaaaaggatttttttctattctttttaagcaaggaatcgggtagaaatacctacaggatatttcggttatttctactctgtgagatatcattttttctggcttcctttacaatgtctttttaaagatgattcttgaggctcttccatggatacctccatgatcaacagagagtcttgaagaagacaatatttaatgattataaactaatttaaaccagacacatcatgacaaatccatctttagacgcataccaacaggtttttgcaatgtcaggtcttgccaatcgtgccggaggctacaatggtaccggcaccgaattacagcaacagcttcagtatgacctatctttttatttcaacaatgttcctcctgttaaaataatgaatcagactacaccatcaacagctgatccttcagttactccggtattgggagactggaatcttgtttggggccctgctctgattgaagaaaccgacgaaaatggcaaacctacaggggttgcagataatgctttgtatgtagctcaatgtgacacagtcgcatttccgggagggcctgcagttcctgcctacgttgtggctatcgcagctaccaatccatcctccctttacgactgggaaacagaagatttttcagtatccgaggtggtcaactggacgacgtatgatccttccaattttacaccatcaccgtataatggaactgatccctatatttcaaaaggaaccgctaccggtgtaggtatactcctcggacttataagcccggatacggccgcatcacctaataccacactccagcagtttcttgccggtttaaatccggatccggatacagccattattttttgcggacacagccttgcaggagcattatcacctacccttgccctctatctgaaagagaataaagatcttgatgctttcgggataacactggtatatcctactgccggacctactccgggtgaggcagcgtttgcaagcctgttcaatactacatttccaccgttacctgccggatggcaggcccagacaggagattatcagagctggaacaccatgcactggaacgatctggatgtggtaccacatgcctggccggcagcagatctggaagagattgcaacgatatacggcaaatctcctgacaggcttactgcctttacactagataccttacagaatattgctcttgctgatgcttccctgtcaggtgtaacctatacaaggatacaaaaccagtcactcccaggtaaacttcagaactcggatgggcctggtgtcagcatcaatacaccaccccagtctttgtatgattatatgtaccagttatttttgcagcacgtagatatgtactcgggtatcccttcctttggtcctggttatcctcaggtaaacggccttattctgcaacagccattgccccagcctcagcagatgaagctggtaccgggagtaactgctgttacaaaatttgagatgattatgaaaataatcaatcagatcatcggctggatttctcttcgttacgcggcaacccagggaatcactcaacagaacgttgaagtgaatgaataattaaaattataacttaaaccaaaaacacctgtcaaagctaggtcgccatgacaggtgtttttatattattctattgatacaggctgattataaatcaacaagagtacctacattttcaccatctacaattttttctaaatttccatctttattcatatcgaatacaatgattggtaatttattttcgtgactcaaagtaaatgcagtcatatccattactttaaggtttttctcaaatacttcatcaaaagataatgaattgtattttacagcatctgcattcttttcaggatcactgtcgtagattccgtcaactcttgttcctttcaggatcacatcagcaccgatttcgatagctcttaatgtagcagccgtatcagttgtaaaataagggtttcctgttcctgcgccgaagattactactcttcctttttcaaggtgtcttaccgctcttcttttgatgaaaggttccgctactttgtccatttcgatcgcagactgaagtcttgttttgattcctgcatcttccagtgctccctgtaaagccatcccgttgattacagtggccagcattcccatataatctccctgtactctgtccattccttttgctgctcctgcaacaccgcggaaaatatttcctcctccgattacgatcgccacttcacatcctttgtcaactacttttttgatctctgcagcatacttctgcagtctttcattgtcaataccgtattgtctgtttcccattaaggcctcaccgctcagtttcagaaggattcttttatatttcatcttttatttttaataactttttattagtactggtttcccaggaatttgattttgcaaatataatcattaaaaatgttgataaaagaaaaatatttaaatagaaataatgtaagaaatattttgaaaagtacgaaaaaggattatttttgcattaattataaattgaattgaagaaaattatcattttttcattatttctatcaggaattgtttcttatgcgcaaacaggaacaaatgtttatccgttcttaaatgtacctgtatctgcaagacaagctgccctgggcggtgatgcaatttcagtaagagattatgatgtttcctttgctattgcaaaccctgccctgttaaataaagattctgataaacagctttctgtaaatgcaacggcataccttgccgattcgaaatacggaacgattgcttatgccaaagactttgaaaatggccatatggcgaccatcaatgcaaggtatatgagctatggaagtattccgagaacggatgaaagcggtttcgaaaacggagaatttaaggcttctgatgtcgctattggtgcaggctatgcctaccagtttgaagaagactggactattggtggaggacttaattttattacctcaaaaattgataattatacttcttccgccatctccggaacagcgggagttacctatcataataaaaagaacaaagaggttgtttcattggtgatgagaaactttggctttcagctgaaatctttcaatggaacaagagaaaaccttcctttcagagtagatctgggatacaccagaaccatcaagaacttccctcttgccattactattacggcacatgaccttcagaagtttgatatttcttcagaagaaaatctggacgggcaaaaagtgggtaccggaagaaagattgccgatcacttttcattgggagcagaattgttcccggaaaagaacttcaatatcagactgggatataatgtaaaaagaggaaatgagctggcggtggcagatcagagaaacttctcaggcctttctgcaggatttggagtcaaagtgtccagattccgtatagattatgcgcacgttagatatcacaactcttcaaatgtcaatcagataggaatttctatggacctttccagccacagaggagaataatcttcaggcctgaaatttcttaattattccgaaatttttttacttcttcttgatttttaagaaaaaatcttgaaatttgcagtatgaaaaaacctgtaattgctatcgatgggtactcgtctaccggaaaaagttctatctctaaaatcattgctgatcaactgggacttattcatatggatacaggagcgctttacagaggagttacctggtatgctttgcagcattgtgtgaatgaaaacggtgaaattgatctgaatacactgttctcttcttttgaccggattaaacttgaatttaaaaacaacgacggcacactgattctttttcttaatgattctgatatctccaaagaaatccgtaccaacatcgtatccgataatgtaagtcttgtggccaaacaaaaagaagtaagagacttcttgctacagtcacagcgcactttggcagaaaaaggaggtgttattatggacggacgtgacatagggacagtagttctgccaaatgcggactataaattctttcttactgccagcatcgatgaaagaaccaacagaagatttctggagctgaaaggcctgggcatagaagctgataaagaacaggtaaaacaaaaccttatagaacgcgacaagatcgacagtgagcgtgagatagccccattgaagcaggctgaagacgccattgttatagataattctgaactgaccaaggacgaaaccatagcccttattttatctcacatcaaaaagatttaacaatttttaataggcttaaagcctcctttggtatacaaattgtaagttttattactgtaaaaactaatctattattaattattaaaaaacttaaaatgtctagaaaaggaaataatacagcaggtatattggcaggacttcttgcaggtgctgcggcaggtgtaatcttaggaatgttatacgcaccggaagaaggtaaagaaaccagaaaaaaaattaaaactaaggctaatgatctaaaagatcaggcaaaaaataaatacggagaggtttctgaaaaagtaaaggaccagtacagcaatatttcttctactttcaaggaaactgctagcagcgtagcacatactgtgaaagacggatatgataaatacaaggatcagattgtttccaaaactgcagatttggcaaaagatgtggaagcagaactgaatgacctaaaaaaataagtaatttatctttttaaataaattacgggaaggaacttttgtgcgaaagttcctttttttgtaactttaaaaaaaaacaatgatagaaactattaaagaatacgcctccaagagaatagatcttctgaaaattgaagcgactgaaaagtcgtctctgtctgccgggctcattacttactttgtagtactgcttgttgcttttgctttttttattatccttttcaattttggaattgccttccttatcggaaaagcactggataattactcttacggattcttaattgttgcagggttttatgctttggtaatggcatttgttgttgcattcaaaggtaaaattgtcaacacggttgcagatcaggttattaaatttttaaatcattaaactatgggcagaaaatacgagagcatagaagaattaagaagaaagaaaaaactgcttcaaagtgaaataagtgatctggaaaatcttcttaccttcaaaaatacgaaggaaagcctgagtgcatttaccaatggcttaagcgaccagtatcttcaggaaaaaatagatgaagacggtgatgaaaaagtagttctcagaaaggatgtcattgccaaacagcttacttcagaggtaaaagaccttttgatcagcaaaaatacagctgtaggaattgcaagctccgcgttcaaaggaggaaacattacagacagccttgttaagctgggagttactgctatcgtaggaaactatgccaaaaaaaatatgaaaagctccaactggaagaaaaaactgattggcgcagctctgatttacctggctccaatagcactgaaatatgtcagaaaaaagattgaggtctatcagaaaaataaaagtgtttcaagtatggaacagcttatatagatgctagaaaccagaggttagaaaatatcagaaagtgatgtacactaatttctaacctctggtttcccgtttctatttcgaaaacagctgacctaaaataatccctgcagccattgatacattcaggctttctgtagactgggattttccaaatctcggaatactgatacttttctgcaaaagcttctccgtttccggtctcattccatttccttcgtttcctaagatcaggttgattttctccggtttctcaaaagtatagatattctccccttccatatctgttccgatgtttacattttctgttttggaaagatattccacaagatcagtatataccacattcaccctggtaaaagaacccatggttgcctgaattactttcgggttgtatacatctacagtatcttcactgcaaataatctgctcaatcccgaaccagtctgccagacgtatgatagttcctaaatttcccggatcctgtataccgtccaaaaccaactgtatattcttatctgccagttttttttcctcagcaagataacataccgcaacggaatcttttggagttttaaggaaactgattttttttaattcattttcagagatatgagtaacaggcatgtcagtacggtccaatttttgtggatcggttgacaatatttctttaactttaaagttagaattaaaaagttcacaaatgattttattaccttcaaccaaaaacaaattgtatttttgtctgaacttctttttatctaaagattgtaaaacttttattgtatgagctgtaagcattataagaattctcctcaaaaatattataaaattatctcatttgcaacatttgttggtctcctttatgcttgtagtactacgaaaaaagttcctgatggcgaatacctgcttaccaagaacactttagagttcgaagataagaaagtgtttttcgatgaggagctcaaggactacattcagcagaagcctaataaaaagcaattccttttcatgccattaagtctccttctgtataatatggctgatccgaaatacgacactatacttaatgaatatatgacctatcccggcgagatgagaaatcagaaactgagagactctttattccttaaatataatatgaagagcagcgttggaaaaagccttcttttcgaccgcttactgcacaattggggaacaccgcctgtgattcttgatcagtccagaagtgaaaaaagcgctgaatctattaagaaaagacttacctacagaggatattgggatgcagatgtaaaattcaagcataatttggactccgcatctaaaaaagcatctgttaattattttgtcagacataatgatcctacacgcatcaaggattattactacaatatcccggatcaggggattaaaggatactacaagtctttcctgaacaaaagtcttataagatccggacagattcttgaccagaccgttcttgaaagagaagtaacaagaattaccgatatgatgagggagtttgggtattatcgattcaatgcctccaatgacgaagtttattttgtagcggattctcttaaaagcaggaaacaggttcctttaacaatggaaattcataaggactcgctggataccccctataagattgctacttttgggaatattgatgttgccattgtggatgaacccggtgattatcctaaaaatacaaaaaaagacagcttaaggagaataagattccatacggtgaatgataaatataaaatttcatccatttggagagctattattccggacagtaaaaaagtctttgaccaatctaaactggatgtcaccaaaagaaatcttttggcgatgaacaactttagtatcgttaaagcaagagactctctgagacaaggtggaatgtcctcacctaacgacagcattgttgatcttttatatgtactgaaaccacttcctaaatatgaactgaaagtgggaacagatattaattattcccaggtgctgaatctggggatctctccttctgttgaccttactacccgaaatgttttcagaggtgcggaaaacctttctaccagcctttccggaacgttcggatctataagaagtacgaaggatatcagcaaaagagtggctgcgtatgaaatatcaacacaggcctcattgaatttcccgagactgctgctgccgtttaattattacaaactgattccgaaacgatatactcctacttcttctattttgcttggagcatcaatccagaataatattggtctgggaaggttaattttcaatacagggcttaattatcaggcaagtgtaaatgaccaggtatatcataagcttacgttatttaatactcaggtcagccttacaaagaataaagatgcctactacgattattttgtgaatgacggaagagtaaaagatgaagttttcgggaattatttcatgttcaatgcagaaacagcacaggtcggccaggattacaaagatggaaaactgagtgtagatgaagtttccaaacagattatcgataatgaagcttaccgtgcaagtcttaaccagcagggcacagatctgctgacagccttcagaggaactttggtcaataaagacaggcagacacaggatgtccttatttcttccatgatctataactttgtttatagtgaaatcggaaaaaaagaatatccaaatgcattttatttcaacgggaaagttgagcttgcgggtaatatcctaagcatattcaataaaaaagacaacagcggaggtgtggttaccggtccgcaaagaactattttcggactgccatatgcgcagtttgtgaaatttgacattgatacaaggaaatatttcagatttaacgggaaccagacattagttcttcgccagtttatcggagtaggaataccatatggaaactcccaggatatgcctattatcaaatcttatttcaacggaggttccaacgatatcagagcctgggtagccttcggaggattgggtcctgcagattctcaggtggatgaaagagttcgtacctatatgacggacaacttaaagcttaccaccaatattgagtacagaattccgtttaataagacgtatgaaggagctttatttacggatatcgggaatacctggagtcttcgtaactacaatgacgggtatggcgatgagtttaaattcagcaagttctggaaacaggtaggtatcggaagcgggttcggattaaggttaaacattgcttatgttactgcaagaatcgaccttgcctacaagatctatgatccgaataaacctgaaggtgaccgatggagaatcaaatacatccagcctttcaaaccaacagttaatattgcgttcgggtatcctttctaatccggagaaacgcctaaaataaaatacactacagcaatcacacgggcgaggatttccctcgcctgatttctgtaaaagctttcaggttttgtgacatcctgcgcatcaaatcccaaagcattcatatcattatttctggcaaaaaacaatgctctgaggttatgatatccctgagatacaataatgacatttttctttttataaacatctttacagcgcagaatacttttataggtattgaatcctttcggatcctccacaataatatcttccggaacaccttcctgattcaccagataatttctcatagctcccggctcattgtaccctttgctcttctccccgctcactataatctttttgatctttccgtgatgatatagaagtgctgcagcgtccattcttttggtaaaataaggattggattttcctgatctcattttaggagatgttcccagcaccaaagcgatttctctgggtggtatttttgagattttggtataggtcctcccgttggtaagcccgaaaacccacgcattacacaggcatatcatcagaatccctaattccagtgatataaacccaaggttaaatatgttcttaataactctcaactaagatcaaagttaagctttatttttttacttttcacaatagacatgcaagctaaaatatgtccctgcgcttcctctttttcggtaagatactcattctccagaagttccacttctccctcttccaaagaacattcacagctgccacatattcccgatttgcaggaataaggtaccgggaatttctgaatcagaagctgttgaagaattttatccttgttatcaggaagttgggttgtatatttttttcccagcatggtaaattcaacctctatattttcaataagaggaaattctttttctacgggataaatatcatcattgaattcttcaaaaagctcaaaatgaatgttctttttcggaatcccatggtgatagcatgcattagccagggttttgatcatttctccttttccgcagatcaatacctcgtctaccgcgtcccagatggtagattcttcatcagtatcatccaaatggagaatctgattaataataagattcagtttcttctcatccagccggccataaaaaaactgatcatcaattttctcctgtgaaaaaaagtaaaaaatctgaagcctgtcaccacatgttctggcaaggttatccaattgatcgcggtacacaagatcatccgaacttttatttccaaagaataaaaacaaacgggttctgggctcgttgtgtaggatatttttaaagtggcttaaaataggagtaatcccgattcctgctgcaaaagcaacaatagttctgaattcgcttggcttggagaccagtgtgaatcttcccgccggctcacttacccatagaatgtcacccatattgtagttttgaaacaactgggatgtagctccttcagaagagttgatctttattcccaggcttatttttccttcataaggtgctgaagtcattgaataatcattaataacctctttcccatgtgactgaaatcttatactgacatactgccctgcttcaaatctgaaattttcctttacattctctggaatatcaaactccagagaaaaagtatttttggtcagctgttcctttttcgctatttttaacggatgaaactgtatcagtttccctttatagatttgttgttccataacttcatttcaaaaatagataaaaaataatttatgaagaagataattttatccacgttacttcttactgcactgtacagctgtaaaaaagaaggtcagaaaactgaaaatacggctgctgcagattctctttctgtatctcaaaccacagaagctgaaggaagtactgttcttcccaaagaactttccccggaaaatgtaagccagcatctggcaaaaaataatgacactttatatgttaccaatttctttgcaacctggtgtggtccgtgtatgagagaaattccaagttttaaaaataaaatggaggaattaaaaggaaaacctgtaaagttcacctttgtaaaccttgatgataaggctgaatgggccggtgctgttaaaaattttgctgcagaaaacaaactgggaagcagtattatcttgctggacggacaaaaattagatcaaaacttcttccataacaacttcaaacaatgggacggaggttctattccttttactttcatgagaaaaggtgataaaactgatgaatatcttggaatgatgacggaagatgtcctgaattcaaaaatcgattctttcttaaaataaaatagactgaacgctttctgaatcatgtcaaaaagatttaaaatcctgtgtttattatttgtgatcgctattattatcagtgctgtcattaatatgaacacaggatttttaagtttaagtttcggggatttttttcaggattcagctcataaccaaattgctgagatccgcatcaaccgtgttctggttatgatgctggccggaatttcaattcctacttcaggttttctgatgcaggaatattttcaaaatccattggcaggacctgatatactgggaataacatcagtcgccagtttatcggtcgctttttatatttttttctcccataatattctgctgcctgagtttttacagaatagcttcctgagtttatcggcgattggtggaagtttactgctgatgctgatattactgtctatgtccaatagatttcaggataaatcataccttattattttcgggtttcttgtatctgcctttgctggtgctattgtgtcgctgcttcagttttatgcggaaaatcaaagtcttaaaaactatattttatggtctttcggagcgaataatatggtgaccagaaaccagatttatgtattatctgtccttgttttcatcggtatgttcatctgttttaaggctataaagccacttatcgggaattctctcggcaattcttatgcacaaagtttaggggtaaacctgaagcagcttaagcttttaattataattgcatcctctctcctatccgcttctattactgcatttctgggacctatcttatttatcggaatcattgttcctcacttctgcagattggtttataacccatccagactatggcagcaatggattcttaatatgtttctgggaatgctgatcatgctgcttttctccgtcattgcagaaaaaacacagattcctttgaatgtgataagctctgtttttggaattcctgtgattctgatgatgctattgaaacagaataaagtgtgatttttttgtttgataaacgcaaaggcgcaaaaacttttaaaaaccttatatttttaagacgcaaagattttatctccgataaaattgagcaatgcatattttaattcacaaaaaaattaccccatccttgccgaaaatcttcgattttctcgcgccttacacaaaatatcaaaagcctttgcgccttctcgcttacccgacattttgcatcaataagcaactattcatatatttaagtccaacaaaacgacacaaatgacagaaaatgaaatttcaaaaattgtttttgaaacaggtttaaagatccatagaaaaattggtgcgggattatttgagcatgtttatgaagaatgtttattttatgaattaacaaaatcaggttttctggtagaaagacaaaaattgcttccaatcatttatgaagatttaaaaatagacaatgcttttaaacttgatctactgattgaaaataaagtaattctggaaataaaaacagttgagtacatatcacctgctcataaagcacaacttttgacttacttaagaatgacaaactgtaaattggggctattactcaattttcaatccgatgttttcaaacacggagtaacaagaattgtaaacaatttataaaataaaacaggataaaaatttgacaaagtcaaattcattgcgccttaaaacattatttttgtaaaataatttgcgccttcgcgtgtaaccaacaaaagtatgcacctacagatcaaacaggcagatatcggctacaatacaactttaatttctaatgccaatgcggatttaaagcttggtgatgtatgcctgctgattggtaataatggtgtaggaaaaacaacgcttatcaagtctattcttcaccagcttcctttactggatggtgaaatctctattaatggcaaaaatgtgaagactctttcggtaaaggaaattgcagaaaacattgccatcgttttttcaaagtctgtaataccgcagcattatacagttgaggacctcatttccctgggaaagtacatttactatcctttttattttgaattaacaaaacaagaccgcgaagaagttgcctatattattgaagaactggacttaaatcaataccgatatacgcttcttaaaaacctctcagacggaaatctgcagaaagcatttatcggccgtgccattacccaaaactcgcctgtcattattctggatgagccaacaacccatctggatgaaaaaaacaaaatcatcattcttaaaaccctgagaaaactggccaaggatcagaataaacttattctgttttcttctcatgactggcgattagccaaagaatttgcagacaagatctggtatgtaaaagaaaaccatctgtattccgggattgttgaggacattttacttcagcatggtgagcttaccaatgcatccttatttcaaattaatgagacttttattccgcccttcatctcagcaccacagtttcataaggaaatgctgtattctctgctgcaaaaaaacttccaaaaagacctgtctgacctgaattttgaatttcaggacccattttgggtaatcactaaagattctgctcattaccaatgtgaatcttttgaagaaatcactaaattaattccaaacattcattaatactaggttttctttgattaattcacatactatgcatgcatagtattatgctaatcatacaatttaatctatttactatcaggttattaacaaaatttaacgttaataaatattatgcatgcataatatttattaaatttgggtaaaaccattgacgcaaaaatgatggataataataaggaaaaaatagaaaacgtagatttgattttaaagcagacctggctggctgtttcaaaaatgtacacagaattagctcaggaacatgattcaacggctgtacaggcccttactcttcttaaaatagaccctaaagaaggaacccgaagcactaatctcggcccaaagatggctattgagccaacttctttaacgagaatcatcaaacttctggaagataacggatatatctataaggaaaaaacaaccaccgataaaagagaggttatcattaaacttacagataaagggttaaactccagaaatatgtctaaagaagtcgttgtcaactttaacaagaaggtgatggaaaagatatcccctgaaaagatggaaacgttcaaagacgtcatgagcgaaatcatgaaaatagcaaacgaattattaaataacagaaaataaattatgatgaacctttcggttctatctaatcttctcaaaataaaaatttacatatgaaaagaagaatcaaacatgtaacggttcttggttcaggaattatgggaagcggtatcgcagctcacttcgccaacattggtgttgaagtatcactcttggatattgttccttttgaacttactgaagctgaacagaaaaaaggtttgaccaaagatgataaggcagtaagaaacagaattgcttccgaaaactttgaaaaacttaaaaaagcaagtcctgcacttctttattcaccaaagtttgcagacagaatcaaaatcggaaatttcgacgacgatttaccgaaaatcaaaaacacagactggatcattgaagtggtagtagaaaggcttgatattaaaaagtcggtttacgaaaagattgaacagttcagaaaaccgggaacattaatttcctccaatacatccgggattcctattcacctgctgacagaaggcagaagcgaggatttcaaaaaatactttgccggaacgcacttcttcaacccggtaagatatcttcctcttttagagattatccctactaacgatacagatcctgagatcattaatttctatatgaactatggagcaaaatttttaggcaaaacaacggttttggcgaaagatactccggcattcattgccaacagaatcggagttttctctatgatggatcttcttcataatgtacaaaagttaggacttaccgtttctgatgttgataaattaacaggtccggttataggacgtccgaaatctgcgacattcagaacagctgatgtggtaggtcttgatacattggtaatggtagccaacggtgttcgccagagcggtgctgaagccaatgatttcaatgatgtttttgcacttcctgactatatccagaagatgatggataacaagtggctgggttcaaaaacagagcagggattctataaaaaagtgaaaaatgcagaaggaaaatctgaaattcatggattaaaccttgatactttagaatatgaactacaaggaaaatcatcattccctaccctggaattaacaaaatctattgataagccgatagatagattcaaagtgctgatcggtggtaaagataaagccggagaattgtacagaaaatctctgggagcattattcgcttatgtctcgcacaaagttcctgaaatctctgacgaagtttataaaatcgatgatgccatgagagccggtttcggatgggaaaacgggccgttcgaaatctgggatgccgtaggtgttcagaaaggtattgaactggcaaaagatgcaggctatgaagtttcggattgggtaaaaaatgtagaaactttctataaagttaatgatgaaggacaaagtatttatgttgataaaaactcaggagaatacaataaaattcctggtcaggatgctttcatcattttagataatatcagaaaaaataaaacactttggagcaattcaggtgcggctattgaagatttgggagacggaattatcaattttgagatccgttcaaaaatgaactctcttggaggcgaagttcttgacggattaaacagagccattgatttagcagaaaaagaatacgacggattggtcatcggaaaccagggagcaaacttctctgtaggagccaaccttgccatgatccttatgatggctatcgaacaggattgggatgacctgaatatggcgatcgcttatttccagaagtccatgatgagagttcgctactcttctattcctgtggtagttgctcctcacggaatgactttaggtggaggctgtgaaatgacaatgcatgcagacagagtggttgcagccgcagaaacatatatcggactggtagaaaccggagttggggtaatccctggcggtggtggtactaaagaactgactttaagaacctccagagaattccacaacgatgatgttaaaaataacagacttcgtgacgctttcatgaacatcgctatgggtaaagtggctacttcagcctatgaagcttatgatatgggaatccttgagaaaggaaaagacatcgtttccgtaagcaaaaacagacagattgctgaagctaaaaaagtagcgaaactgttagcagaacaaggctatacccaaccaattgaacagaaagtgaaagttttaggtaaagatgcattaggaatgttctatgtaggaacagatcagatgttaaccggaaactatatttctgaacacgataagaaaattgcagataagctagccaacgtaatggtaggtggaaacctgtctgaacctacagttgttacagaacaatatctgctgaaccttgaaagagaaacattccttcagctttgtggagaaagaaaaactctggaaagaattcagtacatgttacagaatggaaaaccgttgagaaactagatttttttgtaaaatgtaaaaagtattaatgtattcacgatgcataattttagagatttagaagtttggtcaaaatcaatgaaactttgtaaaatattttatctggcttcaaacggttttccaaaagatgaaatgttcggattaacttcccagtcaagaagaagtttatattcaattccttctaatatcgctgagggtgcgggcagagatacagatgctcagttttcacatttcttaaatatagcattaggctcttcatttgaatttgaaacccagatattaattgcaaatgatttaggtttctttaaaaatgatgattttaatattattaattcagaaatcaaacatatacaaaatatgttagcaaagttgaagcagaaatttaatacttaaacattttaatcataaatacattttacataaatactttaatacaaaaaaaaaatgaaaacagcatacatagtaaaaggattcagaacagcagtaggaaaagcgccaaaaggctctctgcgttttacacgtcctgatgtgatggcagctaccgttattgaaaaattaatggctgagcttacgcaattagataaaaacagaattgatgaccttatcgtaggaaatgcaatgcctgaagctgaacaagggctgaacgttgcacgtctgatttctctgatgggattaaataccgataaagttccgggagttaccgtaaacagatactgtgcttcaggaagtgaggcgattgccattgcttctgcaaaaattcaggctggcatggcggattgtatcatcgcgggtggtaccgaatcaatgtcatatattccaatgggaggttataagcctgtccctgaaacggatatcgcaaaaacaaaccctgactattactggggaatgggttacactgcagaagaagtggcgaaacaatataagattacaagagaagaacaggaccagtttgcttttgaatctcacatgaaagctttaaaagcgaatcaggaaggcagatttgccaaccagatcgtttcgattcctgtagaatataactttcttgatgaaaatcagaaactacaaactaaaaagtttgatttttcagttgatgaaggtccaagagcagatacttctttagctggcttggcaaaattaagaccagtatttgccaacggaggaagcgtaactgcaggaaactcttctcagatgagtgacggagcagctttcgtaatggtaatgagtgaggaaatggtaaaagaattaggattagagcctgaagcaagattagtagcttacgctgcagccggacttgagccaagaatcatgggaatggggcctatctacgctatcccaaaagcgttgaaacaagcaggtcttgaattaaaagatatcgatttgatcgagcttaacgaagctttcgcctctcagtcagtggctatcaagaaagaattaggtttaaatcctgacattttaaacgtaaacggaggagctatcgcccttggtcacccgcttggatgtacaggaacaaagcttaccgttcagcttcttgatgaaatgagaaagcgtggcaacaaatacggaatggtttctatgtgcgtaggaaccggacagggagcagcttctatttttgaactcctttaatagacaaatagagaatagacggatagataatagacttaaagacaccaaaaatgtatgaatgattttaagaggcacaattttaagaagcttaaaatttggcaaatgagtatggaattatcaagattaactttagatcttacagatacttttccgacttatgaaaagtatggtttgaaaaatcaaatggacagatgtgcaatttcaattccatcaaatatagctgaaggttcaagcaggacaaataagtcttttagtcattttttagatatttctttaggttcttcatttgaattgcaaacacaaatattgttagcaaatcatagaaaatatttatctgatgaaaaaactgaaatctttgaaattaagattgaagaatttcaaaaagcagcaatggtatttcagaatactttaaacaaagactaagaaaaagaataagaggtaatagaacgaaagaaaatagacaaggatgaaagtctatcatctatttgtctattatctaaaggtctcaaaaattaaataacaaaataatatatggctacattaaaaggcggggaattcctgatcaaacaaattcctgcaaacgaaattttcagtattgaagaactgaatgaggagcaaaagatgcttcgtgattcggcaaaagaattcatagacagagaggtagttcctcaaaaagagcgtttcgaaaagaaagattatgcatttacagaagaaacgatgcgtaaactgggagaaatgggaatgttggggattgctgttcctgaagagtacggaggtcttggaatgggatttgtgactacaatgcttgcctgcgattatctttccggaacaacgggttctttggcaacagcttacggagcacataccggaatcggaactcttcctatcgttctttacggaaccgaagagcaaaagaaaaaatatcttccggatttagcaacaggaacaaaattcggagcttactgtctgacagagccggatgcaggttctgatgccaactcaggaaaaacaagagcaaaactttccgaagacggaaaacattatatcatcaatggacagaaaatgtggatctctaatgcaggatttgcagatacatttacattattcgctaaaattgatgatgataaaaatatcacaggatttgtgatcaacaaatctgagcttgaaaaccctgaaagtttaactttcggtgaagaagagcataaattgggtatccgtgcttcatctacacgccaggtgttcttcaatgacatgaagatccctgtagaaaatcttttaggagaaagaaacaatggttttaaaatcgctttaaatgcattgaacgtaggccgtatcaagttagcagcagcgtgtcttgatgcacagagaagaatcttaaaccactctatccagtattctaacgaaagaaagcagtttggtgtatccatttccacattcggggctatcagaaagaaaattgctgaaatggcaaccggagtgtttgtaagtgaggctggttcttacagagctgctaaaaatattcaggataaaattgatgagttggtagcagccggattaagccaccaggaagcagaattaaaaggcgttgaagaattcgctgtagaatgttcaatcctgaaggtatttgtgtctgaccttgctcagcatactgcagatgaaggaattcaggtatacggagggatgggattctctgaagatacacctatggaagcagcatggagagactcaagaatttcaaggatttatgaagggacaaacgaaatcaacagattattagctgtagggatgcttattaagagagcaatgaaaggtgaattagacctgttgtctcctgcaatggccatcagcaaagaattgatgggtattccttcatttgaagttcctgattactcagaattcatgagtgaggaaaaagcaattatcgcaaatcttaagaaagtattcttaatggtttccggagctgctcttcagaaatatatgatggatattgagaaacaacagcatttattattgaatgcctctgaaatcctgaaccagatctatatggcagaatctgcagtgttaagagcagagaaacatttctctcctgattctgtagaagcagctatggctcagctgaacctttacaaagctgttgagaagattatcactgctgctaaagaaggaattgtgtctttcgccgaaggagacgagcagagaatgatgctttcaggattaagaagattcacgaagtataccaaccatccgaatgtagtagctttaaccgaaaaaattgctgctcattatattgaaaaaggatcttattagtctttaataacataaatttgattcagcgtcccaaaattgggacgctttttcttttcacccctatttattatgattatcattggatttattaacaatcattaaatacattcaaaaaaaatcattatttttattctaaattaaataacacatgaaaatcttattatttccgatattccttatttcagtggctttctcagcacaaaaaaaagaagatgtaatccctgttcctaaagttgatacgacaaaaatcgtttctaaaagaaaattccccgggtattttgctgtaaaacctgagcttcctcaaaaagaactttataaaatattagcagttaaacctaaagatactaccctttatctcgctttaaaagaaccagcaaaagattactctcaatataaaattctgaatgccattacaagggaaaaactcgatataaatccgaaaaaaacaacacaatcgaaataaaacaacacaaactaaaaactattatcatgggaaaatttattatctctaaacgatcaaacggtgactttcaattcaaccttaaagcaggaaacggacaggttattttaaccagccagggatacagcaccaaaccttcatgcgaaaacggaattacatcggtaaaaaccaacgctcaggaagattcaaaatttgaaagaaacacagccaatgatggcagatgttattttaatctgaaagcaggaaacggacagatcataggaaccagccagatgtatgaatctgataatggtatggaaaacggaatagaatctgtaaaaaacaacgctccgcatgctcacatagaggatgaaactacgatgtaaaaatcatctgaaatattatggataaaaatgccttagtttttaaggcattttttatttttgtactctatttttcattaaaaatgacaaaagaagaattactgaataaagcaatcaaaatcgccgataaggctcataaaggacaaaccgataaataccatgctccatacattgcccatgtaatgcgtgtgatgaactatggtaagacactggatgaaaaaatcgtaggggtactgcatgatgtggtagaagaccacccacaggaattcagtctggattatttgagatcggaagggtttccagaatatattatcttcgccattagctgccttacaaagctggatccagaagaagattatgacgaatttatcaaaagaacagaaagatctctcctttccgttgccgtaaaactgaatgaccttcgtgacaatatggaccttagaagagtaaaccgagagcttactcctaaggatatcaaaagattcaataaatatctgaaagcctatcgttatctgatagagaaatattaatctgctcctgggaaatcgtaagttttcgtgtggtggtctgttccgtcaatgttaatgtttaatgccaggtaaataaaatgtaaatttttatttccttttgcttcgaattcacgctgccacagatatccgcttacaacaccaaaataatcatcgatctgatagccgaaaccgccatagactctgtttctggcgaaagtaggcttcatcggagagacaaagaaaacttcgtcataagcgttggcaaaaacagttcctttctttatggttttggcatttagagggacactgatattcaggcgatacctgtaacgcattctctgagatgtctgatctgttttaggctcatagaaccagcttttttcagcacggagtcggttttcaaactttacgatgccttttttaagatcaataacatcctgaagccatactcggaattcttccctgcttaaactatgatccttataattaacataccttccaagtcctacgaaaggtttgtgatttttagtaagattatatcctactcctccttttatttcataataatcagggtaagtataatcttcattaccacgtagctgtccttctgcatacaggaaaaatttaggatgaaacttataggtcagagttactgcgttgaagctggaaatatgttcctgtgctttaaagaaagaaattccaagtagtaagcctaagcctataaaacgtttcataaaaaatttttgcaaatgtaaattttttaacaatttgttaatattaactttaattaatattgaattaacagctacttaatattaattgtataagaaaatccgatgtggaaccatctttgaggcattgccactccaaatgcttcggtataatttgtattggtaagattgttaaccaacacataaacagagtaatctttaccggaaaaactcagtttttcatctacaagattataagttcccagatttaccctttcattataacggtaaacaagctcattggtaaagtttttaaggaatctgacctctagcttagaaataaactgatgcttcagattatccagaatataccttgaaaccaggccttctttttcttcatatttactgtcgatatacgtatatccaaccgtatatttcagccagtctaccggtctgtggctccactctgcttctattcctttggttttaatatctcctacgttctgggcaaaccatactttatcactgatgtcatttttcacccagtcaatagaattgctggaatttcttagaaatccactgattttagctaaaatcctgttgttttgatattgatagcctacctcagaagaaaccgcattttcaggctgcaaatcagggtttccctgttctgttctgctgacataatacagttcggtaaaggttggtatacgatgtactttcgcaatatttccgtagattttattattggcattaaagatatatcctacatccagccccggataaaagaaattaccttccttggagtaattggcccacgaaatccccggactgatattcagttttttgtcaagtaatgaaaaatgatgttcaaagaaaacctgggaaacaaaacggtttctgtctcctaaattactgcttgccagaaactcttttctaagctcaactccaactccggttgttcccagtccccattggtagctggaattcacttctccacctacgttatttccgatatgcatatttctgtaaaagtcaggatcccatctgttgtaaagatacatatcctgccctcttctccaatacacatttgaattaagtttaagctttccgaaagtctgctggtgggccacacttacaatagaagcctgtgtttcctcatactgttttgtagcactactcgaagcataaaaaccattggctccgaatttcttttctgaaaaaccggcctgtactcttacatctccgtttttaatattcaactttccctggtaaaatacattcctgatttcgtaatccgtattgaacatatagccttctgaagaagcagaattggcctgaatagcattggtaaacttctcatttcccacctgcgcattaaatccaagaccatacgaaccgtaatctcctccttctgcactgatcttcactttttttcccggagtagttttcgtaatgatgttaataactccggcataagcattctgcccgaaacgtcttgctgccgggccttttatcacttctattttctctacatcatccaggtctaccggaatattcatattattatggccggtctgggaatcattcatcctgatcccatttaacaacagaagaacctgttcaaaagagcttccacggaaaccgatatcactctgcacaccattggctcctctcctcctgatatccattcccggcacctgctgaagaatttcatcaatacttttggcaggagaatttacgatatcttctctggtgataacactaatgttctggttggcgcttttataaggtgtagagatgaattttccctgaaattcaatgctttcaatatctgttgtcttttcctgtgcattcacccaaagtaaagatcccagaaaaaaagcacttcctatctttttgatcataatcgtttccgtagttttttaacaggtccaaaagtaagagagttcaccaagacaggcaaatgatagttgtcataaaaaaagatgcaacatcatgctgcatctgtgtgagggagtaatttctatctttttctcattaaatgtgtaactagatctctgaataattttctcatttctatattacatatttacgggtacaattttaaataattttataatataaaacaatagttaaacaaaaaaaatacaacgtattaaaaaaaattaagtaaaataccttaaattaaacattaaaatagaagcaagtccacaaaacatactttttcttgttgtttattgaaaagaatatttcgattttagtactctaatttaacattcattataacaatttttaacaataagatatacatcagattttcgctaaaatttcgtaattttgttggtcttaattttacgatgaaaacattctttttcaactggatattgaaacagcaatcttaacaaaatgctgctgtgaaacgacagaagaattcaggaatatattcaatgtttcaattgatgacagccccggtatatgctgaggcaatacaccattattctgacagccttattgctgtacagatactttagaataaacaaaatatggctaacacaacagaaatagacataaaaaaacagatcttcgttaagaatgcacatcttaacaatctgaaacatatagacgtcctgatcccgaaaaacaaactgatcgttattaccggggtttcaggaagcggtaaatcatctttggcttttgataccatttatgcagaaggacagagaagatatgttgaaagtttaagttcttatgcccgtcagtttttggggaaattagaaaaaccaaaagtagacgacatcaaagggctggcaccatctattgcaattcagcagaaagtaatatcgtccaatcctcgttctactgtaggaacttctacagagatctatgattatatgaagcttttatttgcaaggatcggaaaaactttttctcccgtttccggagaagaagtaaaaaaagattccgtttcggatgtggtagattttattaaagcatccaaaaaagacagttcttttctattgacagcgccactggaatatgataccgacaattttaaggagactttaaatgttttaaaactggctggtttcacaagacttgaaatcaatggaaatgtagcaggtattgaagatctggaaagttttggttttaccccggaaaaaggcatgaccattaatcttgtgattgaccgtttctcatatgaagaagatgaaagctttttacaaaggcttgcagattccattcagatggcattttatgaagggcgtggctattgcgcattgaagaacacagataccggaaaggtgaaagagttttccaataagttcgagctggacggaatggaattccttgaacccaatgtccactttttcagttttaataatccttacggagcctgtccggcatgtgagggatacggaaaggtaatcggaattgatgaagatcttgttgttcctaacaaaacactgtccatttacgaagatgctgtggtatgctggagaggagaaaccatgagtgaatggaaaaaggatttcatcaaaaaagcgggtgacttccctattcacaaaccttatcaccagttaacaaaagaacagaaaaacttcctttggaaaggtgacggaaggagtaatttcccatgcatcaataatttcttcaaaatgcttgaagaaaacctctataaaatccagtacagggtaatgctttcccgctacagaggaaaaaccctttgtccgacgtgtgaaggattgagacttcgtgaagaaacaagctgggtaaaagtagacggacataatatccagtcgatgatcgaacttcctctggatgaactcgctccgctaatcaatgggctcaagctttcagaacatgataaagaggttgcaaaacgattattgtatgaaattacaacccgcctggaatttttattaaaggtaggattagggtatttgaccttaaacaggacttccaatacgctttcaggaggagagagtcagagaatcaacctcgcaacaagcttaggaagttctttggttggttctatttatattctggatgaaccttctatcggactgcattccaaagacactgaaaacctcatcgaagtattgaaaaaccttcgtgaccttggaaatactgttattgtagtagaacatgatgaagatgtgatgagggctgcagattacattattgatattggtccggaggccggttatcttggcggagagctggtattttccggagattataaagacctgaaaaaagccaacactcttacttcagaataccttacaggaagactggaaattgaagtcccgcaaaaacgcagaaaagcaaaagaatggattcacattaaaggggcccgtcagaataaccttaaaaatattgatgtagatgttcctttggaaaatcttgttgtaatctcgggagtttcaggaagcggaaaatctactttgatgaaagagattcttaccaatgatattcagattcagctgggaatgggtggtaaaaaaggagactacgattctgtagaattcccgaaaaaactgattaaaaacatcgaattgatagaccagaatccgattggaaaatcatcccgttcaaacccggtaacatatctgaaagcttatgatgatatcagagatctttttgctaaacagaaagtagccaaaatgatgggttacaaacctaaacatttctctttcaacgtagatggcggaagatgtgacgaatgtaagggagaaggcgtgatcaacgtttccatgcagtttatggcagatatcgaacttgaatgtgaggtttgtaagggaacacgattcaaaaatgagattctcgaagtgaagtttgatgagaaaaatatctcagatatccttcatatgaccgtagatgaagcgttggaattctttaaagataacaatgaagaaaaaatcgtaacgaagctgaaacctcttcaggaagtaggtttaggttatctccaattgggacaaagctcttctaccctttccggaggtgaggctcagcgtgtgaagctggcttcgttccttgtaaaaggagtaacaacagacaaaacgttattcatctttgatgagccttctacaggtcttcatttccatgatattcaaaagttattgaaatcattacaggcactgatcgatcttggacactcagtgattgttattgagcatcaacctgatatcattaaatgtgccgactatattattgacatcggccctgaagcaggaaagcatggtggagaagttgttttcgcaggaacccctgaagatcttactaaaaacaaaaaatcctacactgcaaaatatatcaaagaaaaacttgaacaataaatacaatcggctgtttttgaaacagccgattttttattcagattctttatctttattaaccattacaaaattatttttatgccctggaatcccgaactatacgaccagtacaaagatgtacgttacaaacctttttacgatttagccgcattaatcaagcctgaaaacaatattaaagcgattgacttaggctgtggcaccggagaacaaacttctattctgacagaaaaactgacaggttctgtatttttaggaattgattcatcagcagaaatgcttgaaaaatcgaagaagtacgaaagtgaaaatctgcattttaagctccagaccattgaagaagcagcacaatctggtcagaagtgggatcttgttttcagtaatgccgctttgcagtgggtggatgatcatgaaaatttatttcctaaaatcattgaactcttatcaccagaaggtcagctagccatccagatgcctgtccagaatgaaaatatactgaatcagatcctggcgcagatggctgatgaagaaccttatgcatcttatctgaatcatttcaaacgggattccccggtactttccatggatgattatgcacagatattatttgacaacggaatagagaatatagaaatattccagaaggtttatcctattattgcagatgatcacgaagctttatatgcctttatttcaggaactgcattattgccttatcttgaacgtctggaaggagaacagaaagaaactttcatcatcgaatttaaatcccgtatcgcacaaagatttacaaaatatcctgccatttatgcatttaagcgtattctgatgtacggacgtaagaaataaaaaatcttattaaataagctgtcacaattttgtgacagcttattttttagcattctttaatcttcagattgaggttgtttaaacttttatattcattattttaaccgcaaaagttttaaatatttcaatttttaagaaccaaaccttaggtgtacttttctgcggtatcattttaaacgtacttaaatgaacttaagtgttttaaaatgaagccttttgtaacctttgtggtttggtaaagtttaaacaactttattatataaaaacggactcttccgtatataatctgaattttcaatctgagaacccaaaaactcagcaagatccgcagcactgatattctcacccttacaatctgtcaggtttgcttcagttgtgaaattttcatctgtaagattgattaatggtaacctgaccaaagtccagtccagattacttttcagaaggagttcatactctttttgcttatctgctgttgtttcaggatagttttgatacatccattctgtagccatttttactctttcatttttttgatcggataaagtatttacgctcaatccggtagtgacaatataccggcttattccatgtgagttcattgctttaataatatttccggcagcatcactgaagatagacttctctccttttggctggcctaaagtacttattacaagatcagtttccatgatcagtttatggatcgctgcttcatccctcgcatctccttttaccgtttcaattaaaggattctgaaggataaagttttcggggtgtctcagtaaaagcttaagagaatgtcctttttcaagaaggtgttttaccagatattgtccggattttcctgttccgccgataacggcaattttatatgttttcataatgatttttttaatattaaacatcaataatcaaaagcagattaaccacgaatgaccatcgataaagcaaataacatattgtttttgctttgataatgatataataaaggtattgggttcagaagtttgaacctaaaatctcagggatcagaatacaccctgaacaagagtaatatgtattacgagattttaatgaattaaagttacactttttaccattaaaaaatcaaaaaatttatgattttaacaacactttttaaaagataaagtttataactttgataacaaccttactatcaatacattcacccaaaccaaatacaataagaatatggaaccatttactgttaacattcctgaatcggtaataaccgacctgaaaacccgtttacaaaatacgcgatggcctgacgagcttgaaaatgccggctggcattacggaaccaacgaaacctatctgaaagaacttattcaatactggatcaatgattatgactggcggataaatgaactgcagttgaatcaacatcctcagtatacaacacgtatagacggaattctgattcattttcaatacatcaggggaaaaggtcccaatcccaaaccgttaatccttacccatggctggccggatagttactaccgtttccataagatcattccattgcttacagaaggtgagcaaagctttgatttagttattccttccctgccgggatttggattttctgataaaacagcagtcagcagtgaaaaggtagcagatctgtggaaaaaactgatgactgaagtacttggatataaaaaattctgtgctgccggaggagatataggtatgggagttgtaaaatcactgacttcaaaatatcctgaagtcatggaagctgtccatcttacagatgtaggttatccaaccggtcaggaggatccggcaacaatgagtgaagaagaaaagaaatttgcacagtttgtccagcactggtggtatagtgaaggtgcttatgccatggtacagtctaccaaacctcagacgcttgcgtacggtttgaatgactctcccgcagggcttgcaggctggatcataagttttgtgaacgccggcactcctccggaactcatcgaaactgcatttggcggaaaagacgaaatgcttaccaatattatgatttactgggtaacacaaaccataggttcctctgcgagaatgtataaagaagatgcagctgctttatggaacggaactcaggttcatcaaaaaagtaatgttcccgcaggtgtgcttgtatttccccgtgaagctcagtttccaaaagaatgggcagaacggtttgtaaatgtgaccagctttaaaaaaatggatgaaggaggacattttgccgcactggaattacctcatgtatttgcagatgagttaagatcattcttttattctgtcacataaaaatcaaaccatgaaatatcctgtatccattattcttacaattcctttgttggtcacgagctgttctgttcaaaaaaagaagactgaacacaaggattacaaggtacaactggataccttaaccctgtttgaccaaagcagacaccgaaagattcctgttgccatttatcaccctgaaaacaataaaaagattcccaaccaacaggtgattattttcaatcatggatatggccttaataaaggcggagattattttgtttattcttatttaacggaaatgctcgcttcaaagggttatttcacggtaagtattcagcatgaacttgcgacagacaatttaattcctacggaaggaattccgcagatcgtgagaagacccttctggcaaagtggttcggataatattctgtttgtgattaacgaacttaaaaaaacaaaccctgaccttgatttccggcatcttaccttaataggacattccaatggcggtgatatggcagcactgttcagcaatcagcatcctaatatggtgtataagctaatcacaatggataaccggagaatgtttctgccgagaacttccattccaaaaatttatactttacgctccaatgattaccctgcggatcagggtgtattgcctgatgaaggagaacagaaaaaataccatatcacagtgcagcctactctgatcaatcatgatcatatggataataagggaagtgatgaagaaaagcggatcttaaacaattggatcttacaatatctttcagaacagtagtttctgaagatcaccacaagttatccacaaaaaaatgtggataacttgtgaattttaacatttaattcatgtttcgtattgaaattatcactacatttactatgtaataaacatcgaagtggaaactttatttgcttttcttactactattgaaattgcaattaaatttgaaataaaaatttaagcacagcattgtcggctgtgctttttattgttgtctaattaaaaaaatgagatgtattatctactggatctgcctctaaagggcagattcttttatctgtataccttctacaataaagttttttaaaattgatgactctcaaaagcacaataaaacattctcaaacttctctgtaacctgtggttatcttcctcgtttgtattatattaaataatttgtaattttattacccaaaccaggcctcatagttcaatggatagaatagaagtttcctaaactttagatccaggttcgattcctggtggggctacaaaaatattcttaatcacaagtggtaaaaccttcaaataactcataaatcaggcttttaaaacttactttagccagcttgaagttatttgatattattttttctcggaagtctgatctcatgatcctgcggatacggtgcgcgaaaagtcatgctaacgtcttcttttattttttcctgagtctcatatcgtttatcttcatcatgcgaatatctgggatcgggtatgaatggcatttttgccatttttgtgacagtaatggtaggaaaatgaaaatcaacctccacggttcccagaagcagatagcatcccccaccctgaaatgggtatttttccaggcagtccggaaagtgtgccgtatcaaaatagtttccttcaacatctatccaggtcccaaaaaacatggttcctcttttagtaggcacgtgtttccttgcgatcagatatgccaacatcttaacctcgcttttatgatattttatcagatcattagccattatgtgccctttatattttgtctgcaaaaggtcaaaaggagtacaggaaaccgggaaactcagtatttcaatttcatcaaaagcgtcttcaaagacatttcgtttcagttccggaagcttaaaatcctttaccggtgtatcaaataatgtctgcacccggtgctctggtttaaattcacccaataatactctggcttttaacagcagttcatttttgggtattcccgtaaatctaaaggctccgataaatattaagatctggagcgtttcaatacctacaggaattcttttaatgaaatcttccattgacaaataatccccagatttccttctttcttccggaatcaattgggctattttagattcaactttttccagaagcattaatcccaaataaatattatcaccataaatcgttgtttcatattcacttttattaacacatggattaagtatttttcccccggacattttagcctcatgtacatatacttcagtcctgtaaaagcctcccatattattgatggctgaaaccatgaactccaaaggataataaactttaagataaagactttggtagctttcaaccgcatatgatgcagaatgcgctttacagaaagaatatccggcaaaagattctatctgcctgtaaacttccctgcttaattcttcagaatggcccagttctctacatgattcgaagaaatgtttttttactttctgtaagtcttccagtgatctgtacttaccactcatagctcttctgagaatgtcaccatctgcagcagacaatcctccgaaatgtaaagcaatttttattacatcttcctggtaaaccattatcccatatgtttctcccagttcctcttcaaatactttatgaaaatactcaaattgattcggattgttatgcctgaaaatatattctctcatcattccggattgcgccactccaggacgtataattgatgatgccgctaccagtactttgtaattatcacacttcagtcttctcagcagtccccgcattgccggtgactcaatatagaagcagccaatggtccggccttggcttaaaaactcattacagatcttttcatcctttgaaagtgtagtatccttaatatctactttaataccccgtttttcttcaatgagcctaactgtgtccttaatggtaccgagcccacgctgtgaaagaatatcaaacttttcaaatccaagttcttctgccatgtacatatcccattgtacaatcggaaatcctttaggaggcatttccagtgcggtgaagtttgttaatggttcttcagaaattaaaataccacaagcgtgcatacttcgctggttgggaaatttctccagcagttttccgtatatttgaactttctgtacgatttcgtcactgaaaacgctttcaggatttttactcagttcgtccagctcttctttcggtaatccgaacgcttttccaacttcccgtataatcgaacggtatttgaactcaacatttgtcccgcagaatgctacgtagtcttttccatatcggttaaaaatgtaatccaatataatatcccgtttctgccagctccaatcaatatcaaaatctggcggacttttcctgtttaaattaagaaacctctcaaaatataaatcgagttctaatgggcatatgtccgtaattccaatacaataggctacgatactgttagctccactaccacggccaacatgcataaatcccatactattactgtattggataatatcccaggttataagaaagtaaccgctgaaatcaagttcatcgatgacctttaattctttttcaacccgtaacttagcctgctcatttttccttccatatcttttttctaaaccggtataggctaaacgggttaacagttttaaatcatctgcttttgtaccggtgtaatgctttttatttcgaggggtagaaaacgcaaaatcaaagctacattgagacagaagccttttagtattttcaattatttgaggatagtacttaaattcatccagtaaagattgtggagatttaaaatactctgatttatgacagatttcattctctggcaatagcgacaacaaagtattattgtcaatggcccttaagatgcgatgtaaattgtattctttttttgttccaaaagttaccggctgcaggattaccatttttgaaatgagattcctgtattctgaccggatcaaaagatttaattcctcctgtcttattcctatatattcattttcctttagcccttccggattattttgtaaagaataaatgataaagttatgatccagatttggtctttccggtaactcggtgccatcacagttatattcagtcagcatcttgtttacttctcctaaaccggcaaattttttagcaatggcaatatataaaagcttactcccttttctgacttctatgcctgctactggtttaattccttgtgattcacatttctttttgaattcatacaccccggtaattgtgttgatatctgtaagtacaagctcattgattcccaatgctgatgcttgagaaacaaggtcatctatagatagtgttccatatcttaaactatgatatgaatgacaattcaaatacatacgtgagcattaatgtgtaaaatcaaacccaactgctctaccgacagcagcacttccaaatctattcttaatattgtccatagcctggtaaaggctcatcagttctgcagtatcttcaaataaattcatttgatagctgccatgtactaaatctgtgaaccttaatcctaccagcctcaaccgcatacgtcttgaataaactttatcaaataattccaaggcaaccctggaaagcgtgtgatctgcagaagtataagcaacacgacattgcttcgtttccgtatcaaaattggcatatctgatcttaataaccactgtagacgtcaaccatttttcttgacgcagttggtgagccagctgctcagccattcctgaaatcaaccttttcacttcattaatatccgtagtatcactgctgaatgttctttcttttgaaatagattttctttctgaatatggcactacaggcgtttcatcaattccgtttgctttcctccatagatcagtgccatttttaccaatcatttgctgcagaacttcaacaggtatttcagaaagcgtaccgatagtccttattcccactctggaaagaagtctaaaagtagcatcgccaaccatcggcattttctttatgggaagcgggtttaaaaatgaatgaactccaatggaaggtatttcacggtgtccatgcggtttagattctccggttcctattttgctgacggtcttatttatagaaagggcatagctgatcggaagaccggtttccttttcaattgttgcccccagttcatttgtccatttataagcgccgaaaaacttgtccattccggttaagtctaagtagaattcatcgatggatgatttctccataaccggagctttctcttcgataatttctgttacagtatgtgacattttagagtacaattccatatctcctttgactactttagcttgtggacaaagcctcaaagccatacgcattggcatggcagaacgcacaccaaatttccgggcttcgtaggaacatgaagacacaactcccctatccccaccacctattatcaggggaattccgttgagttcagagttcacaagtctctcgcaggatacaaaaaaagtatccaggtccatatgtacaattgaccgttccattttacaaaattagatatatttttaatcaattatgataatatatattgatatattttgtatcaattttattataacaaaacaaaaccctttatacgtcagaacttgacgcaataaaaaagttatccacaaaaagtaatataataaaaaaacctcctgggaaattaggaggttgaatacatatcatccgatattgaagtaatcgaacacttaaatatataaaatatttcattatttagtgatgcattaagaaatttagcacaatccctttattcatagtacttacagacaaaaacacctctcagaaagagaggcgtatacagactgattagttcataaataaaccacaaacgagtcaaaaataaaaaaacttcatcaaaaaatgaagtttaaagtgtgtgattaagtatagataaatgatgtggtgttgtgtaggttgtatttttaaaaacctgcattaacactaacaatacacatgccatcatcatcactgtttaatgaaaagttgatttttgtggtatcttttttttaaaaagccgacaaccgaacaagtatattaataatccaacttgttaacattttatcttaaaatatcaaaaaaaactcctgcaggaggtcattctgtaaatcagtagaaacttgtattatacaaacataaaaatccccagccatagccagggacattaaaaaaactttctgtacttgttgttatttaaaactcccgtaaatatacggactggctgtagtcataactctacgggaaaccgtaattgagtatattaattatttgtaattagtataaaataaaatcttccaaatctattcttactattgtccatagcctggtaaaggctcatcagttctgcagtatcttcaaataaattcatttgatagcttctgtgtactcaatctgtgaaccttactcctaccagcctcaactgcatacgtcctgaataaattttatcaaatcattctaaggcaatcctgaaaaagctatccacaaaaaaatccccggagaaatccggggataaaactaataaccatgaactcaaaaaaatatgagttgtatcttaatatacgatgaattatagaattcagatttaaaaatcaaataaaaacctcccgggcaaacaggaggtatgaaaacttatgttaaaaattttattaataattcaaaattaataattctctattaaatgatttatgatcatgatcataaaaaacttctgccagcaattattcaccttctttaaccaaaactactcaaaacaaagaaaaattgtactacagacactgatctattaaaaatccacaaaaaaacctcccaacacatcaggaggtaaaaaaatgtctcttttcaaacaattttaattatcgtttcaaatataatagttccgtgtttttacaaatatgattataatcataactctatgggaaatcgtaaggattgagtagccgaatcttttctgatgattattttttctgactttaagattagtttaccaatatttttttaattgtatacagaacaaaaaacctcccgaatcactgggaggtcatactgtaatttgtcagaaatatgaaattttcaatgggccaaatttagtaagcagttatatcataggtatatgatttcaatcataagcccatctatttctcataccatcattttgctgttttgtcattatcgtcaataatggagatttatatttaagctcttgctgtaattttaatttccactttctggcccgaaagagccaattcagtcactccaacaatagtgctggcaacaatacaggattcaccatagaattcttttcccaaagtctgccggcttgcaaacccctcccgcatatccgttacgtagatcacttcctccgtgatatggctggcatttaacccatattcacttagtaatttacctatattctgatacgtctgcctgaattgattttccattccctctgcaagattcccttccatatcatgtcccagttgtcctgagatccagaccaaatcaccgcttttcacagattgtacatatccgtataccttttcccaaggcatatcaaaggttttgaattctttagtattcataatttattttattattaccatactttatattcaacaaatacgcacaaaatttcaagtaactaattatcagaaatttacaaaatatatcgttttgtaaataaatacgaaataccgtagttttatatgcacattatataatatccggagttaagtattcatatcagataattggccagggcccggtaaaatttttattgattacattatgctaatgccttcttgtactcagataaggctctttcacgggcaaaagtatgttctactatgggtgaaggatattcaggggtattccattcaggaagccattttttaatatactgcaggtctttatcaaatttttcagtctgagttgtcggattaaaaaccctgaaataaggagcggcatcacaaccgcttcctgccgcccactgccagtttccgttattggctgcaaggtcataatcattcagctttgaagcaaaatatgcttcgccccacctccagtctatcagcagatgtttacataaaaaacttgccacaatcatcctcacgcggttatgcatatatcctgtctggttaagctctctcatacccgcatctactatgggatatcctgttgttcctttgcaccagtgcctgaattctttttcgttattccgccattgaatatcatcatacttttctttaaaagactgatgaacaacccgcggaaaatgatataaaatctgcataaagaactcacgccagatcagttccgaaagccagacggcattatgcttcaatgcaaaagccatacattttctgatgctgatggttccaaaacgcaaagcaatccccagctgtgttgtatgttgtaatgccggaaaatcacggtattggtcataatcatcaataatggaagcgtccagaacaggctttgaaaatttaaaatctgtttttttgaaaccaatttcctttaacgtcaggatatcagagtattcctgcaaaaagaggtttttaaaatttaattcaacagcctgataatgttcaggctttaataactcccgccacttctttgcatagggtgtgtataccgtgtatggagtgccgtcttttttaacaatctggtctttatcaaaaattacctggtctttacaggctttaaaaggaattttcttttcagtaaaaaaataatagatttccttgtctctttcaatcgcctgcggctcataatcacggttacagaatacactttcaatatcatattcttcagacaattttctgaatatttctacaggtttgccatagtaggtattgagctttgaatggtatttttttaatgaaatattgatatccgtcaaagcctgatggatataatcaacccttcggtcttctttatcttccagttttccgagaatatcggtatcaaatataaaaacaggcattaccggagcatctgattgaagtgcatggtgaagtccgatattgtcttccagccttaaatcacgtctcagccagaacagggtgattttacttttcatgatttttaaaattcaaactacttcttttattcctttgtacggaatgttttttataacgaagataaagatactgattatcatataaaattttaaaccccgacataaataagctttatcattacccatttatttgacaatatccattaaaatttacgacctttatcggaattttaattgaaaaacctcacagcaatggaagaattcgaagtaccggtaacttataaaggacaagatctgcttttcaacggaaagcttgctactttctcttatgggtataaactgtatgtggatgttgatggaaccgaagttgttattgagcgtgacgatcacggtgacttaagagctcttcttccagatgccgcttcagaaaaaaatatagataaagggcttatagaagcgattgttgaagtttttaaaggactccaggttttatagaaacaagccaggaaataattcagcctctgaaaaaaatttcattgcaaggctaaaaaatctgattagctttattttcagaattaagtcactgtttacatttaatatactgtgatatgagaaaattaacttttctttttctaatggtacccattcatttgcttcatgcacagcaaagcaatgtaaaacaattcataattatcaggtaaagtgatgacatatttctctttaaacaaagtggctgaaaacgatataaagttaactttatattattttgaagggaaaatcctttgcaaagaacttagttattttaaatttttcctgtattttcccggagttactcccttatgttttttaaaaagtttggaaagatggctttcgtcactgaactggagttcataagcaatttcacttaatcgcacactgctgtatttcaaataggtctctaccagctttagtctatagtccagcagataatcctgataggaaattccggtctgctgtttaaaatattccccgaaatagttccctgaaattccaaaatgatcagcaataacctgaattcctgttttctcacgatcttttatatgctgctgaatataagcgatgattttcatgatggaaaatgctttccggttttcctgaaggtctgaagtttcactctgaaggatattccgggcaataagattcagaaggatcgacatgcaatttcggataataagatagtcatcagctttgtttttaaactcattggcaatctgcagaacaagggtttctgcaaactgttcatcatttttattcctgaaaacacagccagcccttgcgtgataattatggctgatgtattgcagtttatacaaattttcacagctctcaatacggtctgcttccaaccggattctgtcaataaactcaaccggacactgaatactaatcaggcgggatcctccactttgaaaacaatatatttcctgctgcgggataatgaaaagcttaccctgagagaaagtaatactacgttcatcatacctaagtgtacccctccctctgacaacataaacaaacgaaagaaaagtttttgttttaaacatgatctcttctccttttaattctatgtcttttacatcaatctcttcaagcggaagtcctttcatattataccctattttcctccaaaagtacaattttaacagaatatttagcgggtatttttgtataaaaaattatgaatgtaaatccaaaacggtggcaggcgctcaactttctgatcataggagcctttctttcgccactggattattttattgtcaatatggccctgccttctataaaaaaagcgttcagcgccagtgatcatgaactccagatgattattgccatttacggcctcacctatgcagcacttgtggtttgcggaggacggctgggtgatatttacagccgtaaaaaggtatttgtatggggattgtacacttttttgggttcatctctcgcctgcgcattttctcctgatattacatggctgattgctttcagaatgtttcagggaattggggcatcactgcttgccccccaggtattggcttctataaaagaccttttcaacagtcaggaacagcctaaggctgtaagtcttttcagttcagtattcgggcttgcttcagttatcggacaattgcttggcggagcgcttttaagcatgcattggagacatttttcatgggaaatggtatttcttgtgaatgtaccaatcacggttatctgtattattggcattcatttcacaatggataacagtaacaaaaaagaacaaacagggattgattttataggcgctttactattaattctcgctttgcttatgctcatctgccctcttattttcggacagaaatatgaatgggtctggtggattttcgggattcttttttccgggatcttattatttattttattcttaagatatgaaagaaaaaaacttcagaaagatcatccggtgctgatagatcctgcactgctacagcagaaaccttttgcattaagccttctgattattttcttttacaatttcaccgcgggtttatttatatgctatccttactatcttcagcaatttcttcatcaaaactcaatgcagaccggactcgctatagttccctatggcttggcttttttcctggcccctttagtgagttcccggataaaaatggcacctgtaaaaatgatcaatgcaggattgggattgttaataataggatttgtaggaagtgcagtagctttttattttcagcaaaaaccatcttttattacccatacgaccctgttcatagccggatttggtcatggtacggtgatgccgctcatgatgcggacagccatttctttggtttccagggacaaagccgggcaggcttcaggacttgtcagcataggaatccagattggaagtgttacaggaggagccattattggcactttatttttcaatctgataaaagtcacgggcttcacagaagcatttactgtcgctgtaggaatgattggcatttttcagtgtattggaatatgggcaggaaatagattaagaaagatcttggttcaacatacagattaattcaaaaaatacaatacatttaaatatgaacaatacagaaaaaattatcagggaaattatagaattccatcagaatattgagaaatggttccagggcaaaacagagaaccagcaagccctttacaggacgcttctgtccggattctcaccggaattcagaatgatcaatggaaatggtgatacagtcactttatctacgttatccgactggcttccaactgtattcggtaaatttccgcaacggaccattcaggtagaaaatatagaagtaaatcattctgaacatcatggacttgctacctacacggaaacccaggttacgggagaaactgttaccagaagagcatcatcagccgtttttctgctgaatgaagaaaaagccctttggcttcatcttatcgaacgatggatatagaatttcatagctgtaaaaattaaacagccctgattatccgcgataaacagggctgcatacctttaatggcagagttcttctgttattcagcccatggggagtgtaaaatgcagtcacagaaatttttccttttaaaattcggaatcatgaaagcacatacatccgcttttatatttccaaaggtggtttctgttttatgctcaaagccactgaaaaaagtgggaataattttctttttgaaatcattcctgggaaaaattttaataatctcttcccgatgctcgtcactcagattttcatacccttctcccatcacatcaagacctactcccgagtacattaaagctacttcattttctttgtgttctgcaattccgatagtggtatgaagggcaatggtatcccataccagctgaagtttatcctgagcaataccatgaccttttaagaaatctcttgcagcattggcaccatcaacttcaaatctgagatcaggactgctgtaatgggaaacaagcccaagatcatgaaatacagaggctacatacaacagctctgaatcatgagtcttattttcccgctttgcatttaatgaagagaataaaaaaacacgtaaggagtgattatagataaattctgtaccgtgctccaataaaagttctgtagcttctgtagcgattttactgtccggaattattattcctgcaacttctttcatacgatttactgacatagttttaaataattttatccaaaggtatcctgattactggtcccggggaatatcaatacatactgatgacatgtcagaatttcaaatctattttatactttggtatgaatgaaagtgttgcggtagtttgcaggagatatgtctgtattttttttaaaaaagtgactgaactgttcagaagtagcaaaattaagctgataagcaatctcttttaccgtatgtgaactgaattgtaatagtcttttggcttccgctataatctgcccgttaataatttcttttgcacttttatggctgcaacgcttacagagctcactaagtcttctcgatgtaatattcaatctgtcagcatagtcactgacggcatgaagggtatgaaaccggctactcagaagttccataaatttgcggtagataatataatcctgactatcaaaagttatctctttcacaattttcacattggccagcttgatcataataatctttaaataagctgccagtacatccatctgattggtataggaatctgctttgtattctgtaaataaaattttaaacaggttcaaaaattcctctttttcagtatgatctggttctaacctttgatttgccgaagcattattaaacagaacagctttacaattgctggcactggaaggtactttctcccaaaagcaatctccaaaagaaatatgatagcctcgtacagacaagtcgtttttaaatttgcagacctgtcccttggaaagcaaaaaaatttcctgtcctgatatctcaaaggaatgctgatctaccataaacatccctctgccactttctatcataataatatgatgataactgagccttacgaaatcccctgaatagagcagctgatcatgcaaccgttttacagaaaaagaatgctcaatagaaggttccgataatatttctgaagccagtttcatagaatgattttttgataaagataaaagttttgcccataatttgaactgcaagtttacccaactttatcaaaacagagcatgtcagaaaacctgtaacacatgccagaatttaccaaagttaattacttatttctgaatactttcatctgcccggccattacagcaagtaaaattccaaaacaggcaaaaagagcatatgaatacctgagatcaaaacttccggcaatatacccgataagaggcggtcctattaaaaatcctaaaaatgaaatactggagacaaaagacaatgctatactcggcgctaccgtactcacctttcctaccgtactgtaaacagagggaacactcagggaacttccaagcccgatgatcatgaaagcaataatacaaatccagagctccgggaagaaaacactaagaaaaagtcctccgctcatcagcaacccgcaacattgcagaacaatctttttcccatatttttcaataattctgtttccgataaacctacctaaagtcatcattaaaataaaactcgtataccccagtatgacaaggttttcaggtgctttaactatagtctgaaaataaactccactccagtcaaacatagcgccttcaatcgccatactcaggaagcctatgattccaagtccaaccagtgtaggatttacggatttaaagattgaacgggtctgcggttccgctttatggataatattggtcaggttctgtttgctgtataaccagagtattcctacaagcataaaagtaatcgtgaaatgatagaatgttcctacatgaagattaatcatcagtaaaccgagaactgctcccgtaagcccggcaaaacaccatgcgccatgataagatgaaagaagagttcttttggtaagagattctatttctattgcctgagtattgatggctatattgcacatgttcccggataccccgaagaagaacagaacaattgcaagagtccagtaggaaggtgataacccaatcagtaaaagaaaaaaaggatatagcaaaaaacatcttttaataatccagctgcttccgtatatactgatcagcttgccggccagaaccattgtggaaagctgcccgataggcatcagaagtaaaagtgtccctaattctgcctcgctgatagaaagggcatttttaatgatgggaatccggctggcccaggaagaaaaaacaagtccgtgggcaaagaaaagtaaaaagcaggctgtgggcattttcgtattaaaagattctctctcattcattataacagggtgataaaattccatggcaaagttaaatacacacatcagttaaaatataatccgtttttgtcatttttacgttccattttaaccaataaagaataaatcacctggcgttttggtagaatatcattttgcttttggtttacagatctttaattttcattaatttcgttcataaaaatgaaccatgaaagaaaaatggattccctatccaacaattttagaaggaaaaacagttgaactgatacctcttgaaaaagaacattttaaagagttacatgctgcggctgcagataaagaactttgggaactgattcctacagactgctcagacagaactgtattttataaaacctatgagtttacccttagtgaaagagaaaccggaaatcaatatccgtttgtaatacgtcataaagaaactcagaaactgataggttctactcgtttttttgaaatctatccttccgataaaaaactggaaatcggatggacgtggattacaaaagagttctggggaacagccgttaatcttgaatgtaaactattgcttttaaccttctgtttttgatactctgaaaaccaacagagtacagttaaaaacaaaagacaataacttcaggtcaagaaaggccattgaaaagattggtgatgtatttgaaggtatcttacgaaaagacaaagtatcaagtgacggaactacaagaaatgctgcctattacagtattctcgatgatgaatggaataatgcgaagcttacaattgaaaaactgatcaaggaaaaacaataagttcattacaaatcactagcaggtatggacaaaaaaacacccggcatcggagccgggtaaatatctctaattgaatgattgtctgtaactcaacggtgttttatccgtcttctttttaaacagtttattgaacgactgcggatgttcaaatcccagtgcgtaggctacctctgatacggagaaacctgttgtagtaagatattcttttgccttttcaatcagtttttcatgaatatgttgttgagcattcagccctgtaatattacggagcatatcacttaggtaatgaggtgataaattcaacgtggaagccagaaattcaacggtaggaagtcccttgttcagcgtttcctgcttgttgaaataatcttccagcacagtatccattttcgtcagcagatcatgattgacagcctttcttgtaataaactgtcttttataaaagcgattgctgtaattgagaagtacttcaatataagaaatgataacatcctggcttacttcatcaatcgatgtattcagctcatatctgatgttatccagaagtcccgttattgttgttttttcctgatcagacaggtgaagcgcctcattggtatcataagaaaagaaaccgaagttcttaatgtttctggcgagaggataacttctgataaaatccggatgtacaagtaaagtatagccggaatattcggcattttcttcagttgaaaggacctgccccggagccgtaaacatcattcctccttcattgaaatcataatatccctgtccatagcccatttttccattggtagaatatttatacgaaattttataaaaatccagagtaaaacttctcttcagcatctctttattgaccttcatttttgtattatccacaaggcttaccaacggatgaagaggtttgggaagctgcaggatatcatgcagttccgatatggatgaaattttcaaaggaacgttgtctttcttttccattatataaagttataaattattagaggaaaagacagcataaatgtgatttactttatactgccttttaagtttcggattacataaactgcttacggaattcttctctgaaagcttcatctcctacttcaatacgctgtgcatataatgcttttgcgtcttcaccagcaacgtatctcaactgttttttaccgtctgtagctgcttcatataccacttctgcaatctgctccggtgtagaagcagtttccatcatctctcccatcttagaaaacagggagttcgtcatttcatcatacgccggagtggatgctgaatccaaggaacggcttacaaaatctgttttgatacctcccggagacacggttttaatgtctacaccaaatggattaagctcaaaagcaaggctttcgctccagccttccagtgcccatttggttgcatgataagtagaacctaacggaaaagcaatcagacctccaattgaagtggtggaaataaacattccgttctttttctctctgaaataaggaataaatgcctgtgttacccgtataacacctaataaattagtatccagctgttttacgatctgatcatcagaaagcgcttccaaaggtcctataagtccatatcctgcgttgttgtaaaccacatcaatgtctcccagctcaagagcctgcttaacggttgacttgatctgttccggattggtaacgtccagcggaagtacagttacattttccaaagcagcaagatcagccgctgcttcagggtttctcatggtagcgattaccttccatcctttgctttgaaataattgggcagttgcttttcctaatcctgtagaagcacctgttataaaaattgttttcattttttcttgttttaaaattacatgacaaagttctgcattggaagaaaaccgggagttgccaaaatggggtaagctgtagccaaaacggatatgaaatagatttgttttttgtaagtttgttctatcaattttatggcagaatatattcttgacaacgtcaatatcagtacactttccgtatacgacctgctgaaacatacctcagacagcacatttatcgggatcagggattttcgggacatctcccccgttgccattgaaaaagacaccggaatatttaccaaacagtctactttacatgattttccaatggtaaacattaccagaatcggaagttcattgctttgctcctgtacctgtaacaatgaaaaaaagcagctttgcattcatcaggcagaaattatccattgtatcatagaagataaaaattacaggctgtttttcgatgatatgctccgtaaaaaggtttttcttcctaaagcaaaaggatatggtcttgaaaacgaaccggacctggaccagtactttgagctgcaatatattgacggcagaattgaggttgtttccaaaatcaaggaaatgcttcctgtagatgatgtcattttaaaaagagatctggtgcctcagttttcttcaaaactggatgaactggctgttcaggaaacagctaaaaaacaaatcctagtaattggtaaacacaggtattataaccacctgaccttttcgctgatggaagcagaaacaacacagtccggaaaaataaaaaatccgatttctcctgtagatgccatgcagctgatatggaaagcagaacaacctgcagacattaagttttacacagccattacttcctttcagaacaattataatgaggattacaatccggcagaactggaagctttaaagctcatcgtacagaaccctctggaacttgaagtttattatcatgaccgggaaatcgcagaaaccgtttctgcaaaatcactttttaaggttgaattaaacactttaaatgcggaggtacaattatctgtatttaagaaagatccgttttatgaaataacaggagaattgcaattcaacgatgtgtctgtcccttttaaaaatgttgttctcagaaatgaatattttgtatataactgtaacattttcagttttgtagatgatccagacatgctcaaaatcataaggttttttaaggctaataatgagattttactggttcattcttcaaaatacgaggcatttatgcagaatatcctatcagccattgaagaacgtatccgcatcaattacagctatatacagcctgcaacagaagtacagcttgaagataagaattatcaggttgaaaaagtcatttatcttcgccagcaggaaaattatataggaattacaccggtcatgaaatatggtgacatagaagttccggtgtattcaagaaagcagatttttgatactgatcagaatggcaatccatttaaaatagaaagaaacgaatcagcagaagcccgttttacctccctgattatgcagcagcatcctgattttgaggatcagatggatgggtatcagtatttttatcttcacagagataagttcatggataacaactggtttctcaatgcttttgagacctggcgaaatgaaggtataacgattcttggatttaacgaattaaaaaacaataaattaaacgcccaccgggctaaaatcaatattcagattacgagcggactggattggtttaatgctaaattaaaagtaggatttggtcctaaggaagcttctttaaaacaacttcaccgtgcgatccggaacaagagtaaattcgtccagttagatgacggcagcatgggaattctccctgaagaatggatggaaaagatatccgcctgtttccgggcaggagaaattgatgaagaaatcctgaaaattcctaaaatcaattttacggaagtgacatcgctgttcgaaaaagaaatcctgagcaaagaaattcaggaagagcttacctcctattcggcaaagttttcaaaagtaaaggatattccggaaacagctattcctgctgaactgaaagcagaactcagggattaccagcatgacgggcttaactggcttaactttctggatgatttcaacttcggcggatgtcttgcagatgacatgggtcttggaaaaacgatccagatcattgccttcattctttcccagagagaaaaaagagggcataccaccaacctggttgtggctcctacttccctgctgttcaactggcaggaagaaatcagcagatttgcaccatctgtaaaggttctgcttcactatggtgcagaccggcctaaagcaactgctcatatgtccgaatacgaagttgttctcaccacgtacggaatgctgctttcagacattaagtttctgaaaggttttaatttcaattatgtatttctggacgaatcccaggttattaaaaatccgaattctgaaagatataaagctgctcgtctgcttcaatcacgaaacaggattgtactgaccggtactcctgtggaaaacagtacttttgacctatatagccagctgtcttttgcctgtcccggattgttgggtagcaagcagtattttaaagatatttatgccattcccattgataagtttgaatacagcaaacgcgctatggaacttcagcaaaaaataaaacctttcatcctcagaagaacgaagaaacaggttgccaaagagcttccggagaagacggaaacagtcatttactgtgaaatgaatacggaacagcgcaagatttatgatgcctatgaaaaagagctccgtgaatttgttgcggctaatgatgacgatgaccttaacaaaaacagcatgcacgttcttacgggacttacaaggctcagacagatctgtaattcccctgttttgatgaaagagggatattccggtgaaaatgccgtgaaaattgaaattctgacggagcagatccttggaaagtcaaaagaccataaaatccttgttttctcacagtttgtcggaatgctggatctgataaaagcagaattggaacaacacaatatcgggtatgaatatttaacagggcagacgaaagaccggggagaaaaggtaacgcatttccagaacaatgaagatatccgggtatttcttatcagcttaaaggctggcggcgttggtctcaatcttactcaggcagattatatctatctggtagatccatggtggaatcctgcagcggaaaatcaggccattgaccgcagttaccgtataggacagaccaaaaatgtaattgctgtacgaatgatctgttccaataccgttgaagaaaaaatccttacgcttcagaaaaagaaaaagcaactggctcagaacctgctcactaccgatggaaagaaacttcagggattgtctaagcaggatctcatggatttacttggatccggttcataatgtgcattctttttataagcttaaacagaagcctttacagttttaaaaaaaataaaaccgacaggtaaaaagcctgtcgataaaaaaacaaaaattgatatggatatgatttagatatgatgtgtctgttgtatcttcttcctgctgaattattagaggaagtctttaaaatattatttttttcttgagacaaatttatatttatttagaattaataaaaataataaagcaatgatatttatcattcaatcaaaaataactcctcataattaaaataaaatacaatttaaaacagattatcaatatactatacataaacagacccatcctgaatttcaagaaaggcctgttctatataattagtaatctaagtattaaactgtttaacttatattttcaataagaattgctgaagcgccccctccaccattacagatggcagctataccgtatcttcctttttcctgacgaagtacattgacaagagtggtaacgattcttgctcctgaagcgccaataggatgtcccaaagcaactgccccaccatatacattcactttgctgagatcatagccgagaatctgctggttggataaaataacagaggaataggcttcattgatttcgaaataatcaatatctgataaagtgagccctgtctgtttcaggattttctgaatcgctacagaaggagatgtggtaaaccattccggagcctgggctgcatctgcataagcgacgatcctggccaatggattcagatgatagtgttctaaagcttcctgagagcctaacaggatggctgctgctccgtcgttcagattactggagttggcagcggtcagtgttccgtctgcttcaaatgcaggtttaaggagagaaattttctccggaatcaatttgtcaatatcttcgtctttatcaacagttgttgtttcttttttaccttccactggtattgtgatcagttcattattaaatttaccggcttttgcagcttcctgggctctctggtatgaaagcagcgcatattcatcaagctgctgccttgttaatccatactttttcacacctaattctgctgcacttcccatgtgaaaatcattatagacatcccacagcccgtcttttatcaatccatcaatgaggctggtatctcctaatttgtttccctgccgtagttttacgtaatgcggaacattactcatactttccattcctcctgtcataacgatattttccaatccaagctgaatctgctgggcaccaatcatggctgatttcattccggatgcgcaaaccttgttgattgttgtggcgtctttatcaacaggaattcctgcaaaaattgcagcctgtcttgccggcgattgcccaagtcctgcactcagtacatttcccatatatacactgtctatatgttccggagtaagtccaaggctttcaaagctgttctttatggcaatagccccaagctgaggagctgtaaagccggaaaggcttcccataaaaccaccaacaggggttcgttttgctgctacaataaatacttctttcatagatttaaattttactatataccgatcagtatattttaaattaaaaaaaatccctttttatctgcaagggaacctaacaaagataataaaaatataccgattggtatattaaaaatacagaaaaaatcttacttgtaagggtaagattttaaacttcttatgctctgctcagctggtccagctttttcagcagtgttggtattctgtaattgccatgcatcttttccagcatcagtttagcttcatccacatcaattcccctggcagtaacaaaaagcggagttttgctttctccacggaatacgcttctgcgttgagaatccggagttgtgaattcattttttgccactccaacgataggacatttgatttccaaagcttcataaagatgtcctcccagtcctatttttccgtcattatccaaagtaacatatccgtcaacaatgataatgtctcctggccttaatgcaatttttgtcagcagactcaaaatgcagggtaattctctcttgtaaaaggctccactttcatattccgaacttacaggtgtttgttctataaaggtttccacttctttttcagatgtccagtcttcaaatgcaatacatacggtattggcataatcttcataatagtaggtatcaaatgcgtaaatcatatttctttcttaaaaaactcaccgaaatgccacaaaattcccgacggatcatgtacaaaacattctttcccccaatccattgttcttacgggagtaagcttcacatttttatattgatctgtaagtctcaaagacaaaagttctctccagaaatcatcggtgttggcaacttccataaaaatcatagtattgtcaacccagtcttttgcataataatcctgaaggtaaaagcctgtttcatcccttataaacagggagagttttggctccagaacaatttcttcaaatcccagatccctgtaaaagtttctgctgatctcaaagtcctgtgcaccaataaaaggtctgatggatttaactgttggtttcatatccctgattttttgagtctgtttttaatccttgccaaggttttaaatcttaagcaagaattaacttcctgattattttctgtcaactaccagtctttcttctctgttggcaatgtcccatgcagtggtgaaaataagttgggttcttttctccagcaactgataatcaatcttttcaggatcatctgttggcttatgatagtcttcatgaatgccatcaaagaagaatgctacaggaatattatgcttggcaaaattatagtggtctgaacggtaatacaactgttcaggatcattcaaatcatcatatttgtaattcagctccaggttgttggttcttttatttgcggcttcattaattactttaagctgagaacttaacatgtcagaaccaattacgtacacatactgttttcccctgttggcaggatcatcacgtcctatcatatctatattaagatcaacaacagtattggctaatggaaaaacaggattttctgaataaaactctgagccaaacaacccatgctcttctccggtaacatgcaggaacaaaacagatcttttaggcccttttcccgcttttttagcctgctggaatgctttggcaatttccattacagctacagttccgcttccgtcatcgtctgccccgttgtatactactccgtttttggtccctacgtgatcatagtgtgcagagaccaccacaatttcctcaggtttttcacttccttcgataaaggcaagaatattctcggaatcaggaaggtttcctcctcctctttttttcatgaattcagccggaactttctgatagtaagaatgtagtgctttaggcgctgaaattcccaggcttttataatagttaacgatatactcacccgcttttttctgccctttgcttccggtatcacgtccttccatatcatctgctgcaatcacatacaggtttttctttaaatccgctgcattaatttctttataggcattgttaaatgctttattatgttttgttgaaacaggatgtgaagcgtttccgtcagatatttttgccgttccgcaactggtcatcatcgccattgcaaataacggaataagtatttttttcataaagaataaatttcttaaaaataacaatttttattcaaccataatatgattaataaatatgacaaaacaataaacaatttattatggatttaacaacaaatcagcttaaaaaataattcgatattaaaattttattatatttgatttaaatacaaaataggtggataaaatttacggatttacacattactccttttttacggaaatgtctgaactggcagccagacacggaagctttgatctttctctgggacttcccgattttgatattgatgaacgcctaagggtatttttaaaagaagctgcagacgagcagacccatcattatgaacctctcgcaggaaaccctctcctgattgaaagtattatccgtttcaacgcaaaaagactccataaaatttctattacaaccaatgaagttactgttgtcccatgtgcaacctttgctttatatacctccctcaaatctgttattaatcagaatgatgaagtgatcattattcagccgtcttattatacctacggacctgctgttgtcatgaatgggggaattcctgtttattatgatcttgaagaagactttacaatcaactgggacttgtttaaaaactgtattagtgaaaaaacaaaagcaatcattgtcaattctccccagaatccaaccggaaaaatatggacaaaggaagactggcatcagttatatgaactgattaaagaccggaatatctatttgatttccgaagaaatatacgatacttactgctacgatgaaacggaacattacagttctttcattcatccggggctcagggaaaagaccttctgtattttttcttttggcaaaatgtttcatacttccggatggaaagtaagctatatgctcacttctgaagctttaacaaagaaatttcgatgccatcaacaatatatttcctacggcgccaatgctccggctcaatttgctatcgcaaaatatcttgatgtatttgatccggatatcaataaaaagctcatgcagaagaaaagagatatttttaatgaaatgattaaagaaacccctttccagatcgaacaacaagcggaaggaagtgttttccaggttgttaatttcagaaatatttctaaaaacatgaccgatgtagagttttcaaagtggctgacgattgagaaaaaggtttcgtgtctcccactttcggctttttataattcgagacagaattcggattatgtcagattcagttttgctaaaaaggatgaactgattattcaggcactggaacatttgagaaagaacctttaatcattttacatatttattttttcctgcagatcacacagacttgcacagatgatggtgaatattttattttttgctgttgtctttcttgatctaaatgacaaacaaatatgataaaaaaagcaccgccaaagcgatgctttcctattattttaatattgattttaaagagccagaacccttacatcaattcttctgttttttgctttacactcatctgtatcattagcttcgcatacaggatgctgagatccgtaaccttctgcttctattctgtctgctgaaacccctagctcaagtaatttaagcttcgctgtttgtgctctcaggttagacagactaagattactttcttcatttccactgttatctgtataaccgcctaattttattttaaggttggggtaagcatttaaaatttcagccagcgtgtttaactgaagttcatagcctggttttaaatcgcttgaacctgtttcaaaataaaggttttctatcgtgtaccacttattaggatccagggcagatttatctttttgcttaaccacattatacagctgataaagctggcttccgtctccgatagcaattgtttttcctccctccagttttattttctgaatatttcccgtttcgtacacaaagtccccgttttcattaagatgtccctgaacctgaccgggaacaacctgaattgctttagaatcagtaacgacagtagcagtgccggttactccggtaagactttcaatctttgcttttctgttcgcttcaattttatctttatgcagcacagccagagtaggcgcaataaccaaagaaacgattgacattaatttgatcaggatattcatagaaggccctgatgtatctttaaacggatctcctaccgtatctccggttacggaagctttatgaggctctgaacctttgtaataggtttgtccgttgatgtccactcccttttcaaatgattttttggcgttatcccaggcccctccggcattattctggaacattcccatcaaaactccgcaaacagtggcgcccgccaggaatcctcccaaaacctcaggtccgaaaataaatccgatcagtaagggagaaataatggctatcgcaccgggaagcatcatttttctgatggatgcatctgtagaaatagcaacacatttttcgtattcaggttgtgcttttccttccagaattccgggaatttcacggaactgtctccttacttcttctaccattgccatagctgcctgtccaactgctgtgattgccaatgatgagaaaataaaaggtatcattccgccaacaaatagtcccgccagaacgtctgctctgtaaatatcaataccgtcaattcctgcgattcctacaaatgccgcaaataaggctaaagcagtcaaagcagctgaagcaatagcaaatccttttccggtagcagccgttgtatttcctacagcatccagaatatctgttttctctcttacttctttcggcagctcactcatctcagcaatacctcccgcattatcggcaataggaccaaacgcatcgatggcaagttgcatggctgtagtagccatcattccggctgctgcaatagcaactccataaagtcccgcacagagataagaaccatagatacctcctgccagtacaataatcggaagcaaggtagattccatcccaacggatagccctccgatgatattggttgcatgccctgtagaagactgtctcacaatgctggaaaccggtcttttacccattgctgtataatattctgtaataatactcattaaagttcctacaaccagtccaaccattatggccccgaaaactcccattttggtaaattcatggcctctgagaaccattttttcaggaaggatatatgttaccaggaagtaagaagcaatagcagtaatcacaatacttccccagtttccaaggttaagcgcattctgaacacttgaagtggatgaaccttcattatcatttacttttacgaataaagttccgaccattgaaaatataattcctgttcctgcaataagcatcggtaaaagaatcggggcaaaacctccgaaagcatcatcagaaactgtttctctccccaataccatggtggctaaaaccgttgccacataagatccgaaaaggtcagctcccattcctgctacatcccctacattgtctcctacgttatctgcaatggttgcaggatttctggggtcatcttccgggattccggcttcaacttttcctacaaggtcagcacctacgtctgccgcttttgtataaataccgccacctactcttgcaaaaagcgctatggattctgcaccaagagaaaatccggtgagaatttcaatggttctttccatttcatgagaatctactgtagcatccggcgcaaaaaactgtttaataatcagaaataaggctcccaaacctaaaacagctagtccggcaacccccattcccattactgaacctccggtaaaggatactttaagagccttcgacagtgaagttctcgccgcttctgccgttctgacattagctttggtagcgattttcattccgatgaatcctgcacaggcagagaatatagcccccaccacaaaagcgattccgatactccaatgtgaattggcattactagaccccatcactgccagtaaaatagcaaccactacaacaaagtacgttaagattttgtattcagcctttagaaaagccattgcaccgtctgcaatatgcccgctgattgttttcattttttcatttccggcattctgtttattgacccagttgctctgaagaaatgtataaagcaaagctatgacaccaaaaattggcactaacacaaatagatccatagtttattattttatattaaaaaattgagattagtcttataaatataatgaaattataaacacaccataaaattcattaataataatctattattttgtaaatttgtttctcactatgatttgaattaattatttatgagaaagatactatacacccttatcctatctgcaggcgtaagcagctgtcatcataagatgccacaggaaaaagctgaaatactatatttcggaggacctattataacaatggaggattcttctccacaggttgaagcagtagccgttaaagacgggaaaatactttttgccggaacaaaatcagatgcagaacgtttttcaggatcagccactaaattgattaacttaaatggaaagactcttcttcccggttttatagatgttcatggacatcttacatcaagagccgggattatggatgctgtagatctgtcccccgaaccttatggcactgtaaattctattaaagatttacagattacgattaaaaactacatcaaagacaataaaatctcagttcaacagccaattatcggaaatggttatgatgatgcaataatgacggaacaccgtcatcctacaagaacagaacttgatgtcatcagcaaaaccaatcctattattgtcattcacgcctcaggtcatgccagcgtagcaaacagtgcaatgctgcaacttctggggattacggaatcatcaaaagatcctgaaggaggacatattggcagagataaagcaacaggaaaactgaatggaaagttggaagagaatgccagcttcacagcgttgctgaccttaacggaaaaaatgagtaaaggcaaagatactcaggctcatgccatggaaaacctgatgaaagcccaggatgaatggctcagctatgggcaaacgactatttgtgatggaagaactatgggagaaagtgtagatttgttagaaaaggcagcttctcaacatctttttaaagccgatattgtttactttcctgattatgaatatttcaaaaaagatttcagcaatttcaagccaaagtatatgaagtatgaaaatcgtttgaaactggctggcttcaaattttctgatgatggttctcctcagggaaaaacagcctggttgacacagccttatttagttccgccggaaggtcagtctaaagactataaaggatttcccatttttacggatgaaactttatataacgatctgaaaacacttttccagaatcatatcactgcgcagcttcatgtaaacggagatgcagcaattgatcaggctatacgcgttatcaaaaggttaaaagatgaaaatatttaccagccgaaattgcgcgcaacattaattcatgtacaaaacagccgccctgatcatattcaaaagataaaagaaataggggtaattccttcttacttttctactcatgcttatttatggggagattggcattactcaagtgtttttggtcccgaaagagcagcttttataagtccggccagctctgcattaaaagcaggcattacctttacgattcatcatgacgctccggttactccaccagatctgataacggcagtatacgcagcagtgaatagaaaaacgcgctcaggaatgattttaggacctaatgaaagaatctctcccattggagctctaaaagcgattaccattaacggagcttatcagttgcaggaagaaaatagaaaaggatctattaaagcaggtaaaatagcggactttgtcattctggatcagaatcctttaacgataaatcctgaaaatcttagaaagatcaaagttcttgaaactataaaagaaggaaaatcagtgtataaaagaaattaaacctgctggtacagaataaatattcacaaaaaaagcagatgaaaaaatcatctgcttttttattattctagggaagaacatcttatcctccgaatttatctgcatagtctgtttgagaagctttgatcacttttcttgcgtgttcagctccgtaaacttcctggattctgcattttgcaggctcatccggtaagtttttgtacgttaggaaatagtgcattaatcttttcacttctgcttcaggtaattcagaaatatctctgaaatgcccgaaagcgtgatcattgatcattactgcaacaattttatcatccgcttcacctccgtcgatcattttaaaaccaccaattggaatagcttccatcaaaagacctccggcgtggatgttgtgagaacttaaaacacaaatatcaagcgggtcatgatctcccattgtaacgtcatcagctcctgattctacagcaagtctcatcacttctttatcacagtatgttcttggaacaaacccatacaaagcagggataatgttagaaaatttctgcggcctgtctacctttaaatatcctgtttctttatctacttcatatttaatagtatctgaaggaacaatttccacaaatacatttacaacatttggcgcatcttctcctgcagaaattccgtgccatggatgtgctttaaaatttggaatcattatttatctgttattttttaagttattattaaaatttcttttcttaaatcttctattgtttcggcaatataatcgttgccttccatataattcatgatgaaaaccgttttgaattcatccagctgaacctctcccttcagcccgtcataggttttatgaagcagttctataattgcattttttgagtctacaatattcttccatgaattttttgtaatgtataactgttgggatgagttatattcaaactcttcattgatcgctttttctgtaaggaaaataaactcatgaacggccagccctctgtcaaatctatgaataaggtttgaaggcttaatcctatccagaaacaatgtcattctttcataggaatgtactttgttctctgaatttgatttcacagtaagtaatttgatttcctggttcttaagagtaatgtatgagtgtacaaattgtctgaacaaaaccagaaaaggaattgcaacaatcaatgcaaatgcatatggtaaatatcctgagagactcgtcataattttagactgcaaaattactaattattttccgtcttctaaagagtttttaaagatatccactttagaaatttgtatatagatcaaagagagaataatgataagatagaagccaaccatcatcctgtttaccagagccggaaaaatcagaaatctcaacataacagttccataaataacagcaaaaaacaagacctgagcctggttttttttattgcagaaagaaaaatgattggccagaatgaccactataaaaatcagtaagattggaaaataggaagaattgaattccagcattatattacttttaataaaatgaatataatctgaaaaggagaacggatcaggctgtgaaacgggataaatctgaacttccgtaaattgattcataaaaagcgtagaccacgacacatgattaaaagcttgtattaaacagaaagaaagaaacaaatatccgtatgatatcaataacggcgctgttttaatctgaaacctgtttctatataaataaacaaagacatacaagaatgaataaaaaataaaatattccggtcttgtaagcacacatagcatacctaatatacctgcccagaaaatattcttcctcattaaaaaaatatagaagctgagaagaagaagaaggcatgataaagaatccgcagaaacgtgccgggcagattccggcaaaggtttgaacattgaaattaaaatagtgaggataagggcaagcggataatttttcaggatccttattaaaaagctgaaaatcagaataagaatgcatgcataagaaatagccgaaattaaagagatcgaggcagaagcactgaaaccaagtttaaagaatgaccagccgataaagttatagaaaggcttcaccacaaaaagctgcagctcttcttcatagaccttaggattttgtgaaataattttataataggtgctctccccttctgctacttcttccgctataggatttacaggtccaagcccggcaaaatcaggattcttttccctcaattcatcgtataccttcttatgaatatcctcaattttcatatcagggtattccgttttataaatcagccccatataggcttccatatcagtattgtaatagtggttggtatacagatagtatgacatgaagcatacgtagattgaaaagataaaaacaagaataccgttctttttttccatatactgatattatatgaatacaaatgtaaaaaaactatcttttaatctgtattcccaggaaagtttactaaaggatcagtatactatagttcaaacagggccggtctttgtgttacttcatggtaacagacactgttttcatcaaagaagtggtatacaaggctttttctggttctgtttttatctgtatgaggttctcctccatgaagaatattggcatgccagattaataaatctcctttttttgctttaaatatttctttttttaagcctaattcttttactttttcatcaaggaaagtttcataagccctgtagcttttcttgccgattttcaaggcagtgccttcgttatcgtaatcagaattcagaaaataaggaagtttatggcttttaggaatgtaatgcaaagctccgttgctttcatccacatcttccagagcaatccagaccccaagcagtcctcccaacggataagtggtcatatggatactgtctgagtgtgttttctgctggctaccgttgataaaattgatgctttgaaaaagtttggattttccgtccagtaaaacagataaaaaatctaacagttccggatcacttcctatatttttaatgatttccgaatgatgaatggcaaacatcagctttcccccgtaaataaactttaaagtcccgtctttcatcagtttatcaatttcaaaattgatctgatctgccgtttccggagtaagataattccttagaatcatgtacccgttatcatcgtactgaagagcactttctttattttcttcggaaagcttattaaaaaacggagtttctttaagctttgtataatttaccgtcctttcactggccggaaggtgggcaaaatctttactggaaatgcttgagaaatagctcttattgattccgtattttttatacaatggaatattatgctttaatttactctttttaaacaggttataaagcatatatgataatttgtactgacgaatatgttgtaacataactgttttactaaggattttataaagttacggattattacctaattagaaccaatctaaacaatgcttttcatcataaaaaaggctttcctctcaggataagataggccagctttttaaaaagatttatttttgaattctcaataataccataaggtctcaactcgggccggaatcctctgaaaaattcttcaatattgggaagttcgcctccttcaaaatcaaaaatatgggtttcaatattttctttaatgagatgatcaatcaatacagatgctcccgataacttcacataatttttatcattgaaattacctaaaagcgctaccatattgcaatcggaataagtagcaattacattgataatcttctgctgatagtaaaatgcggtaaatttcagataccccagattgtaaaagctctcaaaaatcctcatgaactcagacaggtcatcttccttgctcagccctattgtgttagcttcaatgaaagctctggctttgtcaaaagatgtcgttttaatttcagaatcttttaaaacagcttcatctaaccgaagttttctttttcttttgggtgaatattttgcgtacactttctcataaacctcaggatataataaaaagtttttcttgattctgatctttgtacgaagttgattaacatcattaaaaggatatgcccggatcatgtaatttttttccagatattctaaaaaagcctcatttaaatccaaatcatctttggcagaaaaaacaccaagctgctgacaaagcttaggattatgtacaattttcatcccgtattttcttacaaaaggaacaggcattactgcttcataatctttataaacaagaatttcccagggcattgcagaagtagtatctaaaaaatgctttgtagcagaatattttctttgttcggaattttctaaacattgagcatatttaacaaagtcaatttcatggtattttaatcttctaatcatagtaatcctgaatccgaaaagctaaaataagactcctgtgtgacaataatatggtctaatagctggatgcttaacgtatttccggcttcttttattttctgtgtgatattaatatcttccctgcttggttttaaacttccggaaggatggttgtgcgcaatgataattcctgttgaaaaatgatccagagctcctttataaagagttcttacatctacaatagactggctgatcccaccctgcgtgagttgggagatatgaatcactttattactgttgttcaggaagatagcccagaattcttctgttctcagatccgaaagctggtttctaagaactgcataagcatcatgactattacctattatcgttttttcagggatttcctgtacagctcttctctttccgatttctaaggctgaaatgattgaaatagcctttgtctctccgattcctttgaatttcatcagatctttaacagaaagcaagcttagctgatgccagttgttattaacagaattgagaatttttcttgcaagctccacagcattttcgtccttatttccacttcccatgatgatggctaacagttcagaatcagaaagcgagcttttgcctttctgcaaaaacttttctctgggtctgtcatcttctgcaagaaattttatagccatggaaaattaaaatattatgaattaatagaatgcatataagatcatcggctttttggaatgatcgatgtatttagcagtttctttaaaagcatttaccgacagcataggacaacctaaactcaggcatgccggagtttcagattccatatcggaaacacattcgtaagagtgaagaacaatagctctctgcatggcattactgttggtagagtccaaccctgtcaaccgataagctttgccaaactttcctacatagctttctccaatgacatactttccaagtgaagactgataggagccttcaatattactgaattttaaggcgtctgattttggtataacagaacctgagccatgggaaactacagcctgctgtacaatcctgttatttttcaggttataaatgaaataacggtatttaccggaaggttttttaaaattgataaaaacagccagttcctgattatactcttttcctttaatataattcttaatttccaaaattcttgcctgtggcacattaagtgaattcaactgctgagactcagcctttgaacaggaaattacaattaaaagaagaaaaataaagtatttcatcatccggtttagtatactgttattctatgatcattccgtctttcatcacgagtttgcggtcagtaatttctgcaagattcgggttgtgggtaacgatcacaaatgtttgattgtatttgtctctaagatcaaaaaacaatctgtgaaggtcatccgcatttttggaatccaggttaccggttggctcatctgcaaaaataatttttggtgaattgattaaagctctcgccactgctactctttgtgcttctccaccggaaagctggttaggtttgtgattcagcctctgttctatctttaagtcttcaaataaagcataagccttttcaatagcttctctctcatttgctccggctatttttgtcggaagcaatacgttttccagagcggtaaactcaggaagaagctgatgaaactgaaatacaaaaccgatattctgatttctgaattttgatagctgcttatcattcatattgataaatgattctcctgctatttcaatttcagtatcatacttaccggattgggtcggatgatccagcgttcctaaaatctgcagcagtgtagattttcctgctcctgattctcctacaatagaaaccacctctcctgttttgatgtgaatatcaactcctttcagtacttctaaattcccataagacttatggatatttcttgctttaatcatgattcaaaaatagtaaattgccttcaaataaaaaaccgctttttgaagcggtttatattttattttagttttaagatgtttagatttcggtaatccattcaattacgtcttttctgttaatttttttaattattgcttccagattttgggcagaaaacataggttttatgtattattgtatccgttcaattcacaaaaaaacctcccggtttgggaggttttattatttttaattcagaaattacagtaacaatgttaatgggctttccaaataggttcttaatgtctgtaagaactgagcacctgtagcaccgtctactactctgtggtcacaagccaatgaaagtttcatggtgtttccaactacaatctgaccatctttaacgattggtttctcgattattgctcctactgaaaggatagcagagtttggctggttaatgatacttgtaaatgtttcgattccgaacattcctaagttggaaatagagaatgtagatccttccatttcgttagctttaagacctttgtttttagctcttgaagccatatcttttacagctgctgaaatctgtgtataagtcatctggtctgtatttttcaataccggaactaccaatccgtccggaatagctactgccacaccgatgttgatatttcctctgtgaatgatcttatcccctgcccaacttgaatttacctgagggtgttttcttaaagcaatagcagttgctttgatgatcatatcattgaaagagatcttagtatccggtaaagaattgatttcttttctggcctcaatcgctttatccatattgatctcaaccatcagatagtaatgaggcgcagagaatttactttcagaaagacgtttcgcgataacatttcttacctgagagttaggagtctctgtatcttcaccttgtacgaagcttactgcagccggagcagcgcttgctgcaggagctgaagcagctggtttcgcagctggctgatagttttcaatatcttttttaacgattcttccgttttcaccggatccctgaatactgttgatatcaactcctttatcctgagccatctttttagccagtggagagatcgcaaccctgtccgaagatgaagtgtttgcagcaggcgcagctttttcttctgttttagcttcagctttttgctcagccgattttgcagttgactggcccgcagcttttggagcacctaccgcggaaacatctgttccggcagggccaatgattgctaacacggaatcaaccggagcagcccctccttcttctacaccttgcttcaataatactccattgaattcagattcgaaatcctgtactgctttatctgtttcgatttcagcaagaagatctccttcttttactgtatcgcctacatttttgtgccatttagccaccttaccttctgtcattgtatcagaaagtctaggcattgtaataatttctactccagccggaacttctgcagtagcagattcagtggcaggagcctcagctttaggctgttcttctgattttttctcttcagaaccggcacttggagcagcagctcctcctgtcaatcctgaaatatcttctccttcatttccgataattgccaaaacagagtctacagcagcagcacctccctcttctacaccaatgtataaaagggtaccttctacttcagattcgaaatcctgaactgctttatcagtttcaatttcagctaaaatatctccttcttttactttatcccctacttttttatgccattttgccaccttaccttccgtcatcgtgtcggacaggcggggcatcgtaattacttctgccataatttattttaatttgaaaatttagcaatctgaaaatttgaaaattaaaaaaggacataatctatcgcattttcaaattctcaaattgtcaaattaactcattatcttttagttttctaatttgtctaggaatggataatcttcctgagcatatacatactcatagattttttccgggtccggatatggagagttttccatgaactcaatacactcttcaacaaaatctctcgatttgttatcgatagtttccaattccgcttcagtagcccatccgttttctaaaattctgtgttttatcaattcgattgggtcatcatttttgtgaagagcaacttcttctttagatctgtatggctcagcatcagacatagagtgtcctctgtaacggtaagttcttgcttcgatgaaagtaggtccatctcctcttcttgctctttcaatagcttcataagcagcttctgccactttttcaggatccattgcatctacagcaaggcaaggcatttcatatcctaatcctaatttatagatatcttcgtggttggcagttctttttactgaagttcccattgcatactggttgttttctacaacaaatactacaggaagtttccagttcatcgccatgttgaaagtttcgtgtaaagaaccttgtcttgcagcaccgtccccgaagaaacaaatgtttacggcctttctgtcgaaatatttatcagcaaaagcaatacctgcacctaaagggatttgtcctccaacgataccgtgccctccgtaaaaacggtgttctttactgaaaatgtgcatagatccacccatacctccggatgtaccagtagctttaccacaaagttccgccatgattcttttaggatccactcccatcgccattggatgaatgtgacatctgtaagcagtaatcatactgtcctttgtcagatccattgcatgtgtaaacccggcagggatagcttcctgaccgttatacaaatgtaaaaatcctctgatcttttgttttaggtaaagagaacggcatttgtcttcaaaccttctccacattgtcatatcttcataccacttcaggtatacctctttagaaaattctttcatgtgttagctcttgcttttttatgatgaaatagttgagcaaaattatgaaaaaaactttgtttttattctatacatagataacttttcaatttttctgtaaaatctatttgcgggctgaatggattattcttaattttcgagccctgcaggtcctgataaaacgctgttatctcttattcttcatgacgatcataactataaaatatgcctgtttataaggctttcataaaacaacaataaatatgaagcatcagaaatgtttcatattcatccatcaatctgtttcatttttaattattgttaacatagcttttggttatttcaacagcatcttttttttaatgaataaaggtttaagtttcaaacctatccttattttttatcagtaaatgtaaaagcaggattgaaaaactgataaatattttacgtctgaaaagcaattgattatcaaataaattctctgctacccgtccattccccaccattcttcttagttgctttttgaggttataatggtatatttgatcattaaacctgattatggaaggaaaaaagtcttcattactgcacaaaatttcaagagtcatctctgatttttttaatcctctggtctctctgatcctgttttttgtatatatgagtatcagagaatattctcttaaagattccatgctgtactttattcctatattattaatgatcattgtgccgatcatcatatggctggtctggaatgtgaagacgggaagatataccaacatggatgtttctaaccgtgttcagagaaaaacgctgtatatatttattgcagtttgtgtaattgcctatcttatttttaattatgtcagaaacggatatattgatcttgttatgcttttcattttgattcttttatttgcgcttcagatcagcaatctgtttatcaaaagttcgatgcatacagcatttaatatatttgtagcagctctgtttttctcgcttgactggaaaataggtctggtatggctgggaatcgcaattttggttggaatcacccgggttatattaaaaagacacaccgtaaaagaagtatttatgggagctggaatagcttttatggtatcttttatctatctttattgcaatattcaatttcaacattagaatactctatgaaaatacatcatcttactgccgcagaagaaaactttatgaagctgttttggaaaatgggatctttctatctgaaggacgttatggaacagcatccggaaccgaaaccccatcagaatacggtttccacttatttgaaaatattagttgaaaaaggctatttatcaactgtaaaagaaggaagaatcttcaaatataccacgattgttccattggaagagtataaaaaattcctgctgaaagagctttctcataattttttcagtgattcaggaaaggaaatcctggaacttttattaagcgaaaaattaatttcccaggaagatatgaaaggttattttgatcttaaaatcgaaataaagcctgctaaaaccgaagaaccaaagtttgagttggctgaagaaatcttaagtccgaaaaaggagaagaaggccaaaggaaaggagaaagaaaaagacaaggacaaaaagaagaaaaagaaaaaagagtaatctaccttaaaaaacaccaaatcatgaaaacaaaattccaggaaacagtaagccgggccaatgaagccattttccggtatccgatgattctggtaatggctttactggcttctattggtgctatatgcattatagaaacggaacacactgaaattacctcttatataaaatttaccatttgtgcgtgtcttggaatttctctgatgtttgcattaaaaatgctgtcacagagaatcgggaaagaagtactactgcagattttcggtattattttccttattggcttttacttcatcctgcctgataaaaagaattatttcaccgaagtctacgcttatatcattgctgttacagcgcttctctcccacttactggtttcttttatcccgtttctggagaaagacagagaactcagattctggcagtataataaaaatctctttgtcaatatctttcttaccgctgtatttacaggagttctgaccggaggagtggagctggccatcttagcagttgataagctttttgactttaattttcatgatagaatttatagagatactttttttgtcctggctattttcggaagcagctttatctttcttttatttaatgataaagggttaaatgatcttgaaaaagacggaacttatccggttgttttgaagtttttcacccaatttattttaatccctttactgcttatttatgcagtgattctttacttctattccgctaaaatacttatcaactggcaacttccgagaggttgggttacttaccttgttttagcatatagtattgttggtattcttgcattgcttctggtacatccactgaaagaagaaaactcaaaatcatgggtcagaatattctcaaaagcattttattatacgattgttcctttgattatactgctttttacagcgatctttacccgaattctggcatacggttatacagaaccaagatactttgttctcctgcttgccttatggctgttaagtgttgtagcttacttcattttctgcaaaagagcaaccataaaattcattccggtgagtttatttctgtttggcgcttttgctctggttttcccttacctcaatgccttcagcgttacgaaaagaagccagaaaacggaacttatcaatattttgaaccaaaaccggctgatcagtgacggtaaaattaatttccagaagaaaattaccgatacaatccgtgatgaaattgccgataaatttgaatttctggctgaaagaaagcagggagaatttttatcaactttactgaataaggaagatcaggctgaattagctgctcatattgatttcggtacattttacagtatacgatataatattcaaaaaagattttcagatgtgaatgtcacagtagaaaacaaagtatatgaaatgaacaaacagtctcttgttcctgaaaaacaagttgtggaaatcggagactaccagtatctgctttctttctatccttacagcaaaagtccaaaaaagctcaatgatgaccagtttgagcttacagattacctcttcaaaaaatcttcattaaaattaaggctaaattccaaagaggaaatagatttcggaccacaaatcattaagctgtttgatcaaaacaaaaacaagcaaggcatcataaaagtccctgaaatagcaatggaatctgatttaggaaaataccatgtcaaacttattttcagtgaaattacacgggaactgtattcagataataacctgtcaaccatttattatcaaaatgcttatttacttataagattaaaataaaaaataggatatctgcgatatcctatttttattaatgttacatcattctccaacacagaaaattatatcagtcatctaagaatataattttggattcttacgaaacctgaccggagattaaatttcacaaaaaaagcggcttaaaagccgcttcattatttttaccaacgatttccgcctccgccacggttgttaccatagcccccgcctctgttgttgttattaccgtaacctccgcttctgttattatcgaagcttcttcttggtttttcttctcttggtttagcttcagatacgtttaaagtctttccgttgaattctttttggttaagagattcaatagcctgctttccttcatcatcacccatctctacgaaaccgaaacctctggaacgaccagtttctctgtctgtaacgattttagctgatgatacatctccaaattctgcgaatagatcgtgcaactcatactctttagttgcgtaattgatgtttgaaacaaaaatgttcattttaaataaattaaaaaattaataaaaatttggtatataaaagaaaaacaacataaattaatgaacaaatattgattccaaatataaacgtatgcaagatacaattaaaaatttcaaatcaaagctttttttacatatttctcacattatgttgaatcgggattactaaatacaataaataaaccaaataaacaattgatataaaacaacttacactacattaattcttttagttaaattatttaacatttaagtatcaatcataattttttttaacttttaactcacagaaaatatgaaacaacacaccaccaattatatcaatacgcttattgaagttgctgaagactgccctgtttcccaagcgaatattcctgctgaaaagaaagaaaaaacactggccaatctccaatatgaaaaactcataaagaatccctatcaatattcttcagatgatattatttttgagtgttatgccattaaaaatgacattccggaaagtgaaagacagcatgaaagagaaaagttcttctccaagggacagccttgtctccgctgttctcctttagcaaaaagatacggtttcggatttcatcacaacacagaaggaaaagttgccctggttcctatggaaagtaaagaatatgaaaaattactgaatgattcctccatagcaaaaaccagagccatgcgttccaaaagaaaatgattgagaaaatgaatgattcttttcagatcaataaatgctattgttttgaaaagatcagcttttaacagtaaatttgtattgcaaattattaaaagatgaactatcatacaagaaaatgggtaaaacccgaagatttaaatcctaaccactcacttttcgggggaagactccttcaatggattgatgaagaagcagcgctgtatgcaattatccaattggaaaacacaaaagtggtgactaagtttatctccgaaattaactttgtcagctccgccaaacagggagacattatagaaataggaattgaggccacccatttcggatcctcctctattacattaagatgtgatgtgcgaaataaaatgactcatcaaacgattattaccgtagacaaaattgtaatggtaaaccttgacgcagatggtaatcctgctcctcatggcaaaaccagaatcgaatttgtaaaagacaggttaaacagcggcttatgaaaattttcataaaaaatatggtctgcaacaggtgcattgcggcagtggaaaacattttccgtaatgcagatgtgaagatcaaagatattttgctgggagaaatagaaaccgaaactgatatttctccggaaaaaatgaagtttatagagaaagaattactgaatacaggtttcgaaagaattatggattctgcccatcagcttgttgaaaaaatcaaaaaccttattattacaaaggtcagcgagctggatattgcagaaaatttcctgctttctgaatttttaagctcaaaacttcataaagattacagttccctttcaaaaacattttcacagaatgaaaatattaccttggaacagttcttcattcttcagaaaattgaaaaagtaaaagaactcttactctataacgaattcaatcttactgaaattgcaggaaaactaggctataaaagtgttcagcatctttctacccaattccggaatgtaaccggatttacccccacagaattcaaaaaactgaaagagcatcaccgcaaagcgcttgataccttataaacaggagtgtttgagaatttataaaaagatatttaactccttcacccaaaaactctcaaacactctcaccttaccactctcaaactctccaacctaattttataactattatccttaaatttataacaaccttacttttccattttggaaatttgtagtataaatttaagaatcatggaacaacagtataaaatactcggaatgacctgttcaggctgccagaaaaagatttcaaatcagctgaacagccttgatggagtgaaagccgatgtaaacctggaaaccaataccgcaaccatcacttctgaccatggagtgaagctttccgttttaaatgatgcactggcagaaataggaaaatacaggcttgaagatcctgataatcctgaaaaaacctttgtaaagccccaggatcgcgtatcgccgtcttcagtatactattgcccgatggaatgcgagggagataaagtctatttcaaacagggagaaagatgccctttttgcaatatgtatcttgtacccattgaagaaaagctggccaaagatcctcatcacaaaccggcttattctgcagcccatcttcctgaaaactttaaagacagcattggaaaatattattgccctatgttttgtgaaggagataaagtatatgatgaaaagggagattgtccggtttgccatatgcatttggaacctatcactgaagaactagttcagaaagcaggcgctcatcagcatcattcccattcccactctcacaaccatcatcatgacgcacctaaagtaacagatgaaatggcaggcagatattactgtccgatgtattgcgaaggagataagacttacgattccaatgtcggatgtccggtatgtggaatggaccttgtaaaataccctgaaaagaaaactgctaaatatacctgtcctatgcacccggaaattatccgggatgaaccgggagactgtccgatctgtgggatggatctcgtcagaatgcctgacagcggtgatgatgaagaagatgaaacctatactatcttaaaaagaaaattcattatttcattaacattcaccattccggttttcattctctcgatgggaggaatgtttatcaacttccctttttcccatcaggttcagggatttattgagcttgctctgactcttccggtgatgttttattccgggtggttcttattaaaaagaggctgggtttctttcaaaacatggaatcttaatatgttcagccttattgccctgggcgtagctgcggcatttattttcagtattgctgctttaattttcccggatatcattccacatgaaatccgtggacataatcatgaaattccgctgtattttgaagcggtctgtgtaattttaacgcttgttattttaggtcagctgatggaagctgctgctcataaaaaaacaggaaatgccatcaaagaattgatgaacctttcgcccgatgaagccaatcttatggtgaacggtgaagaaaaaagagtgttactttcacaggtaaaaataggagatttattaaaagtgaaacccggtgaaaaaattccggtagacggaaaaatcactgaaggcagttctgttgtagacgaaagcatgatcacgggagagcctgttccggttgaaaaaaatgttgatgataaagtatcttcaggaacaataaacggaaaccaggtattcatcatgaaagcggaaaaagtaggtgacgaaaccctgctttcacagatcattaaaatggtcaatgaagccagccgaagtaaggctcctattcagaaacttacggataaagtctcaaaagtatttgttcctgtcgtgatccttattgctgcgcttacctttgttctgtggcagtttttcggtccggaaggaaaaagaagcttatttgccttcgtcaatgcagttgctgtactgattgtagcttgtccctgcgcattaggactggcaacgccaatgtcgttaatggtaggaatcgggaaaggtgctaaaaacggaattctgatcaaaaatgctgaagcacttgagcaaatgaacaaggtgaatgttttgatcactgacaaaacaggaactttaacagaagggaaaccttcggtagaatatatagaaacggctttcggtgatcagaatcagattttaaagctggctttttccctaaatcaaaattctgagcatccattatccaacgccgttataaaaagagcaaaggatgaaaatacaattgctgaaaaagtagaccgttttgaaaacatttccggaaaaggagtgaaaggaaatattaatggaaaaacagcgtatttaggaaatgaaagtctgctggcctcacatcagatccagattcctgaaactttaaaacaaaaagcagtagaagtacagtccaaagcgcatacgatttcttatgtcgcacaagaccagcaagtacttggattcattagttttacggataaaatcaaggaaagctctaagaaagctgttaaacaattaatgagcgaaggcattgatgtgatcatgatgaccggggacaacgaacacactgccaaagctgtagctgatgaattaggaatcaaacatttcaaagcaaattgtcttcccgaagataaactgaatgaagtgaaaaaactgcagcagcaaggaaaaatagtagccatgaccggggacggaatcaatgactcccctgccctggcccagtctgatgtgggaattgctatgggaacaggaacggatgttgccatcgaaagtgctgagatcactttattaaaaggcgatatcttaggggtagcgaaagccaaactactcagcgaaaagcttctcaaaaatattaaagaaaacttattctttgcttttatttataatgtactcggggttcccgttgcggcaggattattgtatccattctttggaattctgttatcaccaatgattgcagctgcagcaatgagcttcagttctctttctgtgattctgaattcattgagattaaactccgtggatctggatataaaatagcattatgaaaaaagaaaatctttacatagggtgttcgggattttataataacgactggaaagggtctttataccctgaaaatgcccaaagtaaagattttctttctttatattcaaaaacattcaattctgtagaaatcaattctactttttacagaaaaccaacctcaaaaacactgtcgaaatggtatgatgaaactccggacgaattcaggttttttattaaaattccaaaatccgttacccatcagaaccggcttgaaaactcaaaagaagaaattgccctcttttgcagtcatattgagagtaatctcaaggagaaactttccggatttctctatcagcttcctccttcctttaaaaattcaactgagaacacagaaagaatcatcaacaatattgatcatcgatttctgaatgtcattgaattccgtcacaactcatggtggcaaaaagaaatatttgatcttttaaaagaccatgatatcattttttccggagtaagctttcccggtgatcttcctgaagatataatcatcaatcatccggatattctttattacagacttcatgggaaacccattctttataaatctgagtacggcagggattttatggataaccttgctgagaaaattaaaaacagcaggaaaacagcttatatattcttcaataatacctggggaaccgctgcgattaacaattcattgtatttgaaaaacattttagaataaacctctgattttgttaaaataaaataattccccaataaatgaaagatattgaaatcttaacaaatatagagaaaagctatcggtttcgtatttataaatgttaaaaataaaagaaaaggaaattataaatttataacattctataaaattgaaatatcctttaaaataaagttcttaaaataagcttaaaaaggaaatcacctgcacagcatggcatataatttgttaactttcaattgttatttttaacgatttttaacaatttaaaattccactatttttatgagaaaaatttttgcgggaaagtcaaaaaataagacttttctcgggatgtttgcattggtgagtgcaacttcggttttattgaacagctgtaatttcaagagtgaagtgaatactgactccgccgtcagttcacaggaacatcctgccgcagaaatagtccccaagatggacgatgaaagcgtagacccggataaaagagtgatctaccttacctttgatgacggtcccaaccagggcaccgaaaatctcttaaagattctggacaaaagaaacgtttgtgcaactgcctttctggttgggaaacatgcatatggaagcaaaaaacagaaagacgatctgttgctgcttaagcaaaatccgctgatagaactggctaatcacagctttacccatgcccataacaagtataccgacttttataaaaatgctgatgctgtagtccacgattttgacattgccaaagacagcctgaagcttactgataaaatagcaagaactcccggtagaaatatctggaggctgaacaatattaatgtaacggatatcaaaagctctactgcagctgcggacgggctaaaaaaagccggctacaaagtaattggatgggatctggaatggagaccttctcaaaaaatgacgttaaaaggaagtcatgaagccatgatcaagaaagtagacagtattttcttaaacgatcttgagaagacttcaagacaccttgttttccttacccatgaccagtatctgagagatgcagattccatcaacgaactggatctgtttattgaaaaattacagaagagcaacaagtttgttttcagaaaaatttctcagtatcctaaaatcaatgaggtattaaattaagaaacacttcataactgatatcactgaactttgaacattcagagaattttcggacatttgtatttatgagtattaaagagaactataacgcaataaaaaaccagctgccatccactgtgcagctggttgctgtttctaaaacacatccagcatccgccgttcaggaagtttatgatcttggacaaaaagttttcggagaaaataaggttcaggaactgatggaaaaagctccccttcttcctcaggacatccaatggcatctgattggccatttacagaccaacaaagtaaaatatattgccccttttatagatactatacaaagtgtggattctgaaaaagtattggcagaaatcaataaagaagcaggtaaaaataacagaatcattaaagttcttttacaggtaaaaattgcggcggaagaaagcaagttcggacttgacatttcagaagccagagacctgttcgggaaatatagggatgggcagtttcctaatgttgaaattaccggcttaatgggaatggctacattcacggatgatgaacagcaggtacgaaatgagtttttaatcctgaaaggtctttttgatgaattcaatcaattaaaagcattaaatactttatctatgggaatgagtgatgatttcccgatagcgattgaatgcggagctaactctgtgagggttggatctgccatttttggaagaagagactattcaaaatagaatatttaggtatagtttttgctaataattgaaacaaaaaatttaaatttgcaactatgcaaaaaatccttatagtagaagacgaaaaagcaatctcgggagtacttcacagtattctttcggatgaactaaccgattatgaatttgttattgccgaagacggccttgaaggttacaaacaggtagaaaaagaagatttcgcactggtgatttctgatatcaaaatgcctaagctttcaggaacggagcttttgaaacaaagtcttgcattaaaaccagaaactacttttatcatgatctcagggcacgcagacatcgattctgccgtttcctgtttgaaagaaggagcatatgattttatttccaaaccaattgatatcaacaggcttattacaagtgtgaaaaatgcattggtaaaggaaactctgaaaaaagaaaacaagaatcttcagactgaaaataaaaccttaaagaaaaaagtaagcaaaaagtaccagatgatcggtacctctcctgctcttcagaaaattcaggatatgatcgaaaaggtagcagcgtctgacgccagagtactgatcacaggacctaacggtgcgggaaaagaattggtagcccatgctatccacaatcaaagtgagcgtgcaagaggcccaatggtagaagtaaactgcgctgccattccatctgaacttattgaatctgaacttttcggtcatgtaaaaggttcttttacgggtgctattaaggataaacagggaaaatttgaacaggctaacggtggtactattttccttgatgaaattggagatatgagccttatcgctcaggctaaggtattgagagcgctgcaggaaagcaaagtttctcctgtaggaagtgataaagaaattaaagttgacgtaagagtaattgcggcaacgaataaaaatatgcagaaagaaatagaagaagggaaattcagagaagacctttatcacagactttctgtaattgaaatttatgttccgccattggatgaaagaaaggaagatatcaagttattggttgagcactttgcgggaatgattgctgatgagcatggtactgccgcaaagaagtttgacgataaagctattgacgctttaaaagccctttcatggacagggaatatcagggaattaagaaatgttgttgaaagattgattattcttggtggaaatactgtttcagaaagtgacgttgcaagttttgtaaggaaataataagctattatttaccatattataaaaatttgcagtgttaccactgcaaatttttttttacccttatttgaataataaactatatgaatcttaaaatattatgagctttttaaacaaaaactatacgaaggaatgcctgactctggctctgcctgtgatgcttacccaggtagggcaggtttcagtaaacttattcgataatattattgtcggaaaattattgggtgccgatgcgctggcatccgtttcattgggaaatgctgtatttttctccatatttgtattggcccttggattttcatttgccatcccgccgctggtttcggaggcacactccagagaagatcatgctacgatcaactctgtgttcagccacggttttatcatcaatatgtctgtcgggattattctgatggccatcttactgctgggaatgccactgctctatcattcagggcagcctgccaagattattcctgatacagtaagcttcttaagcatcatggtgatcagtatgattccatttatggcatttcagacgcttcgtgaagtatctgaaggactatcatacacgattggggttacaaaagcaaccattattgccaatattatcaatattgccttaaactatgtttttatcaaaggcctttggggaattccgccgatgggtgtaaaaggatctgccctggcaacactgatttccagaattttcatggtggttttcctttattttgtattgcttaaagaaaagagaacaagacgttatattaaagatttttctttaaaaattcagggcttttcaaaacagatgtttgataaaatggtgaaacttggactgcctacagctttacagatgttttttgaagtaacggctttcgccggagcagcatttatctgcgggttgatttctgcgcacgatattgcttctcaccagattgctctaagcatggcttctttcacctttaacctgtgtgttgggttcagtgtggcctctacggtaatgatcggaagaaagctgggagagcagaactttgttgagctgagaaaagtaggaatcaacaacctgaagatcgcctttattttcatgtgcatttgcgggttggtctttattttaggcagaaatatacttccgactttctttacgaaaaaagaagaagtggaagttattgccctggctgcaaaattgatgattatagcagcgttgttccaactttctgacggaatccaggtaacagctctgggaatgctgagaggactacaagacgttaaaataccgtctatttatacctttattgcctattgggtgattacaattccattgggatatttcttctgtgtttccttaaaaatgggtgcattcggaatgtggatcgcactgggactaggactgacagtatctgcagttttcctcgtaaaacgatttttaaacatgtccgcaaaacgaattaagcagaatatgcagacaaaagcacaataaaactaagcgcagatgtaaaaaatctgcgctttttcattatttttggtgtcgataaccatcaatagaaatgaaaaaaacactgatcttccttgccttatatgcaggttcttttttccaatcccaaactaacagatttacttacgaacttcagtaccgcaaaaatccatcacagcaatatttaataacccttatgaatctggatatcagtcccgggtctgttaaattttatgataaaggctttgctgattatcatgaaaaaaataaacatgcaaatcagcagatttcccggtacagtacgaaaacagatcaggtggtggaaagaaaaccggattcttttaaaaataactggtacagagatttttttgattattttgtagtaaaaacaaatgatgaaatgaagtggcagatcattcaggagaccaaagaatacaatgggtataagcttcagaaagccagtacagatttcggaggcagaacatggaacgcctggttttccaacgaagtgaatatacaggaaggtccttataaattcagaggtcttcccggtctcatctttatcttagaagacacggatcaaaactttgtctataaactgattaataatgaaaaactaactacagactacgatacccaagattttgtagaaacgcattacggcaaaccggctatccagataaccaatgagaaatttaataaatacattgaggacatctaccaaaatcctacaagaatgttctccgagagaataaagagcggagaaaagagtaactttaaaaatgaaacgatagaatctgtagaagaactcaataaaaaaaaggaaatgctccaaaacggaatcaagggccgttatatctatattgaaaaagataaacaacctgaattcaactgatacaaataaagcggcccccagccgcttttatatttaactaattcttcttcccaatatgaccaggcttctttctattccatccaaaacagcaacattcggaagatttccccaatcttcaaatccgaaatgcctgaagagctttaagctgggttcattgtgaaggaaaataagggcaaccagattaagcactccaaatttctccgcgttatcaatacaatactgtagaatcgttttaccatatccttttcctctgcaggactcatccagataaatgcttacctctaccgtacccttgtatgctgctctttcatggaatgaactgaagcttacccatccgataacatgattctgttcatcttcaactacccaaagcggtcttgtctgaggattatgctcttcaaaccattttagcttgctttccacagaaacttcttccatgtctgcggtgaccatccttgaggcaattgttgaattataaatggctacgattttgttcaaatctgacaattcagcattcctgaactttaatttttccatggatgaatattcgacttaatttcacacaaaaatactaaatttcaaacacaacccctgtagattcacaaatggattattcaatttcgttgtttaccaaagttcacccctaaaaaatatacatcaattcaatcttatgggcacttaacaatttcatttttattgtgaaaaattattttaagtcttttaagattctattcagacttcttactgtaattcccaggtaagcggccatatcttcttttgaaatctgaattccttctttggcctgcattttcagtaattgtgttaaagtatgctctgttgtataaagctgttgataagatgccctgctggaagtattgataattcgttccgcaaaaatatccagcaataaattatttaaagcaatatcatttttaagcaaaaatctgaaatacggaatggcaatctcataaacagaaacttcagttagtgtttcgatactgcataagcatggtgtatttttgatcatctctatttctccgataatttcaccgcttccggaaaactctacaatatattcttttccgttttcttccgtaaaatagcatttggtaattccttccttaataatcataggtttgagaataaactgcccttgtaccagaatctgctctcccctgggataagttttcaacagaatatctctgccactctcctgtttatgataaagcgcttcaaaatagcttaaaaaggtctgattggtgcgtaacatattgatccgggacaaatgtcctttgcttgttgggtttttatactgaattttgagatcagaaaattacaaaacaaaaatgaataatcatatcacaaccattgcatttgatgctgatgataccctttggatcaatgaaccgtattttcaggaagcggaaaaagagttttgcatgctgctcgaaaattaccttccacagcattctgtatcacaggaattatttaaaacagaaatgcagaatcttcatttatatggttatggggtaaaaggttttatgctgtgcatgattgaaaccatcagcagagtttccaataatacggcgccattggaactggttaataaagccatacaattaggacaggaacagcttcagaaacccattgaactattggatggagttacagaaactcttgaaagtttaaaaggaaaatacaggcttgttgtagccaccaaaggagatcttctggatcaggaacggaaactgaaaaaatcaggattacaggagtatttccatcacatagaaattatgagtgataaaaaggagcatgattataaaaagcttttgaagcaccttgactgcaaacctgaaaattttatgatgcttggaaattctattaaatcagatgttttgccggtgttggaaatcggaggttttgcagctcacatcccttatcatgtcacatggagccatgaacagcatgatgttaatctggaacatccgaattttatggagcttaagagtgttgatgagattctgaaatatctttaatcttaggccattaagatttattaaaaaaagagactgtttatgataaacagtctctttcgtaatttatttcttcagacacttttcaaggaactgatcctgttcccatagaaggtgtaagatattttcttttgcctggtatccgtgggcttcttttggaagaaggaccatttttacaggagcacccagatttttcaatgcctggaagtatctttcagtctgtaaagtgaaagttcccggattgttatctgcatcaccatgtatcagaagaagcggagtcttcattttatctgcatgcataaacggagacatcgtattgtaaatttccggaacatcccagtaatttctctgctcactctggaatccaaaaggtgtcagcgttctgttataagcaccacttcttgcaattccgcatgcaaaaagatcagaatgggtcagaaggtttgccgtcataaaagcaccgtatgaatgtcctcctacagccactttctttctgtcaatatacccaagatgatccacagcatcaatggctgctgctgcatttgctaccaattgcggaataaacgtatcattcggttccgtttttccttcaccaataatagggaaagcagcatcatcaagtacagcatatcctttcgtggtccagtatacgaaagatccgtaatatgggaatgtgaattcattagggttttgggtgttctgccctgctgtatttttatctttatattctgtcggataagcccagatcagtaaaggaagtttttcttttttcgcttttctgtcgtaattagcgggaagataaagagttcctgttaaagtaacaccatcatttcttttataagtaattacttctttgtaaacgtctttgatactttcaaaagggtttgcaaagttggttacagcttccgctttatttgatttaatattctttttaaaataattcggatactggcttggagactgctgagtggttaaaatctcaccttttgaaggattcagaatatctacgatagtctcttttgcatttttaaggttagaagtataaagccttttcttcttcaatgatttaacatccatttcatctatgaacgggtgctgaccatctttggtaaatccatctcctatcaggtaagcttttccgcctttcatatccactacatatctcccgtattggttttttgtagtgttaaagttcccgggatcgctgtaaacatcctgataatttctgtcatcaaaaactttagattctccgttagtaagatctatcagatacgattttgtatttcttgtatcgtaccagccttcagaaacaatggcataatggtcatttgtccagactacatcttcatatctctgctttgttttaaagaaagatttcggagctgcagtaaaaggtgcttcccatgtaaatatctcatctctgtaatctgcggttttagactgatcacctccgtccagagcttcagcataggtaagagttgcgggagcatcatttcgccatgtcatatctctctttccggttcttactgatgaaaatcctttcggcatgatttcattcaaaggaacttcattcactgtttttacagcatttcctttcatatcatatacaatcgttactgatgggaatctgctaagcggaacgatataggaaaaaggttttttaattacggtagccatcaggtaatttccgtcaggagaaaaacttaagcctgcaaacatatcctgatctttgaatttcttaagatttcctgtaaggtctacattatagagttcagaagcagtaagtgtttcaaagtttttttcgtcctgaggatttttcagaagatcctggtatgttctgttttgggaaactttaccatcagccgttgaaacaatcgggcctgtaggaagatctttggctgcatctataagggccggtctgttttgcggaagtgttctgatcagaaagctttgagaatcattataccatagataaggcattcctaaattggcattcagattatcagctgtaattttttttgcagcagcggtttccatatctacaatccaaagctctacgcctttattggttgtattggtaaaagcgagtttcttttcatccggagaaaacgaaacgtatgcaattttcggattggaaggcagattttttacctgaatctcatttttatcattgatctttctgatcttcagattatttgagtaggtcatgctgcttgagatattggtaaccggattgattctgagtccgccaagcttcatttcattctggctcagatcttccagtgttttatatgttggacgatacgtaaaaactacccagtcttttttgctgttcatcagaacaactggtggcctttcatagtctgcaagctttaaaatctcggcagaaggtttctggtacgtaatattttcctgtgcatcgtaaaaattgagaaatgccagaaggcaaatagtcagttttatcttcatataattcattttctacgaatgtagtgaatttcaccggaactggcgccctatctgaaagagtttactgctattatatctttaaaaagagaaagcacttcaaatgaagtgcctttctttatttgtattgctttatcctttaaattaccagtctgaagctctttttcttttttctatcatatgatctacggaaacttttccggctcctattaccatgagcagaagataaacagacagatagaccagtgccaactctcttttttcaaaaggatctgcaccatgtactataaaacctgcaatgatcatggtaaaaatcaggaatcccagagcaactcttgtaaaaagtcctaatataagtagtattgaacagacaaattcagcaaaaaccgtaagaattagcgatatctgtggccccagtcccataaaatcgaaaaactcgattttaccaccttccaatagcatctgaagctttggaaaaccatgataaagcattgcaaaaccaacaaataccctcaccaccaataaaacaatatctttaggtattgagcctgaatttgaattattatagttcatctactaaaaaatttatactaaggtaataaaaatcttttaatataacgggattccggccgttttagtttatctgtaaccgaaatttttgagatccctgtcattctttctccagtcttttttcacttttacaaataagtttaaatggatttttttagtaaagaatttttcaaggtccaatcttgcttcagttcctacttttttgatagcttcccctttgtgaccgataatgattcctttctgggtatctctttctacataaataatagaatcaataaagataattccttctttctccttgaactgctctgtaaccacttctacagagtatggaatctctttatcataattcagaagaattttctcacggatggtctcattaacaaaaaacctttcaggcttgtctgtgaactgatctttatcgtagtaaggaggattctcgggaagtaacgattttattttaggaagaatcacttctgtattgaaagcattcaaagcagaaataggcagaatttccgcctttgggattctgttgtgccactcttccaccaatttttcaagacctgcctgatccgtctgatctactttattcagcagaagaaggacaggtacaggaattttattcagtttctcaattaaaaattctgacggttctgctttatcggtaacatctacaataaacaggaaaacatcagcatcctgcagagagtcttttacaaagtccatcattttttcctgcagcccgtattttgggtccaatactcctggagtatcagaaaatacgatctgaagatcatcttcattataaataccaaaaattctgtgacgggttgtctgcgctttctgcgttacaatcgctagcttttcacccattaattggttaagcaaggtcgattttccggcattgggctttccaactatatttacaaatccagctttgtgcataaaaataatattacgaactgcaaagttagtaaaacaaaatcggtctttacagtttatctcaatatttagaagaaaaaagagagttatataaccttaagtggctgtaataaaagaaattttaaaaataaatacaaaaacggatattttgcaaggttaaaaaatatccgattattttgtattgcattacctaaaactgatatttttgaaaattagaattcatctttatgaatatagaccagattcttgatcagatttaccttcttcctgaagcatcaaaaaacagtttaaaaaagcatatcactgaagtttcgcatcctaaaggtttctgcctgatggaagcagataaagtggttccctatctgtattttatcaggaaaggaattgcacgtgcctattcttcaacgtctgaaaatgatatcacattctggtttggaagcgaaggccaatgtatattatctatgaaaagctatgtagaggataagcccggctatgaaagtatagaacttctggaagactgcgatttgtacagaatggaaacggagaacctcaaaaaactctttaatgaggatattcatatcgctaactggggacgaaaactggcagaagctgaaatgatcaaatccgaggagctgatcatttccagacagttcaaaacctctttggaacgttataaggatattatgacctatcagcctgaattgcttaagagagttcagctgggttatattgcttcttatcttggaattacccaggtaagtttgagcagaataagggcggagataaaataatttttgattttgaggatggaagctggaggatggaagaaggaagttatgatagtccactaaggaatcctgctcatttttagtaattaatgcttctaagaactttatctaaaaaatgtttgctaattatcttatgagacaataacttcaagcttgccttcattttttaacaattgtaaaattttttctgcctccaaattctgaactttgcagtagaaaaatttaaaaaatgaattggattatattaattgtagccgggttatttgaagtcgcgtttgcatcgtgtctgggaaaagcaaaagaaacttctggaacagaatcctattactggtttgccggttttctggtaacaatgactatcagtatgcttttactgattaaagcaacccagactttacctatcgggacagcttatgcggtctggacgggtatcggagcggtgggaactgctttaatgggaattatcttctttaaagatcctgtaagtttttggagaatattctttattgtaacccttattggttctgtagtaggtttaaaagcggtgtcttcatcacactaaaagcgcataacttctatcaatatttaaaaacaaaaaccgtcttcataacagagacggtttttttgtttatttcaaatcttcattttaattatactgtcaaaacagataaagaagaaattctttatatctttaccggaaacttttaacctatgaaaaaaattctattccttttagcaggtggtttactgactgcccagcaaacttctgaactcctttccaataattggtatatttccaaaatggtgaccagtagcggccagaccaccaatacccctttaatagataacggagttcctgctaccacattcaattcagtgggaggtacaagctatgttattaattccagatattacaatacatccatgatgagttttggagttatgcctggaagtaacaatcttatcaaaacggccagctcgtgtactcttttgttttataatggcggaaatgcatcagctgttcgtgcctacgatcagaaaaactgtgacacttacgtttcaggagcttatgcatctatatacagctatcagattattacaaacggtaacctcaaaacactgataattacagatccttcaggaaataaagtctattataacaatacgacccaacttaatactaaagaaattgatgccgttgcaaaaacgtttaaagcatatccaaatccggtaaaagagatgttacatattgaaaatattgagagaaatcttcggcttaagatttatgatctctctggaaaactggtatttgaaactataacgagtggtgttaatatttccattgacacaagcagttttcaaaaaggacagtatattttagttcttgaaaattataaatcttatccttttacgaaagagtaacagaaaataaaacccgtcttcaacaattgaaaacgggttttatttattttttataaactacaggtaagatctcattatgtctcagcccatatttttttatttcttcttcagagaatttctgtgagtaaaaattaggttctgtttcaaagcctgcttttcttaagcggtcaaaataatccattccataccagcggacgtgatcgtattgcccgaagtgcttctggcgttccttaggatctttaatggtaaaatcttcataggttttctccagtgaatttttcatcggaacctgaagaattccccatccaccgggctttaataccctgtacagttcgctcattgcttttgcatcatcttctatatgttccagcacgtggttacagaacacaatatcaaagctttcattttcaaacggaaggtccagaatatcagcctttacatctacaatcggagaatataaatctgctgagatatagttaagattgctcattcttttgaacttccttaaaaactcctgttcaggagcaatatgcagaactttataatttttaatgaaaaaatcagtttcattctgaagatagagccacatctggcggtgtctttccaaacttaaagttcctggggaaagagcattttcacgctgcttaccgtatccgtacggaaggaattttctgtaagatcttccatcaatagggtctaaaaactgatctcctttgaaaaactgataaataagcggccttgcccagatgctcattttaataagcatcggacgtggaattttattcagtaaaagcttcgttaattttttcattaaaaatcaagttggaactgcttttcttcatcacttacaatccctaaagcttcatatacatattcaaatgttgaaagtaataccggcttaccgttgattaccgctacgtcatgttcgaagtgagcggatggcatattatctaaagtagtaaccgtccagccgtcattatggaatttcactttttcggttcccatattaaccatcggttcgatagcaatggcaagaccgtctttaattacttttccgcttccttgtcttccgtagttaggaacctgtggatcttcatgcatttttcgtcctaaaccgtgtcctacaagttctcttaccactccgtacccttctttttcacagtgtgcctggattgcgtgggagatatctcctattcttttccctctgatacactgctcaatccccttatatagagattccttggttacctgcagtaattttttaacttccggctttacttccccgatttcaaaagtataggcatgatctccaacaaaaccgttaagaataactccacagtctactgaaagaacgtctccttcttttacgacatcgttgtttggaaagccatgaaccacctgctcattcggagagatacaaagagaattcgggaatcctccataccctaaaaatgcaggttcagcaccatgatctttaataaaatcatgagccagtttatctaaatataaggttgtaattcccggtttaatttcttttgccaacattcccaatgttttagaaaccaaacgggcactctccttcatcagacgtaattcgtctatcgtttttaattgaatcattgtatatagatgttagatattagatgttagaagctacactacagcgttatgcttatttttacttcccgtcatctactgaactttctactataaattataaaagaccaaaagcacttgatattaaaaactaatgtctgatatctggcttccaatttttatattctaccaaaaaagtccttttttcttttcttttttaagttttgaataggcaagaacttcttttccttctacacggaattctattctttcctgaataatgttatagatttcaccccagcccgggaatcctcctaagtttctgtcatcaataaaccaatctgcatctaattttctggactgtgtttcaggatcaaaaatctctccttcaaagcttgaattcacagaatagaactctattccgttttttctgcagaattctacagcttcatccaacgtttttccgtgtctgtatgtccaaagtataagtctgtatccttcagcctgaagtctttttaaagtttcgaatgcaaaagttttcggttttccgattgccgggtaggcatcatcaacaatagtcccgtcaaagtcaacagcaatctttttattatttaacattttgttgttttttttagctttgcaaagataagaaataaaaagagtgccaaaaagaaaggcactcaatactttttatatttaaataataataaacttcttatcagctctttacccagctaaactggaactgaagatccggagtagaaaccctgtctgtgatcttctgaagtcttgcaggaagcttcatcaggtattcctgagctttttctgctttttctgtaaggccttttacgtgctcaattttccattcatccaaaaggtctttcataatattgatataatcctgtcctgtatataccatacatctttgagcagcatctgagaaatgtccccaaagctctccagctttttgtccggactgtctcattaggtgggcaggcattacaattttcttacgcatcatatcttcaaacgcaagaatcatttccgaaggatctatttcaagaatttttgctacaaaatgcttatatgctttagcatgtctggcttcatctgcagcaataacaccacacatttttgccagttttccgttaccggattgttttgccagcgttcctacccttctgtgggagatattcgttgctgtttcctgaaagcttgtataaatgaagtttctgtacggatccatgcttgttcccagatcaaaaccgtcgttgataaggtattgggtagtaatctcaacctctctcatatttactcttccgcacaggtaaagatatttgtttaataaatctccgtgtctgttttcctcagcggtccaggctcttacccagttggcccagcctactttttcttcctgattgattccgtcaacacccatcagccatgactcataggaaggaagagcttcttctgtaatacagtcaccgattaatgttacgaaaagatcgtaaggcatttcacgggcaaatgtctggatttcttctaaatcatgtttaaaatcttcgcttgacggatctggcaaataatcggagggttgccaaattttttcaattggcgttaaaaatttatcaagaaaagaagtcacttccttttccaatatccccattacttctttccttacaagcttttgatacattttactattcagttttaatttacaaagatatgatttatttattatttggcgcataataaagtatgcaagtcataccttatctgacataaatcataaaaaaaatgccgttataaaggtataacggcatttttattcggatattattgaattttaattaaccaaaacttctccggtcatagcatccggtatttccactcccattactttaagtatggtaggagctacatcgcctagttttccaggttttaaattccatgtgtggtctttatccatcacgataaaaggaaccaggttcgttgagtgctgcgtatttggagttccgtcaggattgatcataacatctgaatttccatgatcggcaaggatgaaaacagcataaccgttttcataggcagctgttgctactttttcaatacactgatctaccacttcagcggcttttactgctgcttcaaagacacctgtatgtcctaccatgtctgtattggcaaaattcaggcatacaaaatcagcggtcccctgctccagttcaggtacaattgcattggtaatatcgtatgcggacatttccggttttaaatcataagtaggaacatctttcgggcttgggcacaacagtcttctttctcccacaaattcctcttctcttcctcctgagaagaaaaaagtaacgtgaggatatttctctgtttctgcaattctgatctgagttttcccatttttctcaaggatttcacccatagtttccgtcagtacattttcatcaaaaactacctgtacattctggaaggttttatcatagttcgttaatgtaatataatacaggttcagtttcttcattccaaactcagggaaatccttttgagaaagaacttctgtaatttctcttcctctgtctgtacggaaattaaaacagatcaccacatcatcttcaatgattcttgctaccggcactacatttcccgtagcggtagtgttcattaaaatgattggtttcaggaactcatcggttacattattatcataatacattttaatggttgccagaacatccgttgtctgttctcctattccttctacaagggctccgtacgctaatttcacacgttcccatcttttatctctgtccatcgcatagtatcttcctaccactgttgccagctttccggtagtagcttccatatgcttctgaagttcatcaataaatcctaatccggaatgcggatcacaatctctgccatcggtaaaagcatgaacaaatacattttcatttaaaccgaattcttttgcagccgtcagtaatcctttcaggtgattgatatgtgagtgtactcctccattggaaaccaatccgataaagtgtacttttttattttctttttttgcgtagtcaaaggcgtcctgaatcactttttcctgtcccagtgttccgttctcaaccgccatgttcagttttaccaggttttggtatactactcttccggcacccaggttcatgtgtcctacttcagagttccccatctgcccggccggtaagcctacagccagtccactcgcttcaagcgttgtatgtggaaatttttggtaacagctgtctatgaatggtgtatttgctttatctattgcagaaacgtttgggtttgttcccaatccccatccgtcaagaatggccagtattgcttttttcgacatgttgtaaaaacttttgttatacaaatttacctaatttcctatgaatagaagaatttgaagtcctgaattttatgtattcgcgataaacaggaacctcaacagacaaatgaattcttgaattcactatctcgtttatcttaaagtttattctttaaaaaagtcttcgaatttggtattattctgctttgtatattctctgatgtattgatctaaaaagccactctcttttaaaaacaaaagcggattctgaatatgtaagatatcataaatagctttatgcttatctgattgtttattaaaatacgcctcagaaattttataccccatccaatacccaagatcattaggacgatcatcttttttggtagttccataaagccagtcagtaggatctttcttctttaatacagttacaaattctttatacagtttatcagcatgggcctctccatatggataaaatgggctgttattggtttcgcccgacaccaattcgctgataaaatcagcacttccttcacttaaactatattttaacaagttatcggttcctttaatatcctgttgaaaatgtatcatttcatgggaaacaagtcctgtaatgccgtccagattctgaagagtttcggtgccaatcataattccgtctttagaaaatgttcctcccgtattaaaccttccgtatacaaaatatataggcggaaattttgcctgcggataccaatatttcaatgcgctgtaaacagctctgatccttctttctttttggctgattcctgccagaacattacggcttttcagataatcttcttttctcttcctgaccattgtatataaagaatcagcattgattatccggtattccatgaaaccttttacaccttgagatccgctgctgatataatctgtaaagggattttctttcgaagtatccatcttttcgaatgctttccagaaacggtctgtgtctcttgtttcaaatactgcgttcaatggatcagtggagaagtttgtctgggcttttgtcattgcggaagctaaaagaagaactgtaaaaatgtatctggttttcatattagtttttaaagatttcttatcaaacggttaaaaatataaaaacttatatagaatcaaaataaagcctgtaaaagttttaacagggttgaaaaaactggaatttcgttgattatttcaattcattatcattaaatctttttaattttgcagtatggatttacgagatcaattgaagaatctttttcctgatcatgaagagcaggattttgagatgcctgaagaagaattcaagcagaaagagcctttggtatgcaaatttgagaaaaaaggaagaaacggcaagcccgtaacgattgttgaaggttgggaaggtagtgaggaagacctgaaaaaaatctcaaagaaaataaaaaccaccttaggtataggcggctctgagaaggatggaacgattatcattcagggggataaccgtgataaaataatgaatatccttaaagaaatgggatataaaaccaaacgtgttggcggatagttctagaaatagatctgggtttccggcagtaaggtttttaaattttcaacagtagatttttctataggatttcctgtaagaatcaatgttttcaggtttttgagctgtttgatttctacaggaatatctttcagattgttattggccagattcatactgacaatatttttcagtccttttactttgggtgatatttctgtgatatgatttccgcttacattcagaaattcaagattctttgctttgaaaagattctcaggaagtttgatgatagcgttctgctgaagttcaagatattttaaattttcaggaaaagacaaatttccaaggtcattgatctggttatctgaaagattgagaaacttcagatttttgatccgatccaatttgtctgcaataaagctgatctggtttccctgaaggttgatttcttcaagtgcgggaatttccataagagcttcaggaaaggtattaaggttattggcatcaaaatgtaccactttcaggttctgaagctttgcaagattaggattaatgcttgtaaggctattcagattcatagaaaaagtattcagtttcttcagattgcttacctcatcaggaatatatttaatgctgttttcattcacatttaaaatttccagttcttttaaagcaaagatttcctgatccattttctcaagcttattcgccataatatttaaaaagaataatgaatccagttttacaatctgaggaggaaggttgaacaatcctttttgtctgaaacttatactatagacagcctttttacttcttaaagcctcttcaatattggtaaaagtaggatacttcaccggatcaatctgtgctttgatctgagaaagtgaaactatggaaatcagtatgacaagctttttcataaaaataaaaaggtctgccggcaaccgtggccgccgacagacaagaattataaataatttatttctttacaagtttaactgttttctgaaatcctccttcagcttcaatatttaaaaccaaaactcgtgatccttccaactgctgtgtgaaatcaaggtccaatactttgttggttccgttgaatttcttcgtgtaaacgattttcccatccatgctgtaagctgtcacagcaatatctttcaatccttttgctgaattgatttttaccattcctgaagttgggtttggcgctaccgttactgtgttctcttcaattttagtatcaatagttcctaaagttccttcagttcccagattatttttaagagcaataacaatcgttgctgattttcctttataatcaatcgtatttcctgttgcatctacgtctgtagagatcgttgaatccggatgctgaatagagaagaaaccgaatttatgatcaggcgtaaatgtaagtcctgtaggttctgcacctgccggcattgatgcgaatagtcttactttaggattggcttgtgtatgatccggagcaattacccagatgtagtttttacctccatcctgaagcacccaaaggtttccaagctcatcaaaggtaagattgtcatttccatcagcccatacttcagatttcactccctgagctgtattgaaagaatacactgtagatcctccacctacgaaagtttctacctgggaagcagtagtcccgttatcctgtaaacggtatactctgtctaaaccttttgatgtaaaataaattttcccatccagcgggctgatatccacatcttcaataccattaaactttgttcctcctaaagaaagagctaacggacctgtattgttctgatctgctttttctttattcggaacctggatccatgttgctgttgttgctgccggatctcctgcagccgttaatccctggtctaatttcagtacataaaggtttcctgaagaaagatcatttggcgtatccattacatatttgtagaccatgtgagttccaccgtcttctccataatatgcgattgttccggcattattgatgaccacattctcatggttcatgattcccatctgccatagtttacctttggaaccgtcagtatttttagaaattacctgtgccgttgcagggtcaatttccactaaccagccgtaatctttgtacccatcattgttcacgtcgttggaagtaacagattcttctgctgttaccacagttccccatggcgtaattcctccggaacagtttctgatggtttgtaccagacttggagctgagaagcttaccgctcttgattttgtaagctgccaaagctttgaagttgcattatagctgatttctgccatagtaactcctccaggattcgtttcgtggtttacagacagatatccgtttgtactgcttcctgcttttgcaacataagctgtgaaatcgttctgacctcctaccaatcctccgccttcggtataattgtcaccttcttttaagataagctggtatttgtgctcagcagggataattaatttattggtttgtgctgtaggaacaatagaggtaaagcagctgatatgagttccgttacaagttacaggtgtagtggtattggcagttgttttcagataagcatcaattcttaaatctgaactggttgtgcttctgttatgcagctcaatagaaaatctgttgacaccgtttacaaattttgatttcggaatggagaagatattataaacgctttctgccgcaccgtcaatagtagtactggagaaagtattgaatgtaacagcgcctgcaggcatattatctcttaccacttcttctccgttaaggtatacaataataccgtcgtctctcattacaccaagttccatagtatcggaaagtgtggaaagatctaccgtaaaatctttagcaaaataagctgttgtaagtccggaattgattgtagtggttacaggatctccatatcctagcggcccgtttcctaccgcccaggttgaaatatcatagttctgggtattccatcctgccggctgagcctggttgttatctttgtagctccatgatgcattcttattgaatatcatagtctgcgcctggaggccagaaccggccaatatagccaaagttcccactgttagtagttttttcttcattttctatttgatttattagaccttgcaaaactatttttttagaacttttactctgttaataggattttaaatatggatcggtaaatattaacttatcaaaaacccaatgttaaggggattaattttgtgttaaatggtgagggactttgggttggagagttttagggttgtagggttgaagttgcgggttggaggatttggaattcaaatgtgtacggacaattattcatatcataatggacatgtatatttatcctatttattgattagctcaaaacagctatgttcaacaatctaaacagtaaaagaagagaattttttattcaaaaatgtgaatattttagaagataatttattttaaaaacgaggtctattcttatctcttaaaactttatatttgttattatgattgacacagctatgcaaaataaaaaaatacatcagggcagaaatattaaacgtttccgtgaaatgctgggtatcaagcaggaagccttagctttcgaactaggtgatgactggaatcagaagaaaatctctcttttggaacaaaaagaaactgtggaatctggtattttagcacaggttgctcaaattcttaaagttccggcagaagcgattgagaattttgatgaggaatcagcaattaatatcattgcaaatacatttaataatcatgatcattcttcacctcaatttgctacaattattaataattcaccaagcttccaccctcttgacaaaatggttgaactttatgaacgtatgctaaaacaacagcaggaaatgattgataagctggaaaagctgattcaagacaaataaaataaacttttttattatctctcaagattttatatttgttattatgattgacacagctatgcaaaataaaaaaatacatcaaggcagaaatattaaacgtttccgtgaaatgctgggtatcaagcaggaagccttagctttcgaattaggtgatgactggaatcagaagaaaatctctcttttggaacaaaaagaaactgtggagtctgatattttagcacaggttgctcaaattcttaaagttccggcagaagcgattgaaaattttgatgaagaacaggcagtaaatattatctcaaatactttcacaagtaatgatgcctcaacgttaaatgcagtaaatattcaacctaccttcaatcctcttgacaaaatggttgaactgtatgagcgtatgctaaaacaacagcaggaaatgattgataagctggaaaagctgattcaaaacaaataaacagacagacagatccgttctgaaaaactttaggctaaattctgaaacatgcgtagataacatttacacaagtttcaaaatttagcttatttttattaaaaccatatcattcctaccgaatctctaccctccaactctaaaactctaaaactctaaaaccctccaactctctcaccccgcgccccgtctatttcgctttacttacatccgtaagagcattcagaaaggcaatgatctgtttcttttctgcttcagtaaggtttaatttatccggtgccagcgtctgatttttcatttttaatcctaatccttctcctcctccttcgttgtaaaaatcgagaacttcttccagagtatcgaaagctccgttatggaaataaggtttcgtaagggcaatatttcttactgttaccgttttgaaagagtaatcataaatccatgatttttcctttttcaccgggctgtttcctcttcccaaatcctgatcaagctgtacgggaagctggctgataggttttgtggtaattcccaggacttcagattcattttcattaaaaaacggcggaaccaatccagaaaaatgaggcgcaaaatgacaggttgcacaattggcttttcccataaacaggttgaaaccttttttcacatcctcagaaacagtcttttcattcctcataaaacggtcaaaatcactgtcaaatgaatacaatgaagctacataagaacttaatgcttttgaaaaattttctttgctgatttttccgtctttgaaagccgcgcggaaggcctttttatactcaggctttgttttcagcttctgaataatgctttcgtagctcgtattgaattcctgttcattataaataacgtgttctgcctgctgttcaagataaaaagcacggaggtcatagaaaaatctcttggcaaaaacagcattatataaagatggcgaatttctcaacactgtttttccttccacattgctttgcgatttgggtttcaggtctgtaaaagcattttccggaaggtggcatgtggcacagctcattttcccgttaccgcttaagttctgatcatagaaaatcgattttccgaggtttcggagttccggattattttcagaagatttcagtaaggtataaaagtacggatctaaaaaatcactgctgaaaaagtttttattacctacattccagcctgaaaattccttcagatcgtctggtcttccgtcccattttccaagttcttcgtacaaaggctgtatgtattttttgtaaaactcaatcctgtcaaagctttcaaagtcagtattttttgaaagatagcttattccgtctgttaaaatctggtcagccctttcaatattataatttttaaaataaggatcatcattgatgtatttctgcattccggaaaaagcgtggcttgtttcttcggaaatattcagggaacctggtgtatcaaaaccggacactcccagtgaatagatcctgatcagttctatacgcaaaggcaatgttttgttgtttcctgtgctcaacccattttttaaagcgcttaaataaaacccggaatagctgttatacaaaaaagtagttatggtttttatcttttctttctcatttcctgcttcgtctgaaaatatcagttcatccagcacctgcaatccttcgggaggaagtgtataggcagatgttcctgcagcttcaatatgaaacaaaggagctgcgttaaggtggctttttgtaaattcaggataatggtaagcaatataaaattctatttccttgaatgaatttcttgtactgctgagtgttttctgtaattcttcgagtgaaatccggtcttcagagaacttatcaacatctgacttcaactgttcaagcttcattttaaagtcggtcaaacctttattgacaaatgtattttcgcttctttttccttgataaacaggattaaaagacattactgcaaaccctatgagaagggcaattacaagcagtggataagatctcatgaatttttagcggcaaaactattcatctgatgttatctgagttttaataagagattaaataatgtttatatttctgatacaatatttttcactaattttaaaccccgaaatcaaattcattattctaaggaaaacggtttttcaacataccggtaaataatggcggaagattattgggagaggattttttaaattaaatcaacacatcaaaaaaactaaaataaaagtatgaaaacaaaactatggtttgctgttgcaacaagtttcctttctctgaccgcgttttcacaaaagaaaaagcaacaggaaaaacaacctgaaaagaaacaggaaatggctgtgtatgctgagaaaaaaggaagtgactattatctgatacgtcttgaaaataataaagaaattcctaatgtatatgtgtattccaatggagttacaaagccctataaaacctatactgatctttcagatatcctcagggattttccgggaatgatgacttccaataattcaacaaaagaagagcttgtatctgttctgaaaaaagatgatcatttctatgaaattacgtcacagaggaaagatcctaaaaacattgaaaaaaccgttgttaccgtatatgaggtaatgaacggccagaaaagaattgtagaagaatacaatgacatctacgaggttatggcatctccttataaagaagccattatgactaattaaaaaacaaaaaatatacatattatgctaaacaaacttgctgcctcagaacttgttatgaatgaagacggaagtgtataccacctgaatcttttacctgaagatattgctgacaaaatcatccttgtgggtgatcctgacagagtggcaaaagtttcaaaatattttgatacggtagaaatcaagaaaaataaaagagaattttatacgcatacaggaacgcttcgcggagaaagaattactgtaatgtctacgggtatcgggactgaaaacatcgatatcgtgatgaacgaacttgatgctttggtaaacatcgatcttaaaaataaagagttcaaaactgagcacaaagcccttgagttattccgtatgggaacctgcggaagtgtaaaccctgatgtacaggttgacaatatgcttgtaactcaaaatgtagttggtttagacggattaatgcatttctatcaggattacaactttgaaaatgaattttccaaaagcttcctggaaaaattcccttatgaaagaatcaagccgatgctttacttctcagactgggcagaagaaatgggagaatactacaaagatgccaaataccatggaaatacggcaacattcccgggattctatgctccacaagggagacagcttcgtttgaaagcagtagatgatcaattccttgaaacattgaatgatcttggaattaccaatttcgaaatggaaacctctgccatctatgcgctttcaaaattattaggacacaaagccatcactgtaaataacgttattgccaacagaagacgcggagaattctctgcagatcatcatgcttctgagaaaaacctcattgaatgggtattagaaagaattattaagtaattatttaatttattatacaaaaaaaacctccggaaaatgtttccggaggttttttattaggttttggttaaagccgatgttttttatttattggaaaacgggctaaagcccgttcctattgaatttgtattgtaggatcttgttcatttcacgatgaataaaataccacccagtctgtcattccgtaggaatctctatgctgtttttaatgtttatatttagattcctacggaatgataaagttaccaaaagaaaaatagattaagaactgatgatcaatgatacaaatgccataatcacaaatgaaaagttctaggatccggatattgaaatgtatagcccagttctgaaaccagttttgaagacagaaccttcttccctttcatctcaaattcttcttcatccggaatatctttctgtgcattgatcacctgactttttgcaggatgaactggagctgtcacattatatagttttgattcagttttctgttcaatcatttctgagataatcccgctgatatcagcataatgaatatgattcaccgcatgatcaaggttaccgacattataattttttaaaagcctgttgtctcccatgagaccaccaagtctcagaatattcagttgaggatatttattcctaagcattctttcccctgatactttctcaaaaggaacatcttcttctgtgaattctttagctatatcaggataaacacctgtagagctcatcataaacatctgccctttaaaatctccgataaaggctgacaaattctgaatcctgttatataaagaacttacacagcagcttttctcagaaacagggatggtaatgatcaaaacatccatatctttaatttcttcccaccgggaaacaggttcagacaattgataatccgggaaagatgctactatggcattgatgcctttagaatgtagtgtgtgcactttatcctctgtagttgtcgtagctgatactgtataattttccgataacacggatgctattctttctcccagccagccataacctataattcctattttcttcatacttcaacagaggttttcattttttgatcatacaaaaatatcaataagttatgattttctggtaaagcaactttttaaatgatcattgaccattccggtggcctgcatatgggcataaactacagtagatcctacaaatttaaatcctctctttttaagatctttcgaaatatggtcagaaatttctgttgtagcaggaacatcagacaatttttcaggtaagttatcaattggttttccgtcagtaaagccccagatgtattgggaaaagcttccaaattctttctgaacatccataaatctctgggcattggtaactgcggccagaattttaagcctgtttcttataattccgggattatccattaattcttcaatttttttgtcagaatatgccgccacttttctataatcaaaatggtcaaaagcttttctgaaattttcccttttggataaaatagtataccagcttaaaccggcctggaagctttcaagaactaaaaattcaaatatggtttcatcatcatagaccggtcttccccactcttcatcatgatatttcctgtaaagatcatctttttcacaccagccacaacgtattttttccataattatcaaatttatatgttaaagttactattgattttgaaaagtataacaaaagattatgaaaaatttaacagagaagctgtgttttaggaatggttattgttcaattataattataacaccaaaatttatatcattatgaacaattcagagtataacaaagcggaaaatgcagtaaataatgtagaaaactctttacagaatgtagcggacaaaaccaaatggaaaatcaatgaattggcagacaaggctaaagactatatcaatgagaaaaggaataatgatgaggaggccagccaggaagactggctagacagggtaaaagctaatgtatccgatgcctgggaagatattaagaataaggcagatgaagcatgggaaaaaaccaaagatgcggcagaagatgtaaaggcagaatggaataagaaaaccaattagtatttcagtcatataaatattttcaataaaatggagtcttaaattgataaggctccattttttattatgccataagcacaattattgttacatttgtattataataaacattaaaaaattatgtcatacggtttacttaaaggcaaaaagggaattatttttggagcccttaatgaacaatctatcgcatggaaagttgctgaaagatgccatgaggaaggtgctgaatttatcttatctaatgcacctatcgcattgagaatgggagaacttaatggtttagcagaaaaaacaggttctgaagtaataggtgctgatgctacttctgtagaagatcttgaaaaactttttgatgccgctgttgcaaaatttggaaaaatcgactttatccttcactctatcgggatgtctatcaacgttagaaaaggaaaacactatacagaaatgaactacgactggttggaaaaaggctgggatatttccgctgtttctttccataaagtaatgcgtgtggcttgggaaaaagactgtatgaatgaatggggaagtattctggcccttacttatattgccgctcagagaacattcccggattacaatgatatgtctgataacaaagcgtatcttgaaagtattgcaagaactttcggaaactactggggagaaagaaaagtacgtgtaaacacagtttcacagtctcctacaatgactactgccggaagcggtgtgaaagggttcggaggattccttggatacgcagaagatatgtctccgctaggaaatgctaccgctcttgaatgtgcagactactgtgtaacattattctctgatcttactaaaaaagtaaccatgcagaacctgttccatgacggaggtttcagcagctcaggagttactcagaaagtaatcagtaaatatgatactgaaaaataataactatctaaggtcatcaacaaaaatcgcattatacttagtatttaatgcgatttttttattaatcagaatcaaggagctgttttatttcataaaacagctcctttgataaaaacaaactatctggtttttacagtaatcttttatttttttaatactttaattttctcagaagtattttgaagagttacaaaataaacacctggcgtaaactctgataaagataaagaatcactgatatttgcttttaaaacgattcttcccatactatcataaatagtcacaatattattactgtttctattttttattatgagattttcgcttttaaaatcataaaacaatgttattttcttgtatgcattctcatttgttcccagatttgtagttgcttcataggccccaagatcaacggcagtgccaaaaatcctgttatttcccaataaatcttgtgtctgggtaacaaaactgttattgcctgcattgattgctgcagaggaaatatccaattgataattataagatgtacagtcaaacggtgcggcacttaaaatatttgagtttgtaaatccaggattaacatttaaaacattggttcctcctgtataaccgttctctacaatagaatgtgatacaatattaccagcatcaacctgatcattattggatgaatttgtatttccgtaaacaatagaattatacagattaaatttaccattagcactataaacagctgtttcaaatgtattggtaaggaatacttttttattatgaacaacagtcacattctctaagatctgaggaattccattactgctgtacagagccagtgcacattcatgataggaatttcctgcaaggattgtattgctgattttcgctgaattattagcatcaatataaaaaagacttgattgattagaggtattatttgtaacgacacatctgtccatcacaaaattagctcccaaaaatctcaatacagcattccctccagctacagaacccttgaatttacaattacttatggtaaggttattattgttggagtcatcagaaaaaacagctccgtatacagatatattactaataaaatcacaattgataacatttacagtgtaattcccctggtaagcctgaaaaatagctccggcggcagacccctgattatcatagaaatagcaatttttaatattaataataccagtattgttgttcaaagaaattcctcctgctccacctgctctcccagaaataaatctaaaaccatctaccgtcaagcctgatgtagtattgataattttaaggatcgtattggtattatccgagctatctccaatagcaccgatatctcctgaaagtgttgtaggattctggctgatatttctttgccctattgaagtttctgttccactaaatcccccatataagctgactccatttttcatgttgaatgagatggttctatcggtggtagaagttgctttgtacactcccgctgctacccagatttcatctccatatatggcattactcatcgctgtctgtaaatctgtataagcattggcccacgaaagaccattgtttgaccctgtggcagatgaattaacatatagtgttgcggcattcatacttgaaaatgccaataaagaaaacaatagatattttttcatggttaaaaatttcgccaaaaatactaaaaaagtaaatacattaattcgaaataatattatgataaatactgaagaaaaatttttcagtatttcctcatgataaaacccggcggcctctttgaggccgccgggtctgtcaaaaataatattaatatgatactataaaattacggtctgtatagagtgtgcaggagcattcagtttggctgccataccttcaatccacaaattggtttcgatatcattatctgaatcattcataataacggttaccaattgtccgttttcattcataaaagcggaagaagtcaatgctgccctgttcgaagaagttccgattctctgggcattgggtttgatatattttgaaacatggcctatataatagtattcgtaggtatagaacacctcgcctgttttggtatctgcgataatcggggcaaagcagaagttacctttatggttaggtccgccggtttcatccaataaaatattccagtcggtccataaagcatttcctttgttaaaatcattcaacatgtttttgctgtacagctcacccaggcttacatcatagattttatccatactgaactgttctttacatccttcagtaaaagccaggaatttatccggaaaagctctgtgcgtttctgccagattatcaaaaagctgtgttttattattccatgtttcataccagtgatagccaataccgctggcatattttgaggtttccggatcacttaatgtggttgttgctctttgatagatcagatctctgttgtgatcccagatcattacttttttatctttatatccgttcttccaaagggttggtccaaggttctttttcaggaactccccttcttcttcggcagtatagatacatgattcccagctttgggtagccattggctcattctgaacagttagcccccagatattaattcctctcttttcgtattctttaatgaatttgatataataatctgcccacgtctggtagtattgattctccaatcttcctcctttgtataaacttttgttggatttcatccaggctggcgggctccatggagaaaaatagaaggtaaaattatttcctattgctttctgagcttctttgatcatcggaattttatacttctcatcatgtgcaatgttgaacgttttcagggaagcatcattgtcttctacataagtataggaatcactggagaagtcacaggaattcatattggtacgtaccactgtatatcccaatccgttttttccaaaataagcatccagaatttccttttgcttattctttggcattttataaaaagtttctgctgaagcgtctgtaatggcaccgcctattcctatcagtttctgatatttaaaattaggagccacaaaaatacaggcctcagtttctttaggctgcccaaattgttcaaatttaactgctcctttatccgccatcttctcattcgctttcgagttggtaaggattactttagctgtttttcctgcattctttttccaataattctgagcattgacattgatgacaacacctactacaaaacaacttacaattagttttctcatgatttttttattttggacagttgcgtcccctattcattatttattttgatagactcttacatagtctatgtaatacttttgtggaaaaacagcatcatcaatgccttcttttcctccccaaaaaccacctactgcaagatttaaaatgataaagtaaggtctgttaaaaggccatgcatcattatttttctctttattctcataggtgaaaaacttttggtcatcgatataaacatctattttttccggtgtccagtctgctttatagatatgaaacttttcgcttgcatcttttacaaacagtgtatcggttttctgggttccctgaatgtgattatattttttggtatgaacagaagcatgtataaatccctgattgtatcctacatgttccatgatatccagttcgccgtcatccggccatttcttcatattctcgctcatcatccatatggcgggccatgttccgcggcctttgggcagctttgcccttacttctactgttccatactggaaggcaaattttcctttggttaaaagtcttgcagaagtatatttattgttttcccagttttcttttctggcttcaataatcaggtttcccttttccattctggcgttttcaagcctgtttttggtataaaactgagcttcctcattcccaaaacctccacctcctacatcatagttccatttcgaggaatcaggaaggcctttactgttaaactcatcactccaaataagtgttctgtgagaatccggcttgtgtgaagcacagttcagaacagaaatgaaggtggttgctgcggcacatattttaatgatatttttagccttaagattcatatgtatgaggttttaagttttggctaaagccgttctttttatattttcataagtgggctaaagcccactcctattgaattgaattcaatttattttgtccagttaattcttttgctctgtacatgttgagagtcagttccaatcataatatcaaattctccgccttcccagtcaaaattcagctcatcatcaaagaatttcagatcttcgggagtaagtttaaaatcgatctttttgctttctccttttttgatgaatactttctggaatccttttaattcttttacaggtcttactacttttccaaaaagatccctaacataaagttgcacgacctcttctccatcatattttcctgtattggaaaccgtaacactgatgttcaatgtctggtttcctgtaaggtttgcagaatttaaaaccatatcagagtatttgaaatccgtgtaactcaaaccatatccgaacggatatttcggatcattatcaagatctatgtaggctgaaacataatttctgtctgtattattttttgcaggtcttcccgtattataatgattgtaatacacaggaatctgaccttctgttcttgggaaagtcatcggaagctttcctcctggattcaccgttccaaacaggacatctgcaatagagtttccggcttcggttcccagccaccatgtgtacataattgctggaatattgtctgatgcccagttgaaaataagaggtcttccggcattgatcatcagaatgattggttttccggttttggcaatttcttgcaacaaatcttcctgaacgcccgtaaatccgatattgcttctgctttttgcttctccactcatcgcatgtccttctcccaatgtcataatcactacgtcagcttttctggctgtttctattgcttctgcaaactgtgttttatcctgatcatccacattacagcctttggcatataataaagtggagtttttatccagctgatttttaattccgtcaaattgagaaacaattctttgattgtcatctttgaaagcaactgaccagaagccgtgattcgctactgtttctttcccgaaagggccaatcagagcaattgtctttgtactttttgaaagcggaagaatatttccctggtttttaagaagaacaatactttttgaaccaaattctctcccgaattttctgttttcctgattatcggtttgttctttttgtcttttttcattgctgaatctgtaaggatcatcgaaaagtcccatttcgaatttcttggttaagattcttcctgccgcatcatctactaattttgcatctacttttccttctttaaccagtttgggaagttctgtcatatacacacggctttccatatccatatcacttccgccctttacagctctttctgctgcctgagctgcatcttttgcataaccatggggaatcatttccccaatacttccccagtctgaaacgacaaaacctttataattccattttccttttaaaagatttctctgaatatattggttggccgttgccggaattccgttaatatcattgaaggaattcataaaagtagctactcctgcctctgcagctgctttgaatggaggaagataagtttcgttcagctgtctgagactcatatccacagaattgtaatctcttccgcctacagcggctccgtacgctgcaaagtgtttggcacaggccatcacagcatccagagttcctaaacctttaccctggaatcctttaattcttgccagtccgatttttgttccaagataggtgtcttctccggaaccttccataacccttccccatctcggatctctggcaatatccaccattggagcaaatgtccagtgaataccataagcggcggcttctgtagcagctattctttcagacttttcaatcattcccagatcccagcttgctgcctgccctatattcaccggaaaggttgtccggtatccatggataacgtcctgtccgaacagtaaaggaattttaagccttgactgcatcgcgagtttttgaaaggccctggtttcttctgatccagcaacattcagcatagagcctacttttccttttttaatttcgtctaaaacaacagccgaattggaatgctgaggtcctgtagcatattcgaacccgctgtattgaaccatttgtcctactttttcctccagggtcattttagacaatagctctgctactttctgatcaattgtcttttgtccgtaagcattcagtccaaatgcggaaaataccagtaagaaataaactcttttcatagtatccaattaaaaaatataggttgctgtagaacgtccggaaattgttactgcagcggttttgccggcaaatttaatattaaaattctcatctgcctgattatcgttctgtacaattaaaactattttcccaaattgagtcataaaagcagctattgaaagtgtgttggtttgtgtggaagcgatgcgctgagatcctgccggaacaaattttgaagcatgggcaataatataataggaaacatttctggtgaagttttcactatcagaaacggttatggcgcctttacattctgtacatccgccatctgtatgaggggcaaatttcggatcgttggcaagattccattctaaagcaattttgctccagttcctcatggaacctatgattacattttttgtatgccagttcagatcttcggtaaaagttccttttgaacctgtccactgctccgtaaagtatagatttttgtctggaaaagcattgtgcaccgtacttaatgcggagatatctccttcgtacaaatgaaaagctgacccgtctatatatttgtttgcctcagcatcttttaaaatatcaatagcatattccggtttgttgcagttgtggtcgtaaacaacaattttagttttaattccattcgttttaaaagccggccctaaatgatttttgataaaatctccctgctgctcagacggcatatacatacttggattatttccaggatgtaaaggctcattctgaggtgttaccgtatcaatggtgataccttcttttttcaagccttgtatgtattttacaaaatatcgggcataggtttcatagaattcaggtttcaggcttcctccttttgatttaccattgtctttcatccaaaccggaggagaccatggtgccgcgatgattttaacagaaggattgatcgctataatctcttttagcatagcaatcagatttttgtcctttgccaggctgaattttgaaagcgaaggatcgctctgcccttcaggaaggtcgtcatatgaaaatacttctccatcaagatcggatgcgcctatgctcaatcttaaataactaatggagattgaatttttactatttccaaaaagctcatgaagcagtgcttttcttctggaaggcgacaaccggttgattacctcaacgcttcctcccgttaatgtatatccaaagccatcaacatattgaaacttttgagtatcatcaatttcaatattctgaaagctgttggaactgtttacaaatttaacagaagcctgctgctgtaattttacactttcatcaccttttgtaagccagtactgtacttcatttactttgccggaagatactgagccacacgataaagaaaaaagggccacaccactaagcagtgcggcacctctaaagaaactatataagttgtgaaacttcatggattaataaccaggattttgttttaaaactgtattcggcaattcattgaaaggaattggaagaatttcatttttattggctttaaatcctttgaaggcaagcttagaaggagcatcaccccatctgacaagatcaaaccatcggtgtccttctccggcaagttctctccttctttcatctttaatagcctgtaaagaaacagggactgatggtaaaccaactctagctcttaccgcatccaacaaagcctgagctcttgctccggctgcacctaatgcttcagcttccatcagataagtatctgctaatcttattgcaatataattctgacggaaattaagctctgctggtcctggaagtgagcttttcaaagcatttgtaggcagatatttatttaagaaatatcctgtatcagcaaaggccgggctgtaggtaattttaccatctgctaccagtttttttgcattgaaaacggttacatccaatcttggatctccctgcataaaagtaacaaagttttctgtcacagtattaaatgcccaaccggaatagatatccggggcatcattattcgggatgttttttagtgaataagaacgcggtcctaccattacattaatagagtttccttcatctttaccctgtccccagaatccccaatcggaatttcctttattcgtatgcattacttccaggatagattctgttgaaaacttataaggatctgataattcggggcctactttaaataagtctgcataattggctaccagtttgtatccatattggctggttcctcccggagtaccattcacctgagcaaactgtgcagccgcctctgtcattttcttgtcataaagataaatcttacctaatatggctctggcagttccctgtgtaactcttcctttatcattaccacttgcagtcatcatcagatctggaatagctgcatttacatcactttctatctgtgcatacacctcacttggtttagcctgcggaatattccagtaatcatcatcgaattttacagatttcagaatcaaaggaatgttcccaaacattcttaacagctcgaaataatatagggagcgaagaacttttgcttccgcaatatatcttttcttaagatcgtcactcatattagctccgggaactctttctattaaaaggttagcacgtgctattccctgataataatctctccagtaactggcgggcatcgtgtttgggttaatcatataattgtttaacccctggatacctgctccatcattagagtttcctcctccggaatagaaatcatcagatcctgcattaaaaaatgttacggtattttcaaaccctcctgaatattttcttaaaacatcatagaccgaaaccagtgcactgaaagactgctgttcattctggaaatataaatcagtattaaaagatcctgaattctgcacgtcatccagataagaatcgctacaagcgatattggttaaaccaagacctgccaaaaatgctactgcaagtcctttatatataaaattcttatttttcattttgttagtcattaaaattgaatattagcacctatcaggaatgttctagcctgtggatagtaagccctgtctactccaataatatcttgttcggaattatttcttcctgcaatttccggatcatatcctgtatattttgtgaaggtaagcaggttttctcctgtgatatacagccttactttgctcattccaaaacgttgtgtaacatcctgagggatggtataacctaattgaacaattttcaagcgcacataatctcctttctgaagataataattggacatccatgaatagttgtggttcgggtcattacgcgtaactcttgggttatcgttggtagatccttcacctgtccatctatctaagattcttgtctgatagttggcatcaagcatatccaatcttctcagaccctggaaaatcttgttgccggcctgtccttgtgcgaacatcattaaatcaaaattcttataattaagattcacagtaagtccgaaagtatatttcggaatagaacttcccaggtttaccttatcttcatcatcaattttaccatctccgttgttatcctgccagataaaatctcccggttttgcatcaggtaataattttactccatttgcatttacataattatcgatttgcgcctgattttggaaaacaccactataagtttgtccgtagaatgatccgtatggctgccctactgctactctggaaacagctcccatagtctgaaaagaagcaaggttaaaatatttaatgtcatcttccaatctgagaacttcattttttatcgtagcgaagttcccattaactgaaatcccgaaatcttcccaattcttcttatatcctaattcaagctccagaccactattctgcatgtctcctacgtttgaccagggtaaattcggaactcctacatatccagggatattaatttgcctaagaatatctgtcgttttctttttataccaatctgccgtaagtataaaattgttgaatagtttcaaatcagcagcaatattcagctggctggtctgttcccatttcagatttggattttcaagtgtacttggcgcataaccaatgataatattgtttccagagttggtatagttacttccggaaaccatgaaacttgcaaatttgaagttgtccatttcatcatttcctaaaacaccataacctcctcttagttttaaattattaattactttgttctccggccagaagttctctttatgaacattccatccaagggacatagacgggaaagttccccagtgctgattcgtagcaaattttgatgaaccatctctacggatcgttccggtgaataaatatttatctgcataatcataaataattctaccaaaataagatgctttacgggtttgaattccatcccatcctgttgcggtaatattatcctgcggaatattaaagttgaaggaagcatcctgccagttatcgataggtagattactgtacgtcaaactagccccgccggcaatgttgtaccggtaaactccctgtcctaccatgatattgatgttgtgatcaccaaacttgttctgataggtcaaagtgttttccatactccattcaaatttattttcatccaccttattcagactgttgaaactggtattgttatagtttggacttaaataatatttcggagtaaaagaacggcttccccaataagatttcttaccattcagactggatttaaatgtgaaatgatcaagaaacttaagctcagcaaaaacatttcctacaaaatcatcagaccagctataatttccttgttgtatatgacggaaagcctgtggattggtcatttcctgatttacatatctggaaattccgtatggtctcccttctgaatcacggatgatataaggattggtataaccgcttggatcaaccattgaccaatctgtcactacaaccggagttgtaggatctaggttaactgctgaagccagaggccctccaaattcttcatttgcacttactccttgggacttcacatgggtatacgcaaaggtttgccctatggtcaggtaatctgtaactttatgagttgagttaaatcttgcattgattcttttgtaataagaaatatcactcattacaataccagtctgatcaaaatatccgaaagaggtatagtatgttgatttttcattccctcctgtaatgcttacctcgtgagacgatttttcacctgtcccgaaaatagcatcctgccagttggtaccttttccaaatgattccggattcgcaaaccttggtgcctgcccatcattaacaaaaccttcattaataattttggcgtattgtgtagcatctaaaagatccagttttttggatgcatttgagaaaccataaaacccgttataagaaaggctgagttttccttttttaccttttttggtagtcaccagaattactccttttgcggctgaaaccccatagattgcagatgaggctccgtctttgaggacttctatactttctatatccgactgattaagccatccgatattgtctacaacaataccatctactacccataaaggactgttacttcctgctccaaaactggtaattccccttacacgtacagtagcagcggcaccaggctgtcctgaattggtcacaacagaaacaccggcagctctaccctgtaaaacctgttccggtttaccagatggaatgttttcaatgtcgctggctttgatacttgcaatagctcccgttacattactctttttctgagtaccataaccgatgactaccacttcgtctattttgttttctttagcaattgtgtcctttaccttggtggtctgggcactgaagttggccgtaaaatagaggacggcaaccactcctacgcttcttgatattcttacattcatatacagttattgtttaattctcaaattgagacaataaaaatatattttttttcaattaattaacattctattcataaaaattttaatttttcttttatttttcagggttagaagcactatcttcgcattaatatttcataaaatttcataaaaaaacaataaagacaactcccaaaatgaccttcaagctttccaaaatttcccttccgttaaaacttacctttctcattttttcaatggttctgaactgtatgggacttatcattctgcagttatccgaagagaaaattacctatggtgaactgggacttttggagtctttcaaagatttacccattgcttttatctccctatttgctgtacgctttattaacaaaacaggaacaaaaaaagcattgatttcagcgttggtaattgtcggattctgctgctgccttcttccttttgcagaagttttctggttttttaaattatggttcgccatcataggagcttgttttgcaataggaaagatctgtgtttttgggataatcaggaataatatttcggatgaaaaatcactggcaaagaccatgaacagtgtagaggcttctttcatgatcggaatctttgtcgttaatacctgctttggatgggtggtttccagccaatattctgaatactggaagttttgttttttactgatcgcttttttatgtgcactagcgatcttcatgttatcaaagattaccatctctgaagccaaacctattgaaaacaaaaacattttttcagaattgtcaggatttacaactcctgctgtaatactattccttggggtaatattttttattgtttttatagagcagggatttaattcatggcttccttccttttataaaaatcatctgaaagtcaattcattttttgcacttcaggctacttcttttctggccgtattttcttatgcaggcagaacagtaacggcaaatattatcagaaggttttcgctaccgaactactatatctcatgtatggccttcattattggtttattgctaattattgtaggaatacagtattttgagtcggcagattcaaggataattctctttttattcccagtgattggtttgtttttatcaccactctaccctgtcatcaattcaaaaatgattgcacagattgataaagaacaagtaaatcttttcacctcccttattgttattttttcttctttgggcagctctgtaagctctattattatggctgttttgtttgaaaaacaatggctaaatttctatccgctatatatcttatctttcgtaattcttctttttgtgattagtttgatattttttaatgtttcaaaaagaaaatagttttatttttactgccatgaaaatcaaagacacaaaaagtaaagaaacacttcaggaactgatcgatacaaaagattttgttgctcacatatctgttgactgtactattttcggctttcataataatattttgaaagttcttcttttaaagtatcacgatctggatctgtggtcgcttccaggtggttttgttttcaatgatgaagatttaagagaagctgcagcaagagttttgtttgaaagaacacatcttgaagatatttttctgaaacagtttcacacgtttggaagaatagaccgtacggagaataatgtccatcagattctcctgagaaacaaaggtattcaggtgccgccggatcactggatttttcaacggtttatcacggtggggtattgcagccttattgatttttctctggccaatacttttccggatgcttttaatgaaagttgtgaatggttcgaggtaaacaatctgccaaagatggcttttgatcacgacaggattattgaaacaggattagaatacctgagaatgaacatcaatacggaagtggcagccagcaatctgcttcctgaaaaatttacgatgaaagatcttcagtctctttatgaaacgattttaggacaaaaattcagaaggaataatttccagcgtaaaattttaagcttaaatattcttgacagacttgaaaaactttacgacggttcagccaataaagcaccctatctctataaatttaaaagcaaggttcacaactccaccagccagtatcctatatccaatgatgaggagtcataaaaatgtggaattttcattataaacaaagaaaaagagcattatctacctgaaaaccaatctcaagataagttttcaaaaaaattttcacgacaacacgaaaaatgttacttttaaccaaatcaaaaaatcatgtcatattatcctcttacaagcatccctgattattatggaattgatgctttacttactgaagaacataaactaatccgccaatctgtgagagactgggttgaaagttttgtaatgccgcagatagatcaggccgctcaaaatcatacagatctaccgaatcttatgagagaattggggaaaatcggtgcattgggaccttatatcccggttgagtatggcggttcaggattagaccagatttcttatggtctgattatgcaggagctggaaagaggagattctgcagtacgttctgcggcttcggtacagagctcactggtaatgttccctatcaatgaattcggttctgaggaacagaaaaagaaatatttacctaagcttgcagccggagaaatgatcggatcttttgggttgacagagcctaaccacggttctgacccgggttctatggaaactaattttaaagatatgggagatcattatcttttgaatggggctaaaatgtggatcaccaactctcctctgtgcgatatcgctgtagtatgggcaaaaaatgaggaaggaaaagtacagggattaattgtagaaagaggaatggaaggatttaccactcctgaaactcataataaatggagcttaagagcttcaaaaacaggcgaactggtgttcaataatgtaaaagttccgaaagaaaatctacttccgggagtaaccggactgaaaggcccgctttcttgtctgaattctgcaagatacggaatttcatggggtgtaattggtgctgcaattgactgttattgcactgctgttcagtattccaaagaaagaaaacagtttggaaaaccaatcggttcttatcagcttcagcagaaaaagctggctgaattcttaacagaaattaccaaagctcagttgctatgtcttcagttaggtaatcttaaaaatgaccataaagcaactcctgcccagatttcaatggctaaacgcaacaacgtgaaaatggcgatcgatattgcgagagaatcgagacaaattcttggtggtatgggaatcatgggtgaattcccgatgatgagacacgctgctaaccttgagtctgtaattacttacgaaggaacgcatgatgttcatttattgatcaccggattagatatcacaggaatcaacgctttttaagaaaagacaaaatatagataaaaggagtctggccaatggtcagactcctttgttttactcacattgcagagaattgatattcattgaataattattaatgtcgtaatgttttcctgtttttgttaaacttattaccttaataccacataaaaaaaaccaatatgaaaaaaatcacaacttttttattaagtcttacggcgtcattttactttgcacagcaggcaggtgacgttgtaagtgccgaacagaaactggatttaacaccacaaggtgttattaattttatcgccaataatctcggcgaacagaacgctccggaattctccagttatctcagcagttttaatgttggtttaaaagggtacaaaattacctattacaccaaaaatgaaaataatattcttgtaaaagccacgggattacttatgtatcctaatgtgccatttaagctttcaacagtagtttccgaccacggaaccacagacagcaggtataatgttccgtctaatttcaaaggggcattaacggcaggatttgtagttgaactgtcttatgtccttaacggttatatcttaatggctcctgattacgtagggatgggaaccggtgatggagttcatccatatgtggattacgccacagaagccggagctaccatcgattttatcacggctgccaataaagtactggcacagctgaacattaaacgttatgatgaatactttttagccggctattctcagggagctcatgctgcaatgtctacattaaagagattaagtatttcaaaccctgataatatcaaattcaagtatgcatatatgggtgacgggccatatgatttttccggagtaactctgaataaaggtattcttgaaaaagacttttatccgtttacttcttttgtagccaatgttgttaatagctgcaacaatacaggctacaaaacatacaataatgacatttcagaagttatttctgctgaatacctggataaatacaattatcatgttgttcaggataacggcggcctgttatgggggcctgtaatctggagaaaactttttaccggcagctttgtcaatgatgttaccaataatcctaataataagctcagacaatgcctgaagcctaaagatgtctatgactggtataataaaaccccgatgacattaggccattcaactgttgatttagctattccgcctgaaaatacgtccaagacaattgatgttcaacgaggatattatccgtggtgggatctgaataaatataaactggactcgttttattggggaccacttgggcatgtaggaggaattcttccattcactctggcttccaacgccaaattcaatatcttgagaagtggcggcttacttaatgaatgggcaattgcaggatcaattttcggtaagcagaacgccgagaaaacctctgaaaagcctgcactgttttcttctcagataaaaccggatctcggaacgatgcagcttcttgaaattacagatttcaatcaggaaaaaacacagaaaaagactgctgataaccgtaatctggcaactttaaaagatggcgtttatttattgaaagtactggataacaatgaaagtaaaataattccctacatcaaaaatacaccaaaacaagttgctgaaaacgaaatcatacaatctgctactccatccgttttgcagttaaaagttgatcaggatgaacttacttctgtgaatatttttgacgaaaataaatcccttatcaaaagtatttctcagaaacaataccgtgaagccggaggaattgatgtacaggatctggaaaataaaaattatacctttgaggtggtaactccttattacaatcttcaattcagtaaagcaatcggaggtacatcatcttccgaaaataatgcagatatctttgcccagaaacagcagattattgcaaaagccggcaatggtatcaaaaacatcagcatttacagcatttccggttcactgattcttcagcaggaaattaaccaaccattgtttgaatccagaagcctggagtccggggtatacttggtacaaatcaccttgtctaatggaaaagtcatcaataaaaaagtaaaactttaaatcaatcactcctcaatatcttatttcaagttaatttttggcacttcagcaatgaagtgctttttgttgcatatccttaaaacttaaacccgatgctaaaatatatcctggaaaaatccagctgattgtttctggaaaggttaagactgatgggtcctattaaagattcataccccaggtttacaccataaccaaacatatcaaaactgttattaaaaggagaaaattcctcgctcaccttcccatagctgaacgaaggagtaagataaagtcttttcataatcctgtactgaaatgccacagctgcctttgccacggaagtcataggaagttctttctgacgaagcccgttgaattcagggcttagaagatcataattgtactcactgcctcctaaattgtatttctgattcaggaagagataaggtacctggtcttctctctgtgcaccaaagcttgttcccagaaaaagattcacttttgcagcaagcctccttgtgataggataagcgaagttttcatttaatgtaaaagaaaccagattttttggctgataataataagagtctttaggattaagtataggatataacagcggctgaacggttttcagatcatacagctcatattgatctccgtaataaaatcttgtacttacctgcagattattcccttttgtaaagaaatatcttttgttgagattattctgttcaaacttcagaaacgtattaaaattactgtgattatacagttttttactgtaattgtccacttttgcctgatctactttatccagtaaactgtacattctttctgtactgaactctgttccgagtgaaaaataagcattagggcttacattatagttcaaagcaatctttccggtgatattgcggtacatatggttaggaaaactatcaccaccatcagcccctacatcatataacctgaaattcaagtcgttacttttaagatgaatcatcttagcttccagatccagccacagccgttctccactgtctaaaaactgctgataagcaattttagctttaaaacgttcagaaatatctaccgttgccagaaatcttgatctgttcaggagaatattcctgtaggtataattgacaataattcccaccgactgctcagtatcataatgcaaagccagtttgaaagccccttttttggctcttttcacaaaaacattcattataaggccatcattttcattcgtataagtataatacaccttcacatactggcgcattccgaatacgcgatctattgcttcatttactgtttttacatcataatatttcccttctgtcagtcccatctgttttttaagcacttcaacttctgcggcatccttaattggagttccgtcttcttcattgaaggtaaattttgtagtaggcagttttacttcctcaatcatctcatgctcatatttgatcccggcttttcgctgggcttcagcaagggcaacaaactcaggaagatgctttctcgcctcggtttctcctattttgataattctcctgaatctggcaaaatccttcgttgtaatctctcccaagggatctacaaaatccaccaggatatcggacaattctttctgatgcttgaaatcttctacggaacggatagcatgggtctgataaatcatcttcatagggttttcaatttctttcttggtgaaaagcctgaatcctgtatagccaccgatcacaaaatccgctcccatctcccgaacctcattggcggggtaattacggtctaatcctccatccaccaaaagttttccatcaatataaacaggagcaaaagctgccggaattgccaatgtagcacggatagccaacggtaaagatccctccttctgcattaccaggccaccattttcaatatctgaggaagtaagctgaacaggaattctcagcttgctgaaatcattgatatgttttgcattaaatgtaagcgtattcaaaacctctcccatatactgcccttcaatataagagcttggaagagtcggaaatcctttcactacagggaactcaagaatatatttgtcatattcatctttctcactgatattgactttgctgtaaggaattttattactgagaatcctgttccaatccattttatagatggtatgcttcagctggtcagcattatatcccattgcatacaaacctcccagaattcctcccatactggttcctgtaatataatctacctttattcccaatgagtctatcattttaagaataccgatatgtgcgaacccttttgcaccgccgccactgagtgccagaccaaattttgtgtctttggttatattctgaagggcaatattcagggagtcgttcttttgctgtgatttgataataagagagaaagctatggtaaaaaatatcaggatctttttcattgttagttcttggtgtatccgattttaacttaaaaaagttttataaagagtaaagatacacaaaaaagttaccggtaaaattgaacggttatgtgaagtagataaatcaatttcggcctgtaaattaaaataaataaaccgttgattttcagactacatatcttttcaaatcaatattaaatatttttaatacgtttttatagtctcaacaaagttaatatcaggattcagaatttcgaggataaggcttttgacagctctcatggcatcatcaatatttcctttgtcaaactgcagggaaaccattccttttctggcatctgcaaagctccagatccctgtttcgatcgggtatccccaaaattcgggaagatgctgtacaacgtaatggtaaatacaaagctgaagcgcctgttttctgtcactgttatggaaatattcagccacattatcttcatcaatttttacattgagatttttaattttggctgttttataatcaataattcttagcgttccattgagcttatcaatacggtcaatgaacccgaagaaagatattttatcatttccttcaagaggaaaatctatattttcaaatcttctttcgatatcaacaatttccagtttgttgccttgctttatcagttcaagatcgtgattcagaacattctcaattacttttttagcgatggctttgtggatatagttcattcctttttcatagaattcaggctgatgcttcagcttttcaatggcaacatttatatattcatctattgctttaactgaattctttaaatcactttcttttaaaatcttacccttcaacacctcatacacttcttgaagtgaataatgaactagatttccgtaatttttcacagaaagctcttcttcaatttcatccgtttccgaggtatttaaaatctttgaaagatagaaatcaatcggattatagaggtaactggtaaggtgtgatgcagatactttttgcttccatttttcaagtcgttcctgtacaatctgtgtcttggagatttctataggttgtgttgcaataggctctgaagaattttcaatgatcaggtgttctatctcatgtgaactttccatttcaatctgagtaataaaacggctcttctctcctgtattcactccggagcttaaagcattgtacaacaaatggacattctttgcatcctgaatcaacctgtaaaagtgataggcataaatgctgtcattttccaggaaggtatgaagatcaaagaaccttcggatatcaaaaggaatataggtattctgagagtttccaagcggaagttttccctcgttcacagaaagcagaataacgttttcaaaattcagcagacgtgtttccagcaatcccatgatctgtaatcctctcaatggctctccctgaaaatcgatactttcagagttgatatgctgattgatcagaatttccagcgtttccatcttgatctcaatattgtaaggagtcagctggtttttaatgattctgaatgcattttcaaagtgagaaacattctcatactgaatatcatctatttcaagccattttacctgctggcagaacgctataagcatatccagataagcatttgttcccggagctttctgcaaaagcccgaaataagaaagtccgctcagcagttcatgcaaaagtttatgagagatataaacgatgtttctctcttctactttagctttaaagtcattaataatctgttcatcttcaacagattttggcaactcttcaagaatcgggaaaacatccctatagtaataggaagatttatttttttccagctgtttctgcagatagaaaagacgttttatggcattggagaaagacaggtttttcaatgggaatcccattgtaatattcaaattgtcaactccatgcatcacatcaaggcttgcaggtagaaggttttcatccagcagtacaacagctgtattggaataggttttattattgatctctttaaaaatttcgggcagtacttttgtctgggttacattccccgaaacctcatacaccttaatttttttaggttggttaaaatcatcttcaatccactggaaagccctgttgtcatcaaattctttccatgttttatggtttctgaggaacttaccggcttcctgtctttcgtcattgaaataataccggtcagcctgaaagaagcattgggctttattccactgtaaaagacttctgacgagcttttcttctaccggagtgaaggcattaaacccacagaatacgaactcctctcttgtatttttagcaaaatcagcaaccttagctttggcagcttcatgaatcattcctgaggtggcccagtttttttcctgtaatctcttttttaaagcaggaagaaaaacattcatattctgccagaaattaaggaatttctttcttgggacctcatcatcctctccaagatcctgagcccattctttgatcctttcttcatcaaacatatactgcagaaccgcctgatcgttgtctgaaaatttaagaatatcatcccaatccttctgtaacgttggaaaccacttcagaaagtctgaaaaatcatccctgggaataagattcaaacttctatacacatcaaatgaaaaaagccacagcggaatcccctgaataagctgttgtcccgcaatgttattcacgagctcttcaatggtaaaaaagttgggaagaaaccctgaataatgattctcttccagaatctgccggataaatacaatgggacgttttccgggcagaatgatattaaacgcagaaagatccgggttttgtgctagcagttcgtggatgatcttattaaggaatttcaaagggcttgatagctttttaagttgtctagttgttcagaaattaaatcgttatattctgcctgtttttctttgtcaatgccgtgacgggtttctttgtcgtaagccatctggaaattcttataatccatggagattccgtcataaattgctttgaaatacttgttgtaatctcctgagtttttgattttttcagcaactgactttctgaatttcctcacaaataactctgcgatgtcaaaatgtttctgttcgtgcagcagaatataatcattcatttttttgacatctttccatgatttttcttcatggaatatggttgtaatggaaatcgtaacaggtgcctttggatctgaagattttacagcggaaaactcccagccacaatgggtatatgctgctacatcgggattctttttattactgaccggacttttaaaattatcccaggtcagctttttatcttcctgccaggtaatcttctgtccgaatactgcctgtgctgccagcagacacaatacgatactcaatttcattattctactacaattgttttggtaatccagctatttcctccgttccagaatttaaaagtataagtgccttttttctgcggactaaagttgatctggctggctcccacgtaatttccctgtgtacaaggtccgttcgtaatatatttataagaagtcaccgttctttccagattggtattgtaaacataatcatatccgtaaaagccttcacagtgtgacggatacgtggaataagtctttatgctctgtattgcaaaaacatccatggtatcattgacaatttttacgctgtcgattttgatcttatcaattgattcaatcgtctggtaatcatcatcattacacgaaaccagaagcccgccaaacacgaatactgaaaatccaatatttaaaagttttttcataacctttagttttctgattattaacaaatattagcaaaaattattccttatttacttaaaaatcaggaattaaaattaccttttgatacataaactacctttttagtatcaaaaaattcttcatcaaaatagtgtttaaggttgaaaatttcacatttaattccagccagttcttctgcaagatcaccgccttttaaatataaaatcccattatgtttagggttaaactgttctttttcaaatttccctttcagccatcttaaaaattcaggcatctgggttaccgccctgctgaccacaaagtggaatttctctttcagtttttctgctcttccgtggatagccgttacattggttaaacctactccatctgctacagcctgtaccacactgattttcttcccgatagaatcaatcaaagtaaattctacttcaggaaacaggatggccagcggaattcctggaaaacctcctccggttccgatatccagaactttagttccgggagcgaatgccatcacttttgcaattccgagagagtgaagaatatgtttttcatacagggattccatatcttttctggaaattacattgatcttttcattccattcattatacagactttccagttgtgaaaattgttctttctgtttttcagtaagatccgggaaatattttaatagtaacgatgcagacatgtgaattattataaaccgcaaaaataagttttatttctcttgtattcaaatctactttccggataagcattgaactcagctttaactgagattattatttcgcaattcccggaattaccggcacaccaggattccctgattggctgatcgtttgtacagcaaaaatataattgtctttcgaaagtggtacttttatggaaagtcctgttgtaaagatttttttctgccacaccggactgtcggtttcgcgggccaggacataataccctgccggcgttcctgattttggtttttcccagtgaagcgttgtggagttcgttaattgcttaacatccatttccacattctcaggctttaaagtggattttgcaaggttggccagtaccgcaatgttggcagcaacattcttcttcagatatttaaaatcaataaattcagtcagatcgccatattgcttgttattttccaccctgatatcctgatgctgatgatcatagttttcatagtattcagtaagtcttacagacggaaaaccgttgttgacaaagctggtatgatctcctccccgtaaaaatcgatcatttctgtagatcagctttatttcaagtcctttcacatattcttccgcaatttctttgatataccttgccagctgtctggattcgctgtcattttcaaaacccagatttctgatattcattgcttttttatcgaggtctttgtaaggcagaccttcactgaacacacgaagggtccgggtattgatctctcctgtttctcccgctttgggattcccgatcatatcattattcagaacggcttccagttgtaaaccttctttctttatcttttccgccagctgtttagagcctagcaacgattgttcttccccagagaatgccacaaagataatcgaggccggaaatgaagacctgctcaatattcttgcggattctatgactccacttacgccgctgccgtcatcattggctccgggtgctgctgaagttccgttcattacatcagtcactcttgaatcaagatgtcctccgatcaggaaaattcttttatcgtttggatcagttcctttcagaaaagcaacagcatttcccaggtttaccggcttgtcaattctttttccatccggctgaataccttcctgctgaaggtatacttccatcctgccttcggagtttttagcataatcattgaactttctgatgacccagtttcttgcagcaccaattccgtgcttaggatcatcggttgaactcaaagtatgccttgtttcaaagcttaccagcttattgatataagatttcagcgaatcttcgttgacctgtgagacatactttttcacttcatcatctttggaatgcttctgagagaaaacagtacatgaaatcagcaataaaaaaacggaatacttcatagaataggtcttaaatgttttaaagatacaaaagactgagcatcagaagtaattttattcttattatctcactgtacagattaaaatttaatcgtctgcaaaaaaacaacaggatattccaactggatacatttaaccaaaacctgacaaaaatcttcaattcagccccatttttattgtccctgcaagacgtttttatcatatatttgttaaaattcaaaaaatacatggataaactttcagatagagtaaaaagattaggatactcacagacatttgttatgtctaataaagccagagagatgaaggctaacggaatagatgtaatcagcttaactcttggtgaaccggattttgatgttccggataatatcaaacaggccgctttcgatgccattaatcagaattacagccattattctcctgttccgggatttctggaattgcgtgaggcgattgcttataaattaaaaagagacaacaacctggaatataaacctacccagatctgtgtttcaaatggtgccaagcaggccattatcaatgttctcgcagctatcatcaatgatggtgacgaagttcttcttcctgccccttattgggtaagctatgatgaaatggtaaaaatgatgggaggcacttctgtgattcttccgacatcttacgttaccgattttaaagtgactgcagaacagcttgaagaagctattacagaaaagactaaagcagtacttttcagttctccatgtaatccgtcgggaggttattacacctatgacgaattaaaatctatcgcgaaagttatcgcaaagtatcctcagataacgatcatttctgatgagatctatgagtatatcaactacgaaacaaaaacgacatctatcgctcagtttcctgaagtatacgaacagacagccgtaatcaacggaatgtcgaaagcatttgccatgacaggatggagaatcggatattccgcatgcccggaatggctggcaaaagcttgtgaaaaggtacagggacagatgacaagcggtgctaatacgatggcacagagagcttctatcgttgcattaaaaacagatccttctgaatacaggtatatgattgatgctttcaaaaaaagaagagatcttgtgtatgaattaatcaaagaaattcctggatttaaagtggtacttccaaaagctgctttctatttcttcccggatatttcatactatatcggaaaaacattgaacggaactgaaattaaaaactctgacgactttgcgatgttccttctggaaaatgcgcatgtaggctgtgttggcggattctctttcggaagccctgaatgcatcagattctcttatgccgcttctgaggaggaattaagagaggccatgaaacgaatcaaaaacttattggaacaattcaattaacaaattaataacccaaaataaaacacgacagcaatgaatctgttaaaaaaactgaccatcgccacaagtattgccgcagcgagttttgcgggatatgcttttggccaggatttccagtggaaagaagctacttcgaatggctacaagtacaagtatgtaaccaatgaccctacttccgcaaggtattacaccttaaaaaacggactgacggttattttgagccctaccaataaggatccgagaattcaaacttatattgcaacaaaagcaggaagtaaaaccgatcccgcagaccacaccggtcttgctcattatctggagcatatgctctttaaaggaacgaatcaattcggttctaaggactgggcgaaggaaaaaccgttgctagaccagattgatgcactttacgaaaagtacaatcagaccaaggatgaagctaagagaaaagagatttacaaagaaattgacagagtttcaggagaagccgcgaaatttgccatcgcaaatgaatatgacaaaatgatggctggtatgggagctgatggcaccaacgccttcacttcctttgaacagaccgtatatacagaagatgtacccgccaacgttcttgacaaatttcttgctgtacaggctgaaagattcagagaacctgttctgagactcttccacacagagctggaagcggtatacgaagaaaaaaacagatctcttgatgacgacggagataaagttttcgacaccatgtttgccaatcttttccctaacaacaattatgggaaacaaacgacgatcggaacgattgaacatttgaaaaacccttcactgaaggctatcagagaatattacaacacgtattatgttcctaataatatgggaatcatcatgtccggagatttcaatccggatgaagtgattgcaaagattgacaaggctttctcttatatgaagcctaaaacaattcctgaatataaagtaggacaggaaaaagaaatcagcgccccgattgtaaaagaagtagtaggaccaaatcctgaaaatgtaatgctcggattcagatttccgggagcttccaccaaagatgctagaatgctgaaccttgttggaaacatgcttactaacgggcaggccggattaattgatcttgaccttgtaaaaaaacagaagttacttggcgcttatgccggatcttatgctttaaaagactattccgttttgcttctgcaaggaaagcctactgaaggacaatctctggatgaagtaaaaaatcttcttcttcaggaaattgataaattgagaaaaggtgagttttccgatgatctgatccagtctattgtaaacaatgagaagaaagggatcattcagaaggatgaaaaatattcttcaagagcaagtatcctgatggatgaatttacttctgacattgatcataaaacatcgctggaatatgtagatgaaatctccaggcttacgaaaaaagatattatgaatttcgcttccaaatatcttcagaacaataactatgttgctgtttacaaaagaaaaggagaagacaagagcattgtaaaagttgataaaccaaccatcactccggtttccgttaacagagaagatcagtcacctttccttaagaaaattgatgaaatgcctgaaaaccctattgctccggtatggttgaactatgataaggatattgataaaaacaaattagcaggggtagatgtactttctgtaaaaaatacagataacgccctgttcagaatgtattatcattttgattcaggaaaatggaacaacaaaatccttccgttggcagctgaatatcttcagtatttaggaactaaagataaatcgtccgaagtcatcagtaaggaattctacaaacttgcctctagctttaatgtgagcgcaggaaacgaagagacctatgtatcactggaaggtttaaacgaaaacttcgataaaacagttgctctatttgaagatctgattaaaaactgccaggcagatcaggcagctcttgatgcttataaggttagattgaagaaagccagagccaatgctaaacagaacaaaggagttatcatgtccggattgagaagctatgcacaatatggccctcagaatccattcaataatgtattgagtgatgctgaacttgacgcattaaaggctgaagacctgatcaatgttcttcacgacctgtttaatttcaagcataaagtactgtattacggtccgaaaacaggaaacgaggtggttgcatcgctaaaaccgatccacaaacttcctacaacgctgaaagatcttcctaagtctaaaactttcgttcagattccgacagataaaaacaaggtattgtttgcgcattatgacatggtacaggcagaagttttctgggtgagaaactccgatcagtacaatccgtcaacgacgcctactgtaagcctgttcaacaattatttcggaggcggtatgggttctattgttttccagaccatcagagaatctaaggcactggcctactccacttattcttattttgctcttccaagcaagaaaacagataaggatatgattatggcttatgtaggaacccaggcagacaaattcaatgagtctacaacagccatgaatgagcttttaacaacgcttccaaaatctgaacaattattcgaaacagcaaaaagcggattgaaaaaatcaattgcttcagaaagaattactcaggacggaatcattttctcttatctgaaatcccaaaggcttggaaacaattttgatatgagaaagactgtgtatgaacaggctccaaaactatcttttgcagacatcaatgctttccatgacaaagagatgaaaaacaagaactacacctattgccttgttgcttctcaagataaagtaaatgaagccgatatgcagaaattgggtgaagtaaaaaaacttaatttaactgaaatatttggttattaaaataaacaaaaagccctgatgtcagggcttttttattaaacaacacgtcaaaaacaattatagattttatttatcaatatttgtttgttcgatagatgaatcttttatatatttgcgtaagaaatttaaatataaaaacagaaaaattatgtctttagtaggaaaaaaattcccgaatttaacaattgatgcaatgtctgaaatgggtgacgatcttagaatcaacatccttgatgaagcagtaaacaaccagcaaaaagttcttttattctggtaccctaaagatttcactttcgtatgtcctacagagcttcacgctttccaggaggctttaagtgaattcgaaaaaagaaacactaaagtaatcggtgcatcttgcgatactaacgaagtacacttcgcatggttgaacacaccaaaagataacggaggtatcgaaggagtaacttacccacttttagctgatacacacagacaattggcaaacactttgggaattgttgatcaggatttcgaatatgatgaagatggaaacgaagttttcacaggttctaacgtaacttacagagcaacttaccttatcgatgaaaccggaaaaattttccacgaagcggtaaacgatatgccactaggaagaaacgtaaaagaattcttaagactaatcgacgcttacactcacgttcagaaacacggtgaagtatgtcctgcaaactgggaagaaggaaaagaagcaatgaaagctgacagaacttctactgcagaatacttagctaagaactaatataatgtgttaatttgaaaatgagataatttgaaagttaatctcaggattattaaaagttatctcattttcttctttacaaaacattgacatattttcaaattaacaaattttcaaattacgatcatgtatacagaattaaccgaagatacattacaaaatatagtgaacgacaatgaaaaggtagttgttcagtatggcgcgacatggtgcggaaactgcagaatcatgaagccgaaattcaaaaaattagccgctgaaaatgattctatcccttttttatatgtagatgcagaaaagctgcctgaaagcagaaaattagcaaaagtagacaacttacctactttcgccatctttaaaaacggagagcttgtaaaccaggttcagtctaaccaggcagaaagtttaattaacctttttaatgaattagcataatgaaattacccgtaatcagacagttttatcagaatcagactcctgaaaaccttgaaaaaacattagaagtactggaaagtttctgcgagttcagaggaacaagcgaagaagacttaaatgttgcaggagaattaatcaccaacatttgcggagctttagaagttcacgccaatgtacaaaacggaatgagtgagaaagatgctttaaactcttttgctcagaaggttttaggatcaattgacaaataatcttttgataattctatcaaaaaaattataaaaacacaaaatacaatacctgaggtttttcctcattactatacttttttctattctttaagaatctttatttcaactgtaaaatgtacttcgaaggaccgtaaccggtcacatgaagctggaagttgtatggaaaattttaaagaataaccaataaaatcccggtgatatttttcatcaggattttttgggtttaatttcccaaaaccacaaataacacaaatgatttcacaaatttcacaaatacgacagaacagttgaaaaggtattcatcaaaaaaaacacatcatcactgtgtcaatctgtgaaatccgtggaatttaataatcataagtttcggctaaagcctttggatggaacttatttatgtaaacgggctaaagcccgttcctattgaattagtgttattcgtgaaaaatatttgtggcattagtgttcaacccattaaaccacaaataacacaaatgttttcgcacaaatttcacaaatattaaaattcgtttttttaaaaaatatacgcaatcatccatgccaatctgtgaaatctgtgggattaaataatcaatataattataaatttcagctaaagccgttggaatgcctcccattcctattaaactgttaattggcgttattcgtgaaaacatttgcgacatttgtgtttaaataaaaaaaatcccgatgaaaaatcaccgggactattataaaaagatctttatatgttagtttcttctgctcatcagaatactcagaatataccagaataaaagcataatagaagcaaaaagctgcaatgccgctcccacatactgattggtaccataagagtctttcagtttacttgtctgatacagaatagtagctgaagctaaaatcaccattcctactgaaaaccataacccaaggttaaaaccgaagatcattcctcccacaatcagtccgatggaaataaaaccaccgattacaataatgtttcttaagaaagaaaaatctcttttagaagtaaatgccacagcagaaatacctgcaaacatagcaatggttaaagtagctgcctgaaagattacattagccccgccttggatattggtagcaataaaaagaagtggcataaagataattgcttccagcaaaatgtaaaatcctaatcctaaatactgagtagatttgctttgagaaagcgaccatttggaagctaaaacagaagccagccagaaaactccgataatcagcagccagatatatttctgactaaacatcataaatataatttcctgcggaaccgttttcaataatattgtttccactccaataaatgcaagaatcgataatgcgacatgcaaatacgtcttcttgtaaaaatttgccttctccacctctgaagaatgagcaactaaaacatctgtcatcatagttaatatttttttgttaatcgaaaataaattaagccttatttcgagggcaataccccaagaatttttccatcatcctcaaatacagcggtaataacttccttggaagatcctccctcatatttatatttaatacttggatgactgattccgtccattgttttataatatccggcctttaagacttcaagttttttgttgggatcaataccatctttgacttttttaagtacatcatccgtcacaatttcctttaccttctcagaaatcaatccatcaatagccgtacggtctgaagcctgtaaagctacaacgaacttctggaagttatcattatacaaactgaccttctccttacttatagtagcctgcacttccttttcaggactgtttccaacctttgcaccggttactttctgtgcaaaaaccagctgcccgccaacaagcgccagtcccagcaataattttttcatagtattcatttttgttctggtgaaataagtgatggaagatacgaaaatcagaccagttctaaaaatttcattgtatctacattatctgcgtaggtatcaagacccggattttgtgcttccccaaacggaattgcattcattcccaactcctcctttgccactacacactgaatattttcttcattttctgcgataaagtttttcacatcatccaaagattcatatctgctgaaattaatcacagaaagcggactgaacagtttttcatcctctttcagcatcacaaaattattatcccagaatttatcctgattcaaaagataaaccgctctgttataatcataattattggcatatttattatgattgatgatatcctggaatcctaagaaattctcaaacagcctgtcaatcacaaagtcctgcggaataaaaattctcgtcacatttctgcatcccaatccgaaatactggaaaatatcttttgccagcaattgcagttcctcattcgtttcatcacccttcagcaccgcaacagaagttctgttcttacggataatgctcaaatgatttttgaaataatactccagatatcttgctgtattgttacttcctgtcgcaataacggcatcaaaattctctaatttttctacaaattcaaaaggtatattcccattggaaaactcgttccattttttaagtaaaaacggaatcatatatttatcttttgaagacagcttaatcacaggaatatgattggccagaatcactgaaattacatcatgaaatcccaccaaaggaatatttccggctaaaataagtccaactctttttgaaattttagaaatggaataatgggccagccagtttctgatgttatcttcagtcagaagttctgcccattgctgtaaagcaaatttctgattatcaacggtaaaccacggattctctatttcagatctttttaacaataattcaatatcagcatcatcttcattgtgatcctccggtttcttcgctaaaaacgcttttatataatcgcttaacttaataagtcctaaaacttgattttcggtattcataattactttaaaattgggtaaaattttgtaattttgtgcaaatttaaaaaaaattagcgatggctattaaaataactgatgaatgcattaactgtggggcttgcgaaccagaatgcccgaacaatgcaatatatgaaggagctgtagattggaaagcttctgacggtacggctcttcaaggtacaattactttgccgtcaggacttactgtagatgccaatgcaccacaggaacctgtaagtgatgatgtatatttcattgtaacagataagtgtacagaatgtaaaggattccatgaagaacctcagtgtgcagcggtatgtcctgtagactgctgtgtgcctgatgaggaccatgtagaatctgaagaagctctgcttaataaaaaagcattcttacacggtgaataaaaaacttccgtctcatgatctgtgaggcggtttttttgtccaaaaatcccaaattaaccaaaaaataaagctaaaggaatctcaaatccggaagcaaccaaaaaataaaaatatgagcaaaaagcacaacttcagcgcaggaccatgtattttaccacaggaggtatttgaaaaatcagcacaggctatcttagactttaacggtatcggattgtctctacttgaaatttcccacagaagtaaggatttcgttgcggtaatggacgaagcgcgtgccattgtaaaaagattgatgaatcttggtgatgattatgaagtactttatctgggaggaggtgccagcctgcagtttgcaatggttccttataacctgatgaaagtaggtggaaaagcagcttacctggatacaggaacatgggcagcgggagccatcaaagaagcaaaaaaagtaggaacagtagacatagtaggctcatcaaaagaagagaactattcttttatccctaaagattatacagttggatcagaatatgattatttccactgcacttccaacaatacaatatacggaactcagatgaaatctttccctgaagtggatacactaatggtttgtgatatgagctctgatattttctcaagacagctggatttttccaggtttgacctgatctatgctggtgcccagaaaaatatgggacctgcaggagttactttagtagttgtgaaaaaagatatccttggaaaaacaggaagagaaaacatgttttctatccttgattattcacagcacattgctaaagaatcgatgtacaatactccaccggtatttcctgtgtatgcctctttacttacccttcagtatcttgaaagaaacggaggaattgctgctgcagaacaaagaaatgaagcaaaagccaagcttttatatgatgaaatcgacagcaacccgttattcgaaactttctgcgtaaaagaagaccgttcactgatgaatgtgtctttcagaattacagacgaaagtaagaaagaagagtttgataatgcatggaaagctgccggaatcagtggcttaaacgggcacagaagccttggcggctacagagcaagtttatacaatgccctgccgattgaaagtgtacaggttctggtagatgtgatgaagtcgataaaatagcttatattaggcgaccgaaaaataaaaagatatcagacagcagatgtcagacaacagacctcaaagtttgatttctgacatcttgtatctaacatctataaaaataacaaatgaaagttttagcaaacgacggaatctcaaaagcaggagaaaacgctctgaaacaagccggaattgaaattctggacaatagagtggcccaggatcacgttattaattttatcaacgataataatgtgactgttcttcttgtgagaagtgccacgaaagtaaggcaggatctgattgatgcatgtcctggtcttaaaattatcggaagaggcggtatcggaatggataatattgatgtagaatatgccagaagcaaaggcattaaagtcatcaatacgcctacagcatcttcaaaatcagtggcggaattggttttcggacatttcatctcactggcaaggttccttcatgaatccaacagactgatgcctctggaaggagaaacgcatttcaatgcgatgaaaaagtcattcagcaatgcgcatgaactttcagggaaaacattaggagtaatcggctttggaagtattggccaggaagttgtaaaaataggaattgctttaggaatgaaaataaccgttctgacaagaagtccgaaaacagaagttctaacactgaatttcttcgatggacagtcagttaactttgaaatcacttccaccaatgatatggaagcattccttaaagatgccgatttcatcagcatcaatacgccgaagacgaatgaatatattctggacacgcctcagtttgaaaaaatgaaagacggagtctatattgtaaatactgcaagaggaggtgtcatcaatgaagtggcactgattgattttattgaatcaggaaaagtagccggagcggcactggacgtttttgaaaacgaaccgaaccccgaattacctttgctgatgaaccctgcattatcactttcccctcacataggcggaaatacggtagatgcacaggagaaaatcggtatcgaacttgcagaacaaattattaagctacaaaaagaaactataagataaatatgcctgtttttaaacctttccgtggaataagacctcatagagactttgagagtactttccctacccatccactggataatttcacccaggaagagattgcagagaaagctcaagttgaaaatacttacatcaatatgatcaaaccctatgttgtaagtaaatccaaagatattgaccggaacctgagaaagatccgttctacatttgaagaacttctggaagaaaagaaattagtccaggacaattcagcctattatctttatgagcagatctatcccaacaaacagatgttcagaggacttctgggattggcaagtattgaagatttctggaatggaaaaatcaaaagacacgaaagtaccattccgcagaaaaaggaaaaactggctcattatcttgaaaaagtaaacctgcaggcagaacctgtacttcttacctatccggccaattcaaagattgaattgctgatgaaccatgaggaaaaaaatgttcctatcttcaaccatgtggattcgcttggtatcagacacaaaatatggagaattgacaatcgcctgaaacttcagcagtttaaagaagtaattgatcagattgattctttttacattgctgacggacaccacagaatcggatctacagcattaaatgccaaataccataaagagaaaaacaaaaaacataacggtacagaacattacaactttgtatatagttttattgtttctaaccagtcgatcaagattcatgactataacagaattttacatgatctgaatggaattgctccggatgatttcctgaagcagcttgaacaatatttccttattcacgaaaaaggagaaacaccatactacccttctcaaaagttccacatttctatgtatatggacggtaagttttattctcttcacgtaaagcatgaccttcgttccaaggaaatgtctctggacaatctggatcaccaccttctggacaagtatattttcaaaaatattctgaaaattgaagatccggacagctctgagcttatttcttatgtaaaaggaacctccaatatcaacggaatcaatattttaaaagaaaaagtggataacggtgaaggtaaagtcggtttcggaatttaccctgtgagttttaatgatatgattaaaatttcagacttaaaactaagcatgcctccgaaatgtacattcattgagccaaaattgattacagccttagtaatgtatgatatgaaaccttaataatttcctattttttccctaattttatcaatggaaaaagaaaggtaaataataaatgaaaaaaatattcattatacttccactctttttgagtggatttttattttctcaaaaaaagccacaaaaaagtccggcaaaaaaaggaacggttgccaaattcaattatcatgatgagttcagaaaaatttcggatgaaattatgaccaacggcgctgcttatgaaaatctgggagagcttaccaaaggaatcggaccacgtttcagtgccacaccagggtattcaaaagccgtagaatgggcagaaaaaaaatttaaggaaatcggcataaacatgatctggaggcaggaagccaaaaccccggattggatcagaggaaaagaatccctgcagataaaagccggaaacggagactggaaaaatatcagaatgctttcttttggaaactccgaaggaacaggcggaaaagacctgacaggtgaaattattttaattaattccacatcagagcttaacgctatgtcggtagggcaattaagagacaaaatagttttcgtaaatgttccaatggacccgaaaattatcaataccagtgattcctatttacaaactgcaaaatcaaaattaatttccgcatctgttattgccaaaacaggcgcaaaagcattaattataagatcattaacaactgccaatgatgatactccgcatgccaaaatgatttactacgaaccggatgataaaattaaaattccggctttgtctatcggagtaagatctgcggatgaattggagaaaaccctgaaaagtcaaaaagttatcgctaaaatcaatatgaccgcacagtcaaaaagcgataccaccaatcccaatatcattgctgagattcagggcaaaaaagattctaaagtaattgttttaggtgcccagcttgattcctgggatgttggcgaaggcgccattgatgacggaacaggtgttgtgcagtgtattgaagttttaaggacgttgaaagcgcttggatacgaaaataatcacaccatcagagtagttttgtatgccaacagtgaaaacggaggacagggccgcgaaatgtacgccgcttatgtaaaaaagaaagaggaaaaacatgtatttgctttaggaactgatgccggaggatattctccgagaggattttctttagacatgtcgcctcagagaagaagactggtatatccatggaaagaatattttcttccttacggagtttatgattttgaccagacagaggctattcaggacatttcacccttgaaaaaacttgatattcctctggcagagctcgttgtagatacacaaagatatttcgactaccatcattccgaacaggatacttttgataaagtaaataaaagagaactactgctcggagcggttgccatcacacagatgatttttatggttgataaaaactggtaacaatgaaaaagatattaggaacatcattattactttttggaatacttgctttcggccagtctaaagaagattccattcagttcagaaaaatttccacagaaattctgaacaacggaaaaggatataatgaattaagagaacttacccaaacaataggcaatcgtttaagcggttctgaagcctacgaaaaatcggtacagtgggcagcacagaaactccgtgatgccggagctgataaggtatggcttcaggaagtcatgatcccggtttgggtaagaggaaaagaatctctgcatattcaaacctccagaggaaaatggaaaaacatcaaaatgctttcgcttggaaattctgaaggaacaggaggaaaagatgtttcaggtgaaatcatcatggtaaaatcactggaggaatatgatcagcttcctgccgaaaaggtaaaagataagattgtctttttcaattacccttttaatcagggaaatgtacagacatttatttcttaccgtgatgcaagtgcttacagacggactgcagcttctttaacggctaaaaaaggaggcaaatttgccattgtcaggtcactttcttcagctttcgacgatgttccccacaccggaaacatgcgttatgatgaaaatattcccaaaataccggctgtaaccattggaaatacttccgctgatgagcttgaagcgttattaaaaaatcataaggttacagctaaactcaattccaactgcggaatgaaaggtgagaaaccctcccactctgttatcggggaaatcaccggtaaaaaagatcaaagcgttattgtggttggcggacaccttgattcctgggatgtaggtgaaggtgcccatgacgacggagctggaattgtgcagagtatcgaagtattaagaacctttaaaaaattaggcatacaaaacaaccacaccattcgtgcggtttgctttgccaacgaagaaaacggaacaaaaggaggaaaacaatatggcaaaacagcgaaagaaaacaatgaaaaacatctttttgctatagaatcagatgccggaggcttttcacccagaggaatttctctggaaatgaatgaccctcagagaaaccagatcaaaggctgggttaatctgttcttaccatatggcgtctataactttgaaggaaaatattccgggtcggatatcgctccgcttcacgaaatgggagttcccactgctgaactggttccagatccacagcgttattttgatattcaccatacagaggaagacacttttgaaaaagtcaaccgaagagagctgctgctcggtgctgcagtaatgacacaacttatttatatgattgataaaaattggtaaacaatgaaaaagatattaggaacttcactattactttttggaatgcttgctttcggccagtctaaagaagattccattcagttcagaaaaatctccacagaaatcctgaacaacggaaaaggatatactgagctgagagagcttacaaagaatatcggacatcgtttaagcgggtctgaagcctatgaaaaatccgtaaaatgggctgaacaaaaactccgtgatgccggagctgataaagtgtggcttcaggaggtaatgatcccggtatgggaaagaggaaaagaatccctgcacatccaaacttcgaacggcaagtggaaaagccttaaaatgctttctcttggaaactcggaaggcacgggaggaaaagatgtttcaggggaaatcatcatggtaaaatctatggaagaatatgataagcttcccgcggaaaaagtgaaagataaaattgttttcttcaactatgctttcagccagtctttcatagaaacctttaaggcttatggtgatgctgccagatacagaactacagccgcttctctgacagccaaaaaaggaggtaaatttgctatcgttagatctctttcttctgcatttgatgatattccccacaccggagcaatgcgctatgaagacaaggtttccaaaataccggctgtagccatcggaagtactacagcagacgaactggaagcattattgaaaaatcagaaagtaacggcaaaactcaattccaactgcggaatgaaaggtgagaaactctcccactctgttatcggggaaatcaccggtaaaaaagatcaaagcgttattgttgtgggcggacaccttgattcctgggatgtgggtgaaggtgcccatgatgacggagccggaattgttcaaagtattgaagtattgagaacttttaaaaaattaggaattcagaacaaccacaccatcagggtggtctgctttgccaatgaagaaaacggagtaaaaggcggaattcaatatggtaaaacagtaaaagagaaaaatgaaaaacatctttttgccatagaaacagatgccggaggttttgcaccgagaggaattgccctggatatggatgatgccaaaagaaaccagatcaaaagctggtcaaacctgtttcttccttacggagtttataattttgaagaacggttttcaggcaccgacctctacccgcttcataacatgggaattcccgcggcagaactgatgccggattctcagcgttatttcgatattcaccatacagaagaagatacttttgaaaaagtgaaccgaagagagcttttactgggcgctacagctttgacacagattatctatatgatcgacaaaaactggtaaaataagaaaccgtctgtaaagacggttttctttttaaacactgttgataaatcatcaattcaaatatttttccctactgattttgcagatgtgcacagatgatcatgcaaatcttttaatagcttgattcgtatgatactatttgtggaatttgtgtaaaaatattagtgctatttgtggttatgattaaacacaaatgacactaataatttcacgaataacaccaatttcataaaactcatttattcaaataaattaaaaataagttgaaaacagtattctaatcattagttctatccttaaggacacaagcttcatgcttaacttttcccatcatattataaatatgaaaaacaatttctccgtaatattttctttgttgtcattaataacacctaagtattagaaaatttttctacgtttaaggaaataacagaagaaaacacgcgtcactactgatctcatcactcccgtgaaacaaagtgttaatcgcataatctgaactttggcataatattggcatgtaaattatggagaaaaaaaataaaaaaacactaaggatgagaaaaaaggttttctgtggattttcagtttttccactgattcaagttcatatgtaaatatgaatccctttttttctacgatgccgtaaaagatacgggcccctgatcaactaacccccattagtttttcatagcagttttgcacccgtatctgactggtatcacaataaccaggaatcatttattgattcaaaaaaacaaaatatcccggactttcagcccggtatcataatataaataaacggcaaagtcatcgtgaaccttagcccagtaaaagaatatattctttttaccgtgatgagtgcgcctttatgacataaattaatgtataacccttaaaatgttagtaatgatgagagcgttttttgaaatgatttttaagagaaatgaagatgctgcgaaattgcatatatggagcctaatgctggtgttgagttttgctgcattttctgtgttggtatacgccacgaaaccaagctttaacagcttaattatatatctgacggcatttgccgcttatatcgggtttggccttgtattcatcagttccctggccggaacacgtgtgaagaaaagataacagaacatataactttcaatttatttttacttgggaaaccgccctgtttgggggcggttttttattattcaagttatttaaaaaatatatttttcatttccaacaaaaaaagccactccttccggagcagctcccgtgataacaacaagtgctatcatcacatcgtaaaaatttattctttaaacatattcttcagcattttttcgaggatcttctgggtttcttcctcgatcatttttccggatttttcaaccattttttccctgaaaggctcacaacaggctttgataccgaagccttcatctattttaatcagttccggatgaagattgtgcgtttcacatacctccgactctatttccttttttatcccattgtaattcagatccaacatatttattttgtttcttataagtgccggataaagatagaagtaataattccttaccgaaatccgtatttttacggtatttgtaggaaacaaataaacacttcttcatagacagctttatttttaatacaaaccaacacttactgcttgactctttaaaacttatccagaattttcttcggtaagattttcaccagttcttttttatactctttttcaagaacaacaaatttccatgcctttttatcttttgcaacagcacaggctttcataccagcgttgatgagataggaaccttcgttggctacatatttcacattatctgcaccgtacttagctgttaaggcaccgttcattttctttttcatgtcatcatttaatgaactgacgttgcatttcagtttcaaaaagtaatgggtaatagaaaagtattcaccggtaatgagttcaggtttctcaatagttccaaattttaaatcatgtacttcaattttcatgaatggattattgtaagtcatattcaaaatctgagtcatctgctcttttgaaactatcgtgaagaattttggatatatacagcttaccgcctgatcgatctgtttggactgaatgctgtttacaaaataagtaagtgatttttttatcgcggcatcgtccggatttgccctggtctgtgaaaaagccataaaagacagcataacgaacagaagcagaagtgatttggttttcatgattgaagggtgttacatttttgccagaaaaattattaaactttccaactgtaaaatatgtcgtgatattgactcagatcgttacagaatattttgagcaaaataaaaaagccatcctttcggacggcttttaccatattttgaagattcaattattttacttttacaagctcaacatcgaaaaccaaccatgagtttggcgggattacccctcctgctcctctttctccgtaagccatcgccggcggaatcaataatgttgctgtttcaccttctttcaataaaaggatcccttcatcccatcctttgattactcttcccattccgattggaatttcgattggctcatttcttttaaatgaagaatcaaactcagttccgtctactaatttacctgcatagtgtacggatacattgtcaccagcttttggagccttaccgtcagctgtttttgtgattttataataaagaccggattcagttttctgcataccagctttcaggctttctaccaatttctcctggttagctttgaattcttcttcttttttctttctttcagcttcttctttagcgatgaaagctttattgttttctgcgattttagcttttccttcgttgaaagttttagctgcatcgtagtgtttgtactcgtcacctttactgaaaacagatactttttctaaaacgatatctgttttaggcttatcctgagctcctttttcaacgttagcaatagcatcaatcacttcagtcccttttactacttttccgaagatcgtatgtcttccatccaaccaaggagtagctacttcagtaataaagaactgggaaccgtttgtgttaggtcctgagtttgccatagaaaggatcccttttcccgtgtgcttaaggtcatttctttcatcctcgaatttatatcccggatctcccatacctgttccctgaggatcacctccctggatcatgaaatctttgattactctgtggaaaatagttccgtcatagtaaggaactcccttagccttagctttgttatcgattttcccttctgcaagaccgataaagttggctacagttactggtgctttcttgtcttcaaacttcacaatcatatttccttttgtggtttgaagattggcataaagtccgtcattaagaccttcgtaagtttctttgtctacgttcatttttttataaattggggtacaactcatcagcgaaatacttgccgctgccagaattatattcttgttaaacaatttcatgtattatagagcttttaattttatgattaatggaatgtcgttgtctattttcttttcgtctccgtaggttccgtaagccagtgaagacggtaccaaaagcgttacttcctctccatcccgtataaaacgtaaagcattctccaccgctttcagttcatcgaaatgcccgaatctggcatctctcctttcaaaaggcttgtcatagattttagtctcatcaaaatcatacagatcataggaataggaaatcatggtctcatctttccttttttctctctgatcataaccttccaccgttacccagtaattaagctgcgtaggataatactttacagactggccattgatccagtcctgaatctggccccgttctatagtatttaaatttttcatcctgtttttggaaacatccagatctttctggcttaaaacaccgcctacaggaggatgagccgtctgggtatttctgttgcagctcaacaggcttatggctgatatgaagagtatttttttcataaacttttgcgaaaatacacatttcgcgaatcaattacaaaacttggttaagaaatgtgtgaatgtaataaaatatgaatctaatcttaaactattcatacatttttataaatacatagatacaaaaaagccgggaaaaacccggctttcatattattatttatcagctattatactgtttccaaagcgtggtctacaataactctccatccgaaaggatcttcagacaggttggtttgtaagtctacaaggtctttctttaggatcgctgcaaaactttcctcatcagataatcttggaagatcaagtttttctccctggtaccctaaagcctggaactgagtggtaactacagccgtacctactccccaaacttctttaagggaaccgttctttaaagcctcaattactgtttttacagcaataggctccacttttacttcgattcctcttctttttgccagctgaataaagctgtctcttgttactccatcaaggattttttcagaagtcggaggtgtatagattgtatcattgattcttacaaagacgttcattgtaccactttcttcgaaatattcgtgggtagcatcatctgtccagataatctgctcatatccttcttctatagccaattgtgtaggatagaaagaagcagcgtagttccctgcagcttttgcagaacctactcctccgtttgcagctcttgaatagtggtcagaaattttcactgataccggttctgaataataactcttcgctggcgttgcaacgatagcaaacatatatttattcgaaactcttgctttcaaagcttcttctgtagcaaaaatcaaaggtctgatataaagagacattccttccccctgtggaatccaatctctgtcgatatctactaatgcttttaatccgtctaaaaacatttcttcagtcacttcgggcatagcaagacgcttcgctgacttattgatacgttcaaaattcttttcaggcctgaaaaggaaaacctgcccgtctttgtctttataggctttcataccttcaaaacaagcttgtccataatttactcccatcatagcaggtgtaaatggaatcggaccgtaaggaactaattttacatcaccccattttccgttttcatactcacaaatgatcatatgatcgatgaaagtatttccgaatgaaaaattgttagggtcaaatgtagaaattctggagttttcagttttttgaattatcattttttaaaatttttacgatgttctacaaatttaacataattttctaaatataaaaattttagagtaaatttgacaaaaaaatagcttgaaaagagaaattaagaccacaaacgacggtagtaaaacattgtttatcaatgaattaaatgaaaactaccattctcatcacggggcactacaggaagccgaacacgtgtttatcaaaaatggactaaatttgataaatgattgcgaaattaatattttagaactcggttttggaacaggtttgaatgttttggtaacaattaatgaatatttaaaaactgacaaaaatcatgtcatcaattatttttcacttgaaaaataccccataaatgaatccgaagttaaagatttagcttacgatgaactttttgataacccagagttaaaaaaaatttatcagaaaattcatctgtcagattgggaaaagtcagtagaaattattagtggattcaacctaaaaaagatagaatgtgatttttttgacctgaaagacattgatctgcctgaaattaaccttgtctacttcgactgttttggcgccagagtacagcctgacctttgggaaaaaccgttatttgagctggttgctgacaaaatggccattaacggattattaacaacttattcttcaaaaggcagcgtaagaagaattcttcaggaattgaatttccaggttgaaaaaaaacagggcccgccggggaaaagagagatgattaacgcagtgaaactgtaaaaggcaaaggggcaaaattgctaaaaggcaaaaactatccagaagcggatcttcaaatttgcttttcagctattttgctttttccctatttcgccttttcacctctgtaaaatttccttacattagctatacaaaatattatacattatatatatgatagataagatcaacattagagtgtatgcatgtgcggtaaaagataagcaggttttaaccttatttgaagaatatgccggcgaacctttaatgaaatttccgggtggcggactggaatacggagaaggtgtactggaatgcctgcatcgtgagtttgatgaagaactgaatgtaaaaataaatgtactggaacatttctacacccaggaaaactttctggtttcccgtttcagagaaaatgaacagctgcttaccatatattatattgtagacatcatcaatgaagaagattttattattatggatccctgtattgaaaaaacagaatggattgatattgacagaccggacaatcctttcccgcttccgatagataaaattgtatttaataaattaaaagaaaaattcctgtaagtaatcttacaggaatttatattatttctttactttaaaatcgcttgctcccgggtaaggctgtaaataacctgagttccagttggactgcagcagtgattctataaactcatcacttctgttggtatgagggtcataacgttctttcagatcaatatcagccatttttccttttacattccaccagaaagcgctccatccacctctaagttctttgataatctcaaagacatttttaccggtagccctgttcatcagttttgcaaaaacctgtccttcggtagtagtaagatctctcagttgtttttcatattggtcagccagtatattctgtctctctcttacaaactttctcttggctttactatccatatcattcatatctttctgaatatccctgtactgctgcaatgcggtaacaaataacggatataccctatagagctttttatttagaaagtaatagtaattcttatccagctgattgttaaaccttggcttgttcaccaataccagttcatctaaaacaacgacaggttctccattgatttcataaaccttaattttctgctgctcgtcgtaataatatttattaccgaattcgtccactttcagagattcgggcgggtactgattgagaggttttgccacaataccatccttctgaccgaaaacactgactccaaaaaagagaataaaaaggcagataatcttactaaaattcattatttttacacttataagaacaaaaattaaacgcaaaaatcattcctttttatgaaatttgaaaagaaatctttgaaatttttagaaaaatacctaaacacatcatcaccaacaggttacgaacataaaggacaggaagtctggatggattacatcagaccgtatgtagataagatagaaatagaccattatggaacctgctatggaattattaatccggaagctgaatttaaagtagtgattgaagcgcatgctgatgaaatctcatggtatgttaattatattactgacgatggattgatttatgtcatcaggaacggaggctcagaccagaccattgccccttccaaagtggtacatattcacggagaaaacggaattgtaaaaggggtattcggatggcctgccattcatacaagaacaaaccagaatgagccggctccaaaaatcgaaaatatttttatagactgtggcgctacttccaaaaaggaagtggaagaaatgggaatatatgtaggatgcatgattacttatcctgacgaattctttgaaatgaacgaccgttattttgtgtgcagagctttggacaacagaatcggaggttttatgattgctgaagtagcaagacttttaaaagaaaataagaaatcaattccttttgggctttacatcactaattccgtacaggaagaagtaggcttatatggagcagatatgattgctgatactatcaaaccgaatattgccattgtaacggacgtcacccatgatactaccacgccgatgattgaaaagaaaaaagaaggtgatcagaaatgcggcgcaggtccggtagtattcttcgctccaagtgttcatcacaccatcagggagctgattattgatacggcaaaggctaaaaaaattccttttcaaagagctgcagccagcagagctacaggaactgatacagatgcttttgcccattcgaacggcggagtaccaagtgcgttaatttccttacctttgcgttatatgcatactacggtagaaatggtgtctaaggaagatgtagctaatgttattaaacttatctacgaaacggtccttaaaatcaagccggaaatgaaactgaaatatcattaaaatgaactcaatttctgatttaatcaaaaagccaacttttatctctattgtatttatcatcctggccgtacttggaattcctttaattgtctatcagttattgaccattcctgaaagcgggagcctgggagttacagtagaaataattttcctgttggttttgttcggattttttgtaatcgacaggtttttaatcagaaacattagctataaaaaggtatccatcatagaagtgatgataataacaggatatctgacttattattatttcaccaatgaccgttcattttcaataggataatataaagtaaaagtataaaaagtaaaaatgaaaacgaagcttattgctccatcccttttatctgcagacttcgggaatctgcaaagagacattgaaatgctgaacaattctcaggccgactggttacacgttgatgtaatggacggcagatttgtacccaacatttcatttggttttccggtaatgaaaaccgttcagcagcatgctaaaaaatttgtagatgttcacctgatgattgtggagcctgaaaaatatgttgatgaatttatcaatcttggtgcagaccttgtttctgtacattatgaggcatgtacccatcttcacagaaccattcatcatattcagaataaaggggcaaaagcaggtgtggttttaaatccttccactccggtgttaatgcttgaagatattattgcagatgtcgatcttgtattattaatgagcgtaaacccgggatttggaggccagaagttcatcgaaaatacctataaaaagattgctgaaaccaaagatctgatcttaagtaacaattctacagcacttattgaggtagatggaggtgtaaatcttgacaacgcttctaaattatttgaagccggcgccgacgttcttgttgcaggaaatgctgttttctctgccgaaagcccggaaagaacaatcgaacttttaaagatttaagattatcttttatcatacacaaaaggcagccgttggctgccttttctcttgtttggaaacttaagtcgtcttggttataatctttttttcaacttgttgaaaatgtttaaaactgtcttactaacaagacaaagatctgaataaaatcacacgtacgcatccgtagaaatactgaatctgacatttgcgtatttttacttaatttcatttataatttttatatttccttattccagacgcaggcacagaccacaaaaatgatagaaatgacagaaaaaacagttcttatattattcaggaaattccatctgttttcaaaattttcccgcatctgtctgatcgcttccgtagtggaacctgtaatatcaaacttatccagtgcatcattcatcggaacatttccggcaaccgtaaccccaaaaactccaatcaggtaagccaatgtagccagaaggagaaaaataaagacagactgttgtccacgaaacaaaaacgttgaaacaggaagcagaactacagtacccataaaactcataaagaagacaggattaaggatttccctgttgatgttctgcatagctttcaggtattccggatcagagagctttcccagcccgaggaccacagaacatgaataagcataaaaaagtcctcctatcaaagcagtgagaacagcggtaatgatcaatattaatgttgtcattttcatataatttgattttggttatcagaatagaatttaataaggattccattttttaatgatgttctgcgctgtaagaatcatttcaggatcccagttttctgttttgaaataatgaaaatcatgatttttaataactgcagcatcagcattttcaaaaagaagcttagtaagctccgactgttcttcatacagcatccaatcttccaaaggcttctccggaagtatcatttcttttttcatccagctcctttctgacagtttcaagtcggatatttcaataatctttctgacagtatgaaaatcattcaggaaagaaactttttcttcttccgtttttacagtatgcccgagtctttcaataataatatattccagattttggcattgttccattacagagggtaaaacagaaagaatatcctgcggaatgacgtcatcatgagtatctctcctcacctgctttttcccgtaagcactctcctgccagcttcctcctgaaagatgaatctcttttaccttatccagagggtataaatcaacgatcgctttcatttctaccccaaaattgcaggattgacaataaatattatggatatcaagaatcagaaagccatttgtatcttctgtaagctgatcaagaaatatcccctgctctttaacatcatctatagaaaaagaaaatgccagattttctatcccaacaggaatatccactacatcctgaagtctgcaaagcctgtcttttcctatttgtaaagtttttggatgcagagagaccggtaatggcactccctgatgaaaattttccgtattcatgaaaccaaaatgttcagtaatatggttgtaattccggagcctgacttcttctttaagctttttcagccattcatcctgtctttctgtccatcttgcatcaaacaaagaatagtaaacaccatgacctatcaaacggccgttctctgcgtaaaagtttaacaaatcacgaagccagtccggttcatttggatgataaagggtatcaaaagaccattccaacacatcaatggaattattctgcagcaatggtaaaatagcagaaacaaagtctgcttctgccatcattgatactcccagcattggctttctcatctcctatcccattccgcaggccgggcagccgtatccatgaagcacaagtgtatctttttttacgaccggtttaggagttcccggttttttcttttcagccgtatccgaagcagcagctttccttacttttttaacaggcttttttgttttagcggcaggcctggtagtctgtgcagatactcctaccgctaataaacttgccattaatattgccggaattttcataattgcttttttcaggtaaattttacaataaacgttccatttctaaaaatacaataataagaaactgtttgataataattattgctaaatattaaaactattttatcctgtaatgttttctttatttatatttaatgttaaaataaatctatatatgaaaagcagtctgattaaagctgttttcctgggaatgatattatctgcgggtactattggtgcacaggagcaagcagccggcaacagcaaaaaaatggaatggtttaaaaatgccaagctgggtatctttattcattggggaatttactccgtcaacggaatctccgaatcctggtcattcttcaataattacattaatcacgaaaattatatgaaacagctgaatggtttttcagcttcaaaatatcaaccggaacaatgggtaaatctcatcagggaatccggagcaaaatatgcggtgataacaacaaaacatcatgacggagtttcattgtggaactcaaaagcagaaaaagcgacaactattcctcaaaattcactggcacaaaaggatgttttaagcccttttgtttctgcattgaaaaagtccggattaaaaacagggctttatttctccttaccggattggagtcatccttattatgatatcaatacccggacaaaaaagcgttatgaactcaaaaacgatcctgcacgctggcagcatttcatcagctattatcagagccagcttaacgaactttcttctcagtattctccggatcttctttggttcgatggggactgggagcatacttcagaggaatggcaggcttctcagactttagatttgctcaggagacacaatcccaatatcattatcaattccaggctcaacaatcacggagattatgatactccggaacaaggtgtcccggtagttccgcctcagaatccttattgggagctctgctataccatgaatgattcctggggataccaaccctttgacaaaagttataaaactcctaatatgattgtcagaacgctggcagatgtaatcagcatgggaggaaatctcctgcttgatatcggtcccagatcagatggcagcattccggaggagcaggttgagattcttaaaaacctgggacgctggacctcaaaaaatcagcatgccatctatgaaacaacccgcggaattccttttgaaaattacaaagggaaatcttctttgtcggtctccaaaaaatctttattcctgtatcttgaagaagccaaaaatttcacaaagatctatggactggcgacaaaacctctttcagtaaaaatcatcggagaaccatccgctgttgttaaaacggattataacactgaaaaaactctgacattgaatttctccgatgtaaaatttgacaaagatgtcacagtggcagaacttacttttgacacacctcctgtgtttctcaatgattttaaaaagaaagaaaatctccttgctgaaatgctggaaaacaaaaatacccgggaagcagtttatgatttggccaatgccttacataatggtaataatctgatcacaaatgcaggcttaaccaatgatggcctcgacatgaaaatcaaaaaaactcctgcaacaaatccggaaacgctgcaatggataagcaaacatgcagaagctttatttgaaacaggaaaaggactgccggaaggtcattttccgggaatgagtgctttatcaaaagacaaacagacactttatctttttgtggaaggaattccaacgggaccaattgcactgaaaggaataaaaaacaacattgccagaataagaatcgcaggggaaggcagcatgcttacccataccatttacaataaactttactggagtgacaggccgggaatcatttacattgatattcctaaagaaagactggacaaacagatgaccgtcattgcagttttgcttgataagcctctagagctgtacagagaaaacgtaggagctattgaaaataatctttaataagccgctgcacagaaaaacaaaaatccggagaaaattctccggattttttattgtataagatgattttcttagaaaatctctcttcctgaaaaatggaattgagcttcgattaatgcattctcgtcagaatctgaaccgtgaacagcattttctccgatgcttcttgcaaacatttttctgattgtaccttctgcagcttctgcagggttagtagaaccgattaatgttctgaagtcttcaactgcattgtctttctctaaaactgcagccacgataggaccagagctcatgaattctactaattctccataaaatggtctttcagcatgtacttcatagaatttttttgcatcagcaactgtaagctgagttaattttaaagctttgatcttaaaacctccttcagcaatctttcccaatatagcaccgatatgtccgtcagcaacagcatcaggcttaatcatagtgaatgtaatgttagacataaatgtatatttttttaatggcgcaaaattacaaaaaatatctttgatttttattttaattttttttaacataaaaataacttttattaagaaatcatgaactaaactttggcacagtaattgtttattctattgcgattctcatgtttaatttgagttttcatggttattagtttttacccagcttcggctgggttttttatttcaaaaaaaataccacatttttttactaattccataattttcaacaacataaaaagtcatataaaataattttgtcattttttttgctattattgcaatagtcaaaattacccttagtatcatttttcaagctcaatcagaatgtgacaaaattggagttatttatgagaaaggtagttccaaaaagtggaattattcaaaaacagatttttttcattaaaatccaaaaaaaataattcataaaaaacaaatgcttctatgtatcttaaatttaatctttaaggaagtaatttattagaataatattttatatgacaccaaaataaaatgatacagattgtccgattcatgtgacattataaaagaaatgtctgtccttttatttctgggacgcttcttcagcctcatccatcagtttaatataagtagcatagcgggaatgctgaatttcacctgtttcaagcgcatcaataacggcacatttaggttcgtttacgtgaaggcagttgtgaaatttacactcttctctcttcttgaaaatttcagggaagtaatgctgtacttcttctttttcaatatcgatcatcgcaaattcacgaacgccgggagtatcaatgacatttcctccaaaatcccagaagtgcatttgtgcaaaagttgttgtatgctttcctttcaggtgggtgtccgaaatttcagatgtttttaagttcagcccaggctgtaaagcatttaccagagtagattttccacaccccgaatgtccgaagaatacagaagttttatctttcagaatttcctgaagctgatccagatttaattttgaataggaggaaatttccagtgtattataaccgatttcctggtataggaattcgatgtcttttacgatttcaatttcttcttcgtgtaaaacatcaatcttattgaaaagaatcagtggggtaatattgtaagcttcgcagcatgccagaaacctgtccagaaatcccaatgatgtttcaggatgctttaaggtaaagataaagcatgccagatcaatattggatgcaataatatgagcttcttttgaaaggtttacggattttctgatcagataattagagcgtggctcaattttcgtaatccatgcaatatcatcctgttccagctggaattcaacaaaatctcctacagcaagcggattggtaagtctggtttttatcagtttaaatttccccctgattctggcctcgaaaattttatttgtttccaattccaaaacctggtaccaactgcctgtagatttaatgatttttcctttcatagataatactgctgcaaatatacggaattagggcttagaattcaggaaataggtttaaaaacacatgtttcaattgcctaaatactgatgctaagccctaaattgtattgttgacgaaatcggtaaaagttttatgtacttctctctatcatctataatttatcttttgtcgatcataatgttattctgaacttcaatagactcctcatggattgctttgaatactttttcaataaattcctgagacattcctgtttctttggctttttgtgtagcgtattctgtaattactttccaacgttcgggctggaagatcgcaatatcgttttcctttttaagtttaccgatcttttcagaaattttcatcctttgggaaagaagttcaattaactggaagtcaagatcggaaattaaagttctgtgtctccccatttctccttcaaaacctgcaaggttagagcttctcacctttaaattaccgataagatccgcaagaacctccggtgtgatctgctgagaagcatcgctccatgcctcatcaggattgcagtgtgattcaatgattgctccctggtaccctacgttaagtgcctcctgcgtaatatcagcaagacctgttctgtttccgcagatgtgtgacgggtcaatcagcattggtatattcggaaactggcttttgaaatcaagggcaatctgccagttcgggttgtttctgtattttgttttctggtaggttgaaaatcctctgtggatcactcctaaatttttaatatcctgtcctaatagtctttccaatgctccgatccataaagcaagatccggattaacagggtttttcacgaataccggcttatcagttcctcttaaagccatcgcaatttcctgtactgtaaacggattcactgtagaacgtgccccgatccaaagaacgtccacatctgcctccagagctgcaaatacatggtgtgcattagctacctcagtagctgttttaaaaccatattcttcttttacttttttcagccagttcaaaccgattactcctactccttcaaaaccgttcggtttggtacggggtttccagattcctgcacggaaaaccgacacgttagcattggactctttaattctcctcgcagtttcaagcatctgagcttcactttccgcgctacaaggtcccgcaatcattaaaggctgtgtaagcccatcgatccactcattttttaaatcatttaaattcattattctaaattttattgtttttttatataattttttcgttgacagcaatagccctttggattataaaatttaatttataattcttttcaaaaaatgccgttcaaaattgtttaaaggaatcaggaaaataatagggctctacttctcctgtattttttggaaagaaattcagttaacagtaccaataaaattggtaataggttctgaaatttctataataagaagcagaaaaactaaaataaccgctaaaaaagtaattagcgggtgcaaaaaaagacagatatgtgttagtcagtttttccattttatctggaaatgtctttgttttagcgtttctggttgtaatttgtttttgtcaaaaacttattttcgacagaaatatttgacaaatatataaaaattatgtcaaatcaaacttcattaaatcatcaagatctttcaaaagtggatttttttcgataaacttttcaaacatttttctcttcgtcactacctcaatcttcagattttcaacgtctctgacgtattctatctcgattctatggttctgaacttttcttttaaaatgattaaaaaattccccgcttattttatcaaattctactttggcagaatctgaagggaacaaaactttgattttatgttcttcagctttttccagcttaaaggtttttactgcgttgaacacaaagttatttttaatctgaagctgcttaagcataattttccattctgtctgcagatctgtatctgtaaaatggttttgaggaagattttcagttctcacaactacatcttctgttgcttccactttatcttctttattcagaaaggaattgatgctgaaacctgaagagattccctgttttgacaatggcttggttgttttggctactgaaactgcctgaactgtctgagaagctgcaggctgctgctctgctttaacttctatcttctccggagttctttccggcattttcacttcctgtttctcactgagaaacggagccagtatcaggaacttttttttttagtatcgcctaaattagctgtcagtgaagccagctgcattaatgcaatttcaaccgtaagtcttgggtttttggagtttttataattgatgtccgcatggttgcagatctcaataccatctatcagttgctgggcggtccatttctgtccctgttctacaaatttggctttggtcttctctcctacttcaatgagttccattgttgatgcattctgtgccatcatcaggtcccggaaatgatttcctaatccggcaatgaaaatatggggatcaaaacctttttttacaatttcattgaacgcagaaagcacttccggaattttattttccttggcaagatccacaatattgagatactgatcgtaatccagaatattcagtacttcggctgctttgaccagtgtaatatttctctgggagaaagtagacagcctgtcgaagatggaaagcgcatctcttaaagcaccatcggctttctgagcgatcaggtacaatgcgtcatcttcataacggatattttctttctctgcaatatttctcagatgattctggatgtcttcaatgacaattctcttgaaatcatagatctgacagcgggataaaatggtaggaataatcttatgcttctccgtggttgccaaaatgaaaatagcatgggcaggcggttcttccagcgttttcaggaaagcattgaaagcggcagaagacagcatatgaacctcatctatgatatatactttgtatttaccaacctgaggagcaaaacgtacctggtctatcagttccctgatatcatctacagagttattggatgcagcatccagctcatagatattatacgcaaagccgtcttctgaaaccgagccatctttctcattgatctttcttgccagaatcctggcacaagtagttttacccacaccacgaggaccgcaaaaaagcaatgcctgagctaattggctttcttcaattgcatgttctaaagtatccgtaatatgggattgtcctacaaccgtatcaaactcctgaggacgatattttcttgcagatactataaaattttccattggccaaaagtaagaaatatagttttaatttgaaaattaaaagttttcaaattatcaacaaaaaatatatttctgcttaaatcggaaaacttttaattcctacttttttttgctgtatgcaaagtcgatcagctcaacgatagcgccttcaatttcttttctgccttcttcagttttcaggtcaatcccacagaacttacttgcgttgtatcctgtataaaggttgagataataagcaccggaaacaataagagccataattgccctgtgtcttgttgccacaccttctccgaagtaaggatccgagatatttccaaataggacctctcccacttcttcacgctgatcaaccagttttttaaggataggcttgctttcagaaagttcccaaagaataattttctgaagttccttatttttcttcaggttttcgaactgattaagcacaaccattttggtaagctcatgcccgccgtcagaaaagtccatatcaacatcctggttgacctggctccagtaatcctgcgatttgatatactcatcgatcagtttatcagtacttccgaagtactcatagatcagttttttatcaaatccggcaacggcagcgattttacttacttttaatccggaatatccttttactcttaaaattttaccaactgcagcaagcagtttctgttttgttttttctttgtccctaatggggccctgcactacttttctaggcataattattattttttcgcaatatgcaattttttattaatatcatcaaacgcattaagcgttttgtcgagatgttctttttcatgtcttgcagtaacactcatcctgatacgcgcatcttttcttggtacagccgggtaaagaatcgggttggtatagattcctttttctattagtagttttccggcttctcctgttacataagggtctcctatttttacaggaataatggcagagcaggttactccggtatccaatcccagatcatcaagaccttttttgaaatagttgatattattccagagtttttctctccagataggttcttcatcaattaaatcaatggctttaacgattcctgcggatgatggcggagctgtagctgagaagatctgctgacgggaatggaatctgatgaatgcagctatttttttatctgcaatgacatatcctccaagatttccaaatgttttgctgaatgtaccagtgataaggtctactttatccaataatccagcctgttccaaagtacctctccccgtttctccaaggatgccgacaccatgtacgtcgtccaccatcagaaaggcattgtacttttttaccagattatagatctcattaatacgggaagtatctccatcctgggaatacactccatctactacaacgagtttcgtacggtacagattttcagataccttcaaaatgtgttccaaagattccagattattgtgcggaaatgtttttttattggtaaaagcacatccttcgtgtacgctggcatgtactgccatatctaaaatagcaagatcttctttctgcattaagcattgtaaagtcgcactgttagcggtatacccggtagtgaatactacggcttcgtcttctgttcgtttaaaaaagcctgaaatctttttttctaaagcattatgatagtcaaaatatccaccgataagaggagtggctcctgtacctgtaccatatttttctattccttcaatagcagcctgctttacttttgggtgttgtgtaaatcccaaataatcacttgatacgaaactaacgaattctctgttgcggtctgcaatatttacattcagtactgcattggttcctgaagtattcttcagtctgtagttcatgtgcccgttagactttacatagtctaaatattcataaaaaatttcagccctttgagccatgtcattgtctggtatattctcaaagtctttgatagttgctgttgtgaaattgatgctcatccttaatcttgtttgttgtgtggttttaaaaaaaaacaaatatataattatttagagggcttaagctcccttcctaagattaaatattattaaaagcacaataatttattcttatgttctggaaaccaaactcaattgtatacctctgtttcttttaacatttttctttattgaattaattagttttttcttacctaaatttaataaaaaaagtaaacaataaagaaatattaatagataaataataaaaaaatgcaattattttttacaaccccctcatttataaaagattattttgcggtaattttaacaatataattcactaaattgtatttaaaacatcattacagcatgattaaatccctacctagagacaggaattgccgtaaattacctgctaaagcaattttaaagaaataaaataaatggattaagatttatttgattttctgaattccccaggagtctgtccggtcatttttttgaaaaacttggaaaaattggaagggtcataagtaaaaatgcgggcaatttccgcaacagatttattggaagtaataagcgtatttttggcctgctcaattattttttcatcatagaaagaacaaggatgctgtccggtttcctttttaacagtatcggtaagatgtttgtgagatacagcaagctctccggcaatttcgtttaattccataaattccggaacggtcccggagatgacctcctggatatgcttgtctaaaaaggtaaaatactgacgggtgatctcttcacttcttttcatcattgagggttcttcttaatctgtattcaaattataaaattaatcattagagacaaaacagcacggtgaacttttcggatatttaaagtcaacatttagtaaaaactatctttaaaagcctgtgtagaattcttcaccttcaacttttccagaatattctgacggtggcggcttacggtgttgacacttatagacaacatatctgcaatttccttgctggcatatccttcaccaacaaacttcagaacctccagctctctcgggctcagaatgcttttataatcaagcttatcttttacaaccacttctccttttatcatattcactatcataaaatcaggagcatcagacggagtcagagcaatattataaaggcataatgccagcctcaacctttcgttgtgaggtgaataaatataaaacattcggtgctttacccatctgtacttttcatttttatctttcatcctgatttttgaaagcacgctgtacgctgtacgtttcttcatttccatcgcatcaagtaatttgaaaaaacggagttcgtggatatattttttcagacggtcatccggatgtatctttttcagcatttcttcttcccagatggtttcaatttctgcaggattttcatctgtactaagtccaagttctgttgctgcttcagacttataaatataacttctattctcctgcatatcactcaatacacatattgcaccttccatctgagaataaacaagagctctctgcttatagatttctatatcaagcaggcatttttttgaagtgttatcaagtaatttatcgctaagttgttcacggatttccataatggttatttatcagtattgacgaaaatgtggtttaataatacttttgctaaaataataattacgtttagaacttatttcaaagagaatgaagaaattgattttaggtttttgcaccttattcctgactcaaaagttttccgcccagaccctggagaaaatgacatggtttaatgaacctgaaaaatgggaaatcaaaaacaacagtctttcaatgtttgtaactcctcaaagcgactattggagggtttcacattacggatttactgtagatgatgctcctttttattatacaacttatggcggcgaatttgaggcaaaagtaaaaataaccggaagctataaggccagatttgatcagatgggccttatgctgagaacagataaagagcattatatcaaagctggagttgagtttgtagatggaaaatataacctgagcactgcagtaactcacaataaaagtgactggagtgtcattacactggagaaaacacctcccgcagtatggatcaaagcagtaagaagattagatgctgttgagattttttattcttttgatgacaagaactatatcatgatgcgtaacgctcctcttcaggataatactcctgtaatggtcggattaatggcagcatgtcctgacggacaaggattcaatgcaacttttgaacactttaaagtaaaacatcttccggatcagcgtaggctgcagtggcttgaaacccatcaatagcgattgaattacacttcaatatacagtcaattttattcacctcccatcatttccgggaggtttttatttttataaagacaggtggcaggtgacaacaaaaagaggctgttgatgttattacagcctcttgtgtttttgagataaaaaccgtttgtgttcttagaatcattattgtgacaataaagcttctttagtcattatgagaatattttgcaaaaatatgaatatccatgagccttgacaaagatgtcatgtagaattaacctcagatttttgtcaaattattactacaaataacaattaaaaaaaacttaagtcgttattagtaaatgtgtaaaaaatatacagatttacaatatttgtcatttataaaattctaaaataaatttaaagtacggtacaccactgtgatttactaaaggattttaaaatgaatctgtcataaatttatcacttattattgaaataacataattctttcagaaaattttgagtaccacattaacagcaaaccgctatgcaacttacataaaacaggagataagatgctgatttatctccataatttcactatttttacacgatcaaaaaatataaaacacaaaagaccagaaaacttcaatgataaaaatttattctcaatcgttcctgccctttaaaaagactttgacttgtattaatactattattaaccatctattgcattagcagcagatacagataagtcttgcacatatatgaaaatctgggcatttatttttgcttgcatatatttaaacatttccggacagcgccacacttcttcgtggtacaacatagacaatgggcttccgcaaagcagtgcaaaggccattgtgaaggataaatatggctttatctggatctctacagaaaacggactggtacgctatgacggaacttcgtttattacttttaataatttcagggtaaataacctgcatttcggtgaattcatcggtgatccgctactcgacagtataacggttcttaataattttcaggagaataaaatcatcatcaaaaacaggtttccgaagcttgcaagcctaaccctggatgataaaataacctattccaaaggaggcagcattatacatcgcattgcgaataatatcattacatcggatttttataatgatgtacagtattttatccagcttaagaattctgtctatcattttacagacaaaaatgccattatctataaggaaggaaaaaaagaaataaaaatcatgctccccttttccaaccaggatctgaactatacttttgttttcaatgatactctttttattaatgacctgaaaaaaagaaaaacctattctatctacaaaggtcatctttccatttcttcgcaacctaccctttttaatcatccggatacaaaagtttactggcagcagatcaccaatcagactttcattatcaaccacaataatatttatatcgtagaaggtactgccagtgatcttcgcctgagatttcttgtaaaatatgaggaaatcggaaaccacccatattgtgcgatgttctacgataaggattttaataagttataccttggaacgcttaacaatggattaaatatagttaagctttccaatttttatatttcaaaaaaagaagctgatttttcgaataatgtctattacacctccctccccttcagtaagaatacgatcattagtgaagacggtacagaattcggaagaaatggcattgtaaataaacatcttttcggatacaatgataattatctgatgatgtatgacaattccggaaatattctgatcagaaagagaaacagtatcatcagattttataagaattcaggttataaaaagaaggattctgccctgttcagaaaaggacttcaatcttttatgaagagcggatatttctacgggactgcctttactcatccttcaggaacccagcttcacctttacaggaaagatatatttacacagccggattatacctttaattttaaaagtttcatcaatacattttatcagtacagtaaaaatgaaatcctgaccggaaacagcgacggtttgtattcagtaatgcttggaagcaataccataactcctttactgaaaaacatccatgttaaaagtattatcaggacaaaggataatctgatatggattactacgaataaaagcggattttatcttctcaggaaccacaagcttatcaagatgccgaacgacatcaacaattacctggaatcagcccattatattcttgaagaccaaaagggatattactggatttcttccaataatggtatgttcagggttcctaaaaagcagctgctgcgctacgcagacaacaaaaatactccggttttctattaccgcttcactaaaaaagatggctttctgacgaatgagtttaacggaagttcagaacctaatgcgtatgctcttgaaaacggggactttgtatttccgtcgatggatggttttgtgtttttcaatccggacagtatccggacttattatccggacagaaaaaaaatttatatagaaagggtaaaaatcggaaattccggaccgcagtatttccatcaggtatttgatttaaagaatgattataaaacggcagaggttttcattgacattccttacttttcaaatccgggaaatctttatattgaggccaggctatccggaaaagaagatactgaatgggaaaaagttgcaacaggaacggagctaaaatacaccatcagcaatctctctccgggagattacaccctgagtgtacgggtactggtttctcccgaagggcagtacgaagtaagaacaatacgtttcaaaatccagcctcttttttatcagacactgcttttcagagtttcagcttccatcattatcctgatcatcattattgttattgttcagttgacgaccaatttcctaaggataaaaaataaggctctgaagcagattgtgcataataaaaactccgagctgaaagaaacatcccttcacctggagctggtaaaaagcaatctgcagaaagaaacggaataccagaaaaagctggtagaaaccataagtcatgatattacaactccgatcaggttcattgccatgctttcgcaaaagcttcatgagtctgatgatgtggagcttcagaagaagtattttgacagtatttataaatcctcagagcagctgtatcagtttaccctgaatttaaaagaatacacggaactttataaggctgaaaatatctttgaggaaaaggaatatcctatcaacagaatcctggaaaccaagaacaggctattctgtgaaattgcaaaagaaaaaggaacaacgataaccaatcttgctgaacaaaaagtgtattccagggtcaatgaaagtattttaacagctattattcacaatataattgataatgctgtgaaaaacacctttgaagggaatataaccatggctattactgaaaaccagcaaaaatccataataaccattactgatacgggaacaggaatgtctgcagaacagattgatatttatatgaacctgttcagaaacccaagactggaaactcccagcttcaaaggaaaaggactgggacttcatatggtgattcacctggtgaaaaagatcaatgctgaaataagcttcagacaaaaccagcctcagggaacgattgtgaaaataacactcaataaaaactaacctctatgaatgaaagaattttaatcgctgatgatcattatgtagtaagagccggaacatctttggttcttgagactgcatatccgggactgaaaatagattttgcagaaaactatgaccaggtgaaaaagaagttggaaaatcaaaagtatgatcttctcattttagatattgacatgccgggaacccggtataaaaaaatggtccctgagcttaaaaacatacagaacgaccttaagatccttatcttttcaggatataacaaagatgtagccattcagtatatcagagaaggtgctgaaggatacctgaataagcaaagcagtgaagaagaaattaaaaatgcagtgaaaacagtgattgaaaaaggctatttctatcccgcagagctgattggcctcattattcaaaacaaaagaaataatcctgtagaaaagctgtcatccagagaatacgaaatcttcaaacttcttgcagatggaaacgggaaccttgaaatcgccaacaaacttaatattcagatgtctactgtaagtacttacaaaaaaagaatttttcaaaagcttgatgttaccaatattgcagagctgattaaggtttatgaaatgatgcattaaaaaagggggcggaacccttatcatattccagcccccgaaaaaacacaagtctcattagtttttaggctaatctctttgattttgtatatttttcaatcattgtatttttagaatcatcagacggtttatcagtacaacctctgcacagaaagaaacagttctcgtgtattatcagaagtattagaatctgtagttgtagcatcactgcttccggttgtagatttattatctacacgaaatgcataatatactctgtaccatctgggttccggttcctgtattgtaatgtcaaatgttacggtttcattatgggtctgagtaagataaacaccatcatcaaactgccggtaagctcctggtgataatttaatatttccattatcagagtcaccggtgtgagtagacatttctgaaacccagattttcacatctgatgttcctacattataaagccttggattaaaagtggtagcagctcctgtacctgctgaactgctgttaaattgagcatcaagtctcaggaaaccacctaaaaccggaagatcagtaagataagtactcgctaatgtattggcgccggaagtgcctgccggaatacttccatgataatagatcaaatctccaatggtaatatcatcatcttgtcctccaaacgcaaatttccaggtagtcccgttgaacatataataaccggctttgtcaacttttgctgtttttacagaaggaactgttacagcctgagttacatataccaaagctccggtctgagccgccagatagacattatctttagctcttaactgatcacctgtcatcctgggagccataactccatcagccgcagtagtcacatctggttttccttctacctgcaatgttacttttggagaatctgtattaataccaacctgggaataggctgcaagtgaaaagcacatcattatgccggaaagagttaattttattttcttcattttagtatatttgtttaaaaattattgatttattaaaaaagaaaaaaacttgcaggttaattgatagatcatcaataaccattaatgagctagctggtgcaaagttatctgcattaaacaatcaattttttgaataatcaatgaaaaaccggaaacggctcaacaaaacacaatacgttgcaaatcaaatatttaaaccagtcattttctgaaaactgactgtaataaatgctattgaatgatttaaaaaattatctccttccacaaatgaccgctacaaaagatatacaaattgaacaatacaaaagacagctggtttattattataatattctgatgtctgttattcttgccatatttggtttgatatttacttttattattccggataaaataatggcctggtatcttttcgggggactttttttacttgattatacttatctgattgttcgtaaaacctattcggtgaatgtaatggtgcattcgtatatcattattgcgacactttataatttttacattatgctggctttctggaacaattctatagcgagttttgtctggcttattcctattccgctggcagcctatgttttttttccaaggaaatatgtattcatttacagtctctttgttttgctgaatattgcggcaggatatcttatatcaaaaaatttcagctttgacttcccacagcacagtcaggatgatgtaagaattacagatacaattctgatggtttccaatgttgctgttatatcacttctgctcttttttaaggataaaataaagcgtgttgaaatttatcatgaaattgaaagcaagattcatactccggaaactcaaaccactccggcagcagaaaaaattccttttgcagatgagctgtttgaaaaaatagaatccgtaatgcaggaaaaacaactgtataaagatgtaaattttaatatttcaaagctttctacagtaatggatattaacagcagctatatatcaaaatcaatacgtgcaaaagggtatcccaatttcaacaattacctgaataggtacaggattgaatgtgtaaaaagacttcttcatgaaaatgatattgaaaaagttaccctgatgtatatttacaccgaggcaggattttccaaccaatctactttcaacagggtattcaaacagatggaaaacattactccatctgaatatatcagcaatttacaggtgcactgatttgtttcaccgataaaaatcattgaaacaataatttttaattccggaaaataatcaggaaatttacaggacttaattttctgtctaatccactgcattgtaattgcaaacactcatgaattcatctgaaaaagctcctcagggtagccggcgcctccgatacataaaactttgtattttcttttcaggactttcggtttttgcacagctttacctctttcagcccatgcttcctatggcagcagaacaatttggcgtatccgtaggtgatacttccctgcttgtctcttcttctacaataggtatggcattgggattattattttttgctttcaaagctgacagctattcgagaaaaagcctgatggtcttttcactggtttcatctgccattcttaccattatttctacctggattcctgctttaagccttctgattggtatcggggtgttgaaaggttttgttgtttccggagtttccgcagtggctttggcctatcttacagaggaggtgaatgctcttgcagtgcctgctgccattagtatgtatctcagcggcaatacgatcggaggaatgagcggaagaatattggccactttatttgccggtgaattcggatggcgtaatgctgtgctgcttatcggaatagaaagccttattctgggtgttatattctggaagctgttcccggagtcaaggtttttcaatcctcagaaaacggattatcacctgaaggtaaaacagatgaaatttttccttaccaacccttatatgcttcgtttgtactgtacagctgcattgttgatgggagtttttgtaagtgtttataattaccttacattcagactggaagcgcaaccattttcattaagtcattttatgattgcttttatctttctgatgtatattttcggagtcttcggaactatgattgtagggcgtctttccagaaggttcccgatgaatgatatccttaaaggttctatcctgtttatgcttacgggagccgcattactattatcagaaaatatttatatccttatcttcgggctcggcctttttactctttcattttttgcggcacatactatggccagccagatgacagctttgtatgccaaacgtggaaaatcttcagcaacttctatttactggcttttctattattttggttcaagcatactggggagcggtaccggttatattcttcatgctttttcctggaatattttcataggtatccttattctgtctgttatcattgcacttcttttaaccactgccaatgtgaatccaagggaaaaaacaaaaagctgataccacacagataccacattttattttttgataaaacgccataattcgcgtattggtgtactattttaacagattattaattttttgtagtaaaaatttaacctaatcttgcgtaaaataaccactggcaatgcaatgccgggcatactatttgatatttatcaaagagcatatcaccaccttaaaaaatcaaaatattatgaacgtagcagatctaaaaatcaagaacttagtcgagtacaaaaatcagatttatacgatcactgagatctttcagaatgtcgaccaggcttattttgttaaaattgaaaatgatattcagagtatttcggtcccggccgcttccatcaagcctatcagaataaccgaagaatggctagaaaagctgggattttcacggactgacagttcggatcagagtatacgatatgaaagaccggaagcatttataaaatatgatatcgacctgagctccagaaaaataatggaagggttgaaaatatacggaaatgccatcaagtgtaaatacatccatgagtttcagaatattttctcaagcttgtttggaaaagaaaccgctttacattatggctatctgaagacggaatcatagttaaatagttcttagttgaagaagaccacaatttacatggtaaattgtggtcttccttttttaatttcgctagctttaacagttcaaccataaaataaacggaattaaaaagtttgagaatttttcactttaaatcagagtccggggattctggtattttttaccctaatttacgcgctacccctcgaaattcatctccttcatactgcaactcatccatcattttcctcagttaatcatttaatgatttgattaatagcaaattaaacaaatattaaagtttctttgtgctctcaaaaaaaggaaacatgagaaaaaaatggataataatggcagccctaacacaggcagctcatactttcgctcagatagaaatcagatcagaatatctgccagagcaaaaatacattaatgacaatcgcgaaaagacagatggaaaaagttctgcttttacaacaacacttacagcaacgatcccgatagatgtaaaacctaccgcttatcatcagccgaggatatgggcaaccactatgaatgcttcctatacgtcattcagtaatagtggaactgctgcagaggtgttgccaaaagaaatagcatcagcagatctgggtgtcctttacatgactccacttcatgaaaaactgatgttaatcagcggcctttctgcaggtgtatattctaccaacagtgatcttaagaaattggcaacagatcagattgttgtgaatatccattcttctctcatctggcaggtgggtcccaaaataaaagtgggagcagctcttattgccaataatgcctttgataaacctatgctgattcccatgccatattttcagtatcacagtgaaaaaaagcaaggtatggaatatcatgctgaactgagctatatgcctaaattttctgtaggataccgctttaatgaagcatttgctttacgcattgtcaatcgtccaaagtttttctttgcattaactgaaattgatggtcagaagaaatattttgaccaccattacgtaagtctgggcatagaacctgagtataaaataaaaaaatggacattaaatggtacatttggagctaactttggacgtaccgaccgatatagagacaggcacccctcccaattcctgaagtggggaaatgctacttttgatccttcattttacatttctgccgggattaaatataactttgcaggaaaataaactaattttccaatttacagaaatgacaattcaatcgcattatcaacttttatcatcaacccaatattgaatatggatcttgctgaaattttcagagaccaggaaacaaaggctaaaaaatatgtgatcattctctattatttcatagtcacctctatttatactgtttaccagatctttttcttcaacaccattatgaaaagcagtattctgtcaaaagtcagcctgtgggataatttcctgctgcaatttgtcctgatataccctattgttctgatgatgaccttactggattatttactcataaggcttatcaatgagctcactcctatgcataccagtatgtacaggcatgcttcttcattatttgtaagtaatatccttctgtgtatccttttgtattttgctttcaactttattgttactgagatattcgatttaggaatcaggcaatcgctttcttataaatcaggtctcattcttaacatcaccgccaatcttcccattctgctggtgcttgatttattgttttatttccaggcagagcgtaaagccattaaagcgtctgaaaaggcaaaacatgacatgctgatgtaccagtataatgcgctgagagctcaggtaaacccacattttcttttcaattctctgaatgtattgtcttctctgatctatgaaaatcaggaacaggccaacaaatataccaaagccctgtcccaggtatacagacaagttctttctgtaggcagaaaaccactgaatacattacagaaagaaatgcatttctttcatcagtatctttttttaatggaaatcagatttgaaaacggttttgatattgaaatagctcccatggaacaatgggggaatcgtaaactggttgccttcagttttcagcttcttcttgaaaatgctttcaaacacaatataagttcagccgaagatcctttgcgaatccttatttctgccgatgagaacggaatatctttcagaaacagaatatctttgcgaaatgatatcaccagaggtgaaggaattggcctgtcttttctgaatactcagtacagccgctatcacaaaaagctggaaatcatgaaagagcaaaatgaatttatagtcaaaataccttttgtagaatgaaaaaatacctgattattgaggatgaacgccttgctttttctgaactgaagagaatgatggataagctccgtccggattatctgctgatgaaaagaacccagagcgttctggaatctgttgaatttcttcaggaacacagtccggactttattctgatggatatcagcctttcggacggaagctgttttgaaatattcaatcatattaaactggatgttcctattatttttacaacggcttatgatgaatatgcaatacaggctttcaaagtaaatagtatagattatcttctgaaacctatttctgaagaagatctggaacaggctgttataaaacttgaagatctgcatttcgacaaagtgcaaaaggaaacaggcatccggatggtggaatctttactgatgaaaaagataaaaaacagatttctggtacattcccgtgatggatatctgtatatagagtccggaaatgttgcttatttctacagtgaagaaaaagtggtcatgcttcatacctttgagaataaaaggtatattgtgaattatactctggatcaactggaagaacagcttggagaagactttttcttcagggtctcccgcaactgtattgctaacattaaatcaattaaaggcataaaaaaagcagccaacagcagattagatattgaatttgaacctccctgtccccatgaagtaattgtaagccgtgtaagagtccagaactttcttcaatggctgaatgatgattaaaataaaggatttttctgctgttcattccgtatttttacagtacacttaatgatccgttatgcaagaagttattgtttatcaaatcgattcttttaccaaagaaaagttcaaaggaaatccggctggagttgtgttaaatgctgagcatatgacgtctgaagaaatgcagctcattgccagggaactaaataattctgaaaccgcatttgttttcaaatctgcgcatcccgcagaagattttgattatcacatccggtattttacgcctactacagaagtgccttcctgcgggcatgccactattgcggccctttatgcaaaagcacaggaagatcatctggattcctgtaccgtcagaatccatacacaaattggcatattaccggtttatattgaaaggaaaaacaatgattatctcattaccatgacccaggggaaatttgagctgagccctgcttttgatcctgcaataactcaaaaaattgtactggcactgggactgacaatggatgaccttgacgaaaaatgtcccatacaaattgcgtcaacaggccattcaaaagtaatgatcggtattaaaagcaatataattttaaatcatctggctcctgatcttactgctttggcaaaacttagtaaggaaattggctgtaacggatattttgtatttactttcgataccaatgaaaaagaaatattaaccaacggaagaatgtttgcacctgccatcgggattgctgaagatccggttacaggaaatgccaacgggccacttggaggctatcttattcaaaataagatcgtagagacttctgatgacatttttgaatttaccggaaaacagggtgaagccatcaacagggttggtaaagtgaaagtaagtgtcaatatcaaagatggtaagcctgactcagtcagtattaccggaaatgcagtatgtgttttcagaacaaccatggatttacattaactttcatattatagtaaaatttgtccccacaggagaatatcagtcgtcattaaggtgaatcaaaaaaaattgaatacaatgaaagaattcttattagtctttcgtgcagactacaagtccatgcctaagacatcaccggaacaaatgcaggccaatacccagaaatggatgaactggattgccggaatcgctgctcagaataaactggcagacagaggcaatcgtctggaaagcacaggaaaaattttaaagtcagacggcctgattgctgatgggccttatgctgagattaaagaatcaattatgggctatactctgatcaatgcagaatctgtagaagaggctacagcgttatgtaaggaatgtcctatcctgctattgggtggaagtgtagaaataagagagatcagcaaactgtagtattattttacaaactcaaaagcgcagaacattgttgcttgatttcattttcattgcgtttttgagttttcgaaacaaaatacaattaccttagatatgcctttttatgactcatggtaaatccgaatgaaataacaccgcatttattcaggaccgagtacagcaaaatcgttgcagtgctttgcaggagctttgatatcagacatattgaaattgcagaagatattgccagcgacacctttctgaaagcttcagaatattgggcactgaacggaattcctgataatccttcagcctggctttacaccgtggcaaagaataaagcaaaggattatttcaaacacctttccgttgttgaaaaaaacaaacaagaagaaataaaggccgttgaaaacaactatcagaaaatcgattttgataccaaaaatatttctgacagtcagctggaaatgatttttgcgacctgcaaccctgtcaattcccaggaaacccagatatgcctggcccttcagattctttgtggctttagtatagaagaaattgccaatgcttttttgtccaaaccggaaaccataaaaaaacgtctgcaacgaggccgggaaacactcaggaaacatcattttacaatagattatttaaatgagaaggatattcatcagcgcctggaaacggtattaactactttatatttattgtttaatgaaggatatttctcaagaagccataatcttttaatccgtaaagacctttgtctggaagcgatgagactcacgttgattctcacagaccatccattcaccaatactccaaaagccaacgccttgctggctctgatgtgttttcaaagctcaaggctcgacgcaagggttaatgataaaggtgaagccattctttttgatgaacaggacgaaacgttatgggataaagctttaatagaaaaaggaaattattgcctgatagaggcttgccagagtaataactcttctgtatcaaaatatcatctcgaggctggtattgcttattggcatacttcatcggctgaagataaatggcagcagattttaaacctctacaatcagcttgttgttattgaatactcgcctgttaccgctttaaaccggacttttgctttttcaaaagtctatggaaatcaaaaagcaatcattgaagcagaaaaacttaacctcatcaccagcgaatattatcatggattaatgggctatttatatagtgaaattaacataggtaaagctattcaccattatggggaagccatccgtctgacaaaatcaaaacctgaaaagcagaccttacagaaacagattgatcttttatcttcaaaataaaaagcctcctgatcaatattcaagaggctttctataattatttaacatctgcagttattgagaataattctctttcacgatgagatgaagattgatcagtgcttgtctgttgatctgaacaacatcacagtttttaattttatacttcttctgcaggagtttttcattacaataaaccgcattaatatctagtaattgattcaattgggaagatgaaaggcctaaacattttcttataactgttgaaacctttacattgaaatcaaaaggatatttcatttgaaatgaaatcatttcatttttcatatttgtcaggtcttcaacagaaagatcatcacggataatttcatattctacactttccggatctgtttccacattatttttccttattgtttccagtgaaaatgcatacgtccaggctgtttccaaattattttctgaaaacttatcaaacagatttttgctgatggattcggtccttattcttgaaaatacattcatgttataggtgttgttacatgttacacatcggtaaatcaaccatatatcaatattctttttctgagcattcagtctgaatttgtcactgcattgaaatctgtcgctgttacaatgattgcatttcttttttagtaagggagtattctttgcttttacctcccatatatgttttgtactcattacttatagttgtgcttaatattctttgtaggatttttcccatattattcacacactgcagtaaacttgagatacatctgattttacccagaacttatttaaggttgtttgctgtatattcgtcattattacagacaaatacagacacagctgcttttacaggcattgcaataaataatgtgatgaaatgaaaacctgttcaggtagaattacccaaacgaaagaacgatcagcctgtggttactgagactgatactaagcgataataagtttaagagttgttctcaaaacaagttgtttacttggttatgataaaagtagttaattttattgaagaacagtgtgtttttacatgtaatttcaggcagggaaatttgcaccatattttagggttaaaaaatgagccatacaacaaacaaaaattgaaccttacaacaaacctgtcttttctttttctgacgaactttggggtattaaaatcatcaaaatgaatcagattaataaaatttacatcaatggcgaatttgttacgccaaaaggaacagaaacttttgatcttataagtccggttaccaatcaaaaaacaggcgaagtagttctcggaaatgaggaagacacccgaatggccatcgcagccgcgaaaaaagcttttaaaacattttcaaaaacaacaaaagaagaacgcattggttttcttaaaaagctgcatgaagcggtaaataaacgggaagacgaacttgtttctgtcatggtcaatgaatacggaggaacattacaattttgcagaatgagcgttcagaatgcaatctctgcctttacaactacgatcaagaccttagaatcttatgatttcgaaagaacagccggacattctaaagtgcgttttgaatccctgggtgtagtaggaatcatcacaccctggaatgccagcaacagctttatctgcaacaaactggcaaccgccattgctgccggatgtaccgccgttataaaacccagtgaaatgagtgctgcccaaacccagctgctgacagaatgcttccatgaagccggtttacctgaaggggtattcaacatcgttaacggattaggaaacgttgttggagcagaaattactcagcatcctgatatcgctaaaatctccttcaccggatctaccttaaccggaaaagcgattgccaaaggcgctgtagacaccatgaaaagagtgactctggaactgggaggaaagtctcccaatattatccttgaagatgcggattttgacaaagctattcctatggcggttttcggagcttatatgaacaacgggcaggcatgtattgcccctacccgattgcttgtccctcagaacaggctggatgaggtaaatgaactggctaaaaaagctgcagaacaggtaaaagttggaaaacctgatgaagaggatacgcttgtaggaccaatggtaagtgtcagacaatttgaacgcgtacaaaattatatccgtctgggacaggaagaaggtgcaactctgctggcaggtggtgaaggtaaaccgcagggtcttgaagacggtaactttgtaaaggcaaccatttttaccaacgtacacaacgatatgcgtattgctcaggaagaaatctttggtcctgtattatctattattccttatgctgatgaagaggaagcaattgctattgccaatgacactaattatggtctggctgcttatatcagctcttctgatcaggagcatgcagaacgtgtagcagcccggattgatgccggaagaatctgtatcaatggattttcacatgatccttatgcacctttcggtggttttaagcaaagcgggataggacgtgaatacggggtattcggattggaagcttatctggaaccaaaggctgttattgtataaaaaaatatattcatcacagtacaatgttccaggagcattctgctgtgatgatgctgaaaagttttgtaagtttgaaaaaaagaactgagcaagaaataacacgttgagccatgagtgaacataatattccttttccaataaactattcctgtcatttttcagaattcagggaaggagaacagttttcccggattcacagtctggggcttgttctttccggagaaatggaactgaatgatgggagcacgaaaacgatattcaaagaaggcgaactttattccgcaagaaaaaaccgtttggtgaagtttgcaaaatatcctccaaaagatggcgaaatcaaaactgtaaccctctattttgatgaagcgctcttacgggatttcagccgcgaatatggatatcaggcggagaaaaaagaaaatgtacccgcctatataaaacccagtcaaaaggcattaacttcatttatgtattcattgcttgcctatgaggaattaccttcatctgaagaactgctgcgtctcaaacaaaaggaagcattacttctgatgctgaattacgaccccggtcttaaagatgttttatttgatttctcagagcctcataaaattgatattgaatcttttatgaataaaaattttcacttcaatgtcaatgtagaacgtttcgcctatttaacaggaagaagtttatctgcttttaaaagagattttcagaaaatattcggtattcctccgagacaatggttacagcaccggagattaaaggaagctcattttctgctgacccaaaaaggaagatcggtttctgatatttatctggatctgggatttgaaaatttatcccatttttcttttgcctttaaaaagcagtttggctatcctccaagttcattacagacaaaatagaataaaaaattgatcaggatattacatttaatccagattttaacccttaaatatcagatcgtgtcatgaaaatcataacacgatctgatttgaatctaattattgtaagttttttaaagtgcgtattctacagaagcctctttagcagctgctaccattgctatcagagctttttcagtttcttcccaatgccttgttttaagtccgcagtccggatttacccaaagctggccggcaggaattacattctgggcttttctcagcagctcaatcatttcttcttttgacggaacccttggtgaatggatatcgtataccccaggacctatttcattaggatatttaaagtctgcaaaagcgttcagaagctccatctgggaacgggaacattctatcgtaatcacatctgcatccatatcagcaatattttcaataatatcattgaactcagaatagcacatatgcgtatggatctgggtagcatcctctactccacctgctgaaatcctgaaggcttccactgcccatttcagatagttctgccagtcggtttttcttaacggaaggccttctcttatcgcaggttcatcaatctgaataattctgattcctgctttttccagatccaccacttcatcacggatcgccaatgcaatctgtttacatgtttccgaacgtggctgatcatcacgaacgaaagaccactgtaaaatcgtaacaggacctgtaagcattccttttacccatttcccagtctgggattgtgcatactgggaccagtaaaccgtcatcggagttgggcgggaaacgtcaccgaagattacaggaggctttacacaacggcttccgtaactctgtacccatccgtttttagtgaatacaaaacctttcagctgttctccgaaatactctaccatatcattacgctcaaattctccgtgaaccagcacatcaatcccgatgtcttcctgccagcggattgttcgctgcgtttcttcttttagtaatgtgtcatattgttcagccgtcagttctccttttttgaattttgctctccagcttctgacttctgcagtctgcggaaacgacccgatagttgttgtcgggaataaaggaagctgcaatactttttgctgctgttctttacggattctgaaggtattgattctttgggcgtcttttttagtaaccgcatttgccctctgcttcacctgatcattatggataagaggagaagttcttctgctctcaattgcttttttattttcttcaaatgcttcaggaatctgtttactttccgtttctgacgccagttctttaagcgttactatttccgctactttctgtttggcaaaagccagccagtttttaatttcaggattaagactggtttcaaaatcaagatcacaaggggaatgcagcagtgagcaggatggtgcaattaaaattctttcagaacctaattgattcactgctttttttatcagagacaaagacttttcataatcatttttccagatatttcttccgtcaaccactcctaatgacagacttaggctttcaggaataacgtccagaatatcatccagctgttcaggatttcttacgagatctatgtgcagcacattcacaggaagtgagacagccaaagatgcattatcttttaatccttcaaaataagtggcaataataaatttcagttttggaaaacgtttccttatttcagcatatacaaaatgatatgtttcttttgccttctctgttaaatccaatgccaaaaaaggttcatcaaactgaatccattttgcgccctgatcctgaagtttggttaaaatctccgagtatacggaaagaagatttccggccagatccagcttatcaaatccttcttctttttcttttcctaacaacagataagaaaccagcccgataatcaccggcttggcattgatcccagcctgctttgctcctgcaaattcattgaaaattttgtctgagcttagtttaaactgctggtttttataaaattcaggaacaatataatggtaattggtatcgaaccatttggtcatttccatcgctgtaatatccagtccttctttctgatatcctcttgccatggcaaaataaagatccaactcagaattattctttttaaggactatttcatggtaacgtgacgggattgcgcctaccacaaggctcatatccagaacctgatcatagtatgagaaatcattacacgggataagatctatccctgcttctttctgaatattccagttttgattgcagatatttctgcctgtattcagaagttcttccggaaggattttacctgaccaatactgctcgcaggcttttttgagttctcttttgctaccaatacgcgggtagcccagaatgtgagtttgcattttttaaacttttatattaaaacttgatgtaaagtctttttaaatgcttcttaatgcttaaacaaatagaaatttcaggaaaaatggtatagcagacactacagcttcccacaagagaaaatgtacttgtctgatatatcatctgtatgacccaaagcttcagaccgcgaaagcattgtcaattcagtaaaggcaggtctcctgacttgtaacagtttccgtcatccttcccgcttttagcagtggatatgcaaggacagaaacctttggtatgttacttacagttgcgcgacagctcgtgatttgcacacgattccctattaatttacgttaagtaaaaccttttctgtttgatgaagtatctctaaagaactatacttttactttcaacaactgtcttctgtaaaagtttttaattttgggtaaaaataataatacagaataaagttttagctaaaacaaaataattaagcaaataaaactttataagttataattaaaagcatattatcctgtatatttgactgtttttataattttaaagaataatattctgtggaacaactcgatgataaggatttacagctgctcaggctgctccagaaaaacgccaaactgaccgtaaaagaacttgccaaggaagtaaacctctccgcttctccggtttttgaacggataaaaaggctggaacaggaaggcttcgttaaaagatatgctgccgttcttgatgctgaaaagctcaaccgtggttttaccgttttctgtcagatcaagctgaaaattcatgacagatcagtcggctatgattttgtaaaagaaattctggaaatagaagaagttgccgaatgctataatatttcgggggattttgattttcttctgaaggtacaggtaagagatatgaagcattatcaggattttgtattcaataaactgggctctgtagattctataggaagtacccacagcacttttgtgatggctgaggtaaaaaacaaccatggattgacaatataaactttattaaagttcacattacaaataaaaatccgtcattatttgacggattttgtaatattttttgtggctcagattaattcactgccggattgataagttctgttgttaaacttaatgattttaacaggcttttactgtcgaactgcaatgtaacataatgtttaccttttttgaaaacaagttttgatcctccggggaattcgcttcctgctcccattttctgcgtctttgcaccgtatttactgaactttgttttacaatcctgcaatgtacttttgttcatgataagaccgaaaggaagtccttctactaccacaggtctgttgtctgaagtaacgaaaaacatttcattaactgtatgatcctttcccgggctggtatacatttcaagccctgtcttcattggccatttcacatatttttcttcattggcatcttcataaaaaactggctttatattcaatgctcttgagattttatcggttgtctgcgggaaaataaattctgaattgctgtctaataaagaatttaaagcttctgttttctgggaaaatgcagttacactaaatgccagaaaaaagatggttacaatgaaggtaaaagttgtcgttttcatagattattaaaaatgattcgatggctaaaggtattaaaattatacaattcagtatatacctgctatgaagaaactcaaatttcctgatgttgctgtaaattaaaaaccgttcctgccggatcagtaatccagtgcatattttcagggagcgattcaatttcatcacaggtttccacaccgtttgaccgtaaatattgtgttgctgcttctacatcaggaaccgtaagctgtaaccaggtttcagagtgggtgtaattgtctacacagtctaaccagatcacattattcccgaattgtacttcatgagtccttgaaacggtaggattactgatcggcttctcctctacttccagttttaaaatatctttataaaaagcaacggttttttcatatttacttttaggaatttttatggcgatattaattcctgcctgaaatttcggattcatcatcaaactattttaaaaaattattcagatagttcagaattgttgcggtctgcatcatcacagtgacatggctttgtcccggaacaattgccagttgagatttcggcatagctcccatatcagcagaaactccgcctcctaataacttataggtttttgaaagctcggttttatccagtccatcgttatcaccagcaatgattaaaacgggtaccggaattttagaaatattatcatcccccagatcaaaaggctttccggctgaggctatcatttgctccaggaattttgtccattttgttttatcgggtgctacagcgttataggcggtatgcaagggactgtttgtaaataaatcaggtttcattccttcaaatgctttattgacttccggcagccagccactgcttttataggttgatgaaataattaccagattatttaatctttccgggctctgtattgccagctggtaagctacttccccaccaaaactatatcctgccacatcagccttatcaattttcaggtagtccattatctttgtaacatcactggccaaaacagcgtgtgataatttacgttccgagaacggcgtgtgtccatgcccctgaagttcaacggcaattacttttctggttttagacagttcaggaatcagctctccccaattcatatcaatggtcataaaagcaccatgcagcagtacaagaggctttccattaccatatacttcataatacaccttgataccgttaacgggcgcataaccgctttccgatggttttactttttgtgcggataccatacatgtagcggacaaaacaattatcatcaacaatgattttaacaagacggagaatttgaatatacttttcataataagagtgaatttgataattaaaggtattcaaaattagcaagtccttatgaaacccaacttgccacaagacaagatttattatgcatgatcattctttatttactcattcaataggtaatttggcactggcaacagatattatattttatttattttcagaagattaaaagcaaattattatatataatattgattgaatgtaaatattttcacaataattctacaacagttgataaaaaattactaatttcgaaaagtactaaatctaaattattatgaaaaatttaaagaaaatcgaaagacaggaattgaaaacaattaaaggaggtattgactgcagaggtggccagttatgcttaattggtggtaaatggcaatgtatgccatacgacggatgcggcggtggaaaccagccttaattagtttaaaacaattacttgactatgaaaaattctaaaaaaatcacaagagaacagttgaaaagtatcaacggaggagctttaagctgctccgaagcatgctgcccgccaccagggatcaaaagatgtccatgggtagtctgtgtagcaccatgtgagatattaagttaaaaaccggattctccagataaggcctgcaatttgtataaattgcaggcttttatttttttacatatttccaatcagccttcagtatttttagtataaaaaacattgaaatattcccgataagccctctgaagatcaagttattttatatacatttatataagtgtttaaatcaagcttcaaagtaggtactgcatatcacatctactctactttgatttgatttacaggttcatttatctgatttatacattttattataggacagattaaccatttttattgaggcttattttatgtacgttataacagaccaattaaaaaatttaggattcagcatcaacacattgaataatgtaatacaaagaaataataataaaagaagttttaatacactggagtacttctgtatttatattatgatagaagacatcacattggagatagaaaacattccgtacttcataaaaggtggccatattgcatttttaggacctcagaaacagattgtatttggtgaaaccaaacgtggtgaagtttatcttatcacattttcttccagtttttatgaaagatctgcaaaagacagtatgtttctcaattcaagactcttttttaattatgattctgatgttttcatagcacctttcgaaaatataaaagaaatgaacattgtatttatgggaagaatgcacagttttcagcataaagacgagagtctttatatttcagcggcccataatgctattgaaagactgattctggatgcatttctccatattcctgcagaaacactgaaaaaagatgtaaaacttgattaccttcattacgtcaaccggtttaaaatccttttgcagcgtgactacaaaaaagccaagaaggtttcctactacgccaatgagctgaatatcaccccaagaaaattaacggagatgactgaatatgttctgggaaaaagtgctaaacatattattattgaaaaactcattaatgaatgtaaaaaatcgcttagcttctctggatacaacatttctgaaaccgcttatgagctgggattcagtgatgaaggaaattttagtaattttattaaaaaacatacaggaaaaaatccctcagaaatgaaataatataaaaataatattgtatttttggataaataacaaataagtgaaaaattcatatatggggataagatgtattttttcagtagtattcttttttgtttccgtaaacatttttgctcaggcagatgatgttcagataaatgtgaggctctaccccacacaaatgcttgctgttggaggtgacagtgaaatggttgatgaaacgaatgaaactgcccagccggaaattaattctgtaaccatttcaagtccgtccggttttcagttaggaattcagcaggatgaaaatgaagagtataatcttatcaaaagtcatcatggggttatagaaaaaaaattcatcataaatcaaaaaatacataaaattataaaacagtttaaagataagtccacttttatgatgttaactttaatctctcaataagccgatctggagcagattctctatgcattagatattatttttttaatttttgatgatttatttttagtaaattcataataatataatattcgtttaacaacattaacaagttttttaatttttaattaactgaaatcatcatatttctttataaaatacaatttattatcaagtttttttccaaaaccaaatttacaaatctttagtactttttcacaaaatgagtacctgtagctctgtctaaatttgcacctgaaaaaaaacaagaattaatacactaataaaaactcctgttattttatgaagaaatatatcgtagcctccacgttactatttggttttgttgcattaaaggctcaacaaaccgtaactttaaatgttagactgaagcctatccaaacccttatcgttaatccatctcaaaatgtagttaacttagactataaaaccaaaaatgactacgcagacggggtatcttccttaaatgctgaccatttaagcatttatagtaccggtggtttccaggttaaagtgaaaagtgcgggttcagctttaaaaagcggtgctaaaaatatcgatgccaatactattctgatcaaagccagtgcaggaactgatggagtagacggagctcagtatgcacaaaacgtacagctttcagctactgaagcaacattggtaacatctgcaaatggtggtgtagataaaaaaatcaacatcgaatacaaaggtgcaggtgcgaatgcttatcttaacaattacatcgcaggtcaggatcctactgtttatacaacagaactaacgtatactattatttcacaataagtatttagatattataaaattatatggataaagtgttacagattgtagcactttatctgtactttaacagcaaattataataatgagccgttcctacatcatctttttattttctttatttctattgtgcaccaagactaaggctcagacgggagtatctgtatctcctccaagactttatttcgaatctgacgcaggaaaaagtaccacccaaaaagtaacggtaacaaatgtaagtgcaaaaaattctcttgacatggctgtcagcctgggagactgggagtacaacggaacaggagaaaacaaaatgtctcctgccaatacactgcctacatcctgtgcaagctgggtgaccataaaaaatgaagacacttattttaccttagacccgggggaaagaaaagatattgatgtaactattactccacctaatgcattaacagatcagctgttagctcatactgctgtcctttatgtcagccagatgaatcctgtgaatgatgtggacaataaaggagccaatataaaagtaagcatccgttcaggaattaaacttttccataaattgacggccaaagccactaaaaaaattgaaatccagaatcttacattagcccagtcaaaaaaagaccttactcttttatttgaaaatcagggtaatatctgggcagatggaaaaatacagacagagcttatcaacacagaaaacggtaataaggtatcacttgaccagattattttctataccatgccgggaaacaagagagaggtaaatattccgcttcctgcaacactttcgaagggaaaatatactgcatcggtaatgattgattatggcgacaacaataacctggagttggcggaactgaattttacctatgaataaaatattatgttttctcttatttctgatctccatgagctgtttttcacaagtttcgtatagctcatgggtaaacagttatctgcagattaattcttataacggcaataccaatcctgatgcatataatcttactctggcaggaaatggcaatatcaatataccctactggagagtttctgtacgattgaagcagcctattacatcaaacaacgggaattacatattaccagctaataaaatttcgtttcaaccggtttcatcgtcaggaaaagcttatcccaacccagttcccactattccgcaaattggcatgccacttaatgtgatcctgaaggaagggcaagaagtatttcttattccgcagtccaatgcggcgttgtttaatcagcctgctcagcccaatggttattacagccttcagatcaaatacagcatcaatctggcaggagggtcatatctgggagcatatcctgcatggatcacttttacagctccgttacagtttacggcttatgatcagtacaataatattctcggtaccgtggttcataattttcagtttcagatcggctcgctttcaggaactcccacagatgttccggagctatctatgaagttcggcgcttctgcaatgaatggtattctggaatttaaaaatatgcaggattatgtcaacggggccagtgttacttactctaatgcacttattgtaaaaagcaatacgaattatcagatcaaagtaaaatcgcttcagagccagttcagtgcttcttccggcagttttcttcctcttgatgctgtaaaacttaatctgataccggtttcaggcaacatgggaactgcaaatacgattttactgagtacagcaccacaacttattgctaacggtggttccacgcaaaattctgacgtttattatgacatgcggtattctaccaaacctaatgatgaaaggttcatcaatgctaaatcagaagattatactacaaccattcaattcgagattacgcctcaataatttataatgcttcacaacaagctgttcaggaaaataatactttttttgttgatcccgttttgtatttgggtttcagctcaggctaatgctgatgcagctatcagcatggaaatccgcaatgaacagaattcagctaatccgaacattatagatgtactgcttgttttgaaaaacaatgaaagcaaccattttaaaggcagggttgaagtaaacacccccactggtttcagaaccatttctgacagcaatcctgaaattgaactgaatgccggccagcaactttttattcccttaaaaatactgaagaatgctacaatagtttcaggtaaagcagatctgatcttcaccattactgatgaaaaaaaacatcaggtggtaaaaaaaagtttgtcatatacagtgacagagaataacaacatgaggataaccgctgaaaatcctgttgtctacatgggaacgtataaagattctctggaaatccgggcaagagtttccaatttgggaaataaaaaacagaatgttaccattgtatttaagattccggaagcgacccagaaaaatctgtttattgaaaaaaagggaacgatcaatgttcagaaagattctgtatttgttttccggtttgttccttcaggcaatctgctcagaagttctcagtttacggtgaatattgccggcttcagagaaccggacaaggaaatcttcgggaatacttccgtattggtacaaaatgtttcttctacgcagcgttatcaggacgctgaatttgatctgttttcaaattacagtaaaaatactattaccgccagttacagacgtattggcaacaatacagatatgtatcagcttattgggtcaggtggttttaatctcccctcaggttatatgtttatccgtggtaacatttataccttgaacaatcaaagtgatcccgtggtgaacaatacttacctgacttatcgcagggaaaaaagtgaatttactttggggaatatcagtaagcttatggaagtttcactattcggaagaggggcagaatatgcatatacttcttctgataaggataaaaaaatagaagttggttttgtagatcagagcttcagccttattgaaagaaattcttttctgaaatacggatatggattttatgccagaggaattaccggggctcagaatgcttcgaaaaatttttctgcaacctatattttcaaaaatgatccttatgaaaaggctaatcatcatgtattaggtacggatattcagtatgctttcaataatttctggaaaatgaattccaaggtatacagcggactaagcttttatgaaaatacccatctcacccagccttctctggctttagaggcacaatattccggaaatatcaataaaatcaatctgaacggaaattatttctacagcagtgattattatcccggaaacagaagaggaatagtgcaaatacagcagaatttttcaaccagcatttttaaaaaccattctttatatgcgaatgtaatgatctctaatttttcgccgaaattttactcctacaattatgatatcagatcatacacgacaagaggagatatcggaatcaactttgcaaaaaggaagaatttcggattttctgcaggtgcacaatatcaagaggaaagctccaatacctataataattttctggatacttcaggaaatcaggaaatccagaagctgaaagcattcagagtcactcaaaatataacctgggcgagcaacaacaaaaagcattcttcattactggcactggaaacgggatccgtacaatacccttcatctgataatgctcagcttcagatgaaagctacaggaaactacagttataaatggttcaatataaacgggatataccaatatggcagctattatctctctgaatttgcttcatcaagaatcttcagtaaagacattatttataaaaagttttcagtctctgcttttatcaacaaaaatctcctgagtgaaaagcttactgtcacttcgggattatcctatactgatgatattttatatggtaaatctccttcaggatttgtcaacctaaaatatgcaaaagaaagatatggagtattccttaactcttcctggtacaattactcttccggcaacttcagcaataacctcttcactgttgaagcaggcgtaactcttaatttgcaacccaacagactggacgccagcaaaaaaggagaaatatcagcctttgtttattatgacaacaaccataacgacatttatgacgaaggtgatcaaagtgctgaaaattacatcattatgatcaataatatttctttcaggacaaatagtgaaggtaaaattatttacaaagcaattccgtatggcaagtatatgctgaaacaggtgattcagcagggatggtattaccaggattctgaatttgaagtgaagaaacacagctatttccttcaggttccgctgcaccagaacggaacaattctgggtaaaatcaattatgaatttgatcctaaaaaagcattggaattcgaatctaaaacggcaggaattattttcaatatttatgatggagaccatttactacagcgcgttgttactgatgacagcggtgaattcggttctttccttcgatccggtaattacactgttcagcttgtggaaagctcgttacctgccaatacatactgtgaaaaaataagtcagaatattaccgttcaggcaggaaaattgatgaatcttgagccgtttaccattaaagtatcggagaaaagggtacatgtcaagaaatttggaaactaaagaaaaagcagggttcacggacactcaaacatgataaaattctttgcatgtggaaccaaaaattgtttaaaaaaaacgctgtaaacatttaatgtttacagcgttttagtttattttggttttttacctggcggagagtgagggattttgtacccatttctcatcgccttatggataagattttcgctgtagcatctctgtgaatggcctcaaataggacatttgcaaaaaagtggtaaaatcctaatttaaatcttacgtagtaaaactaaaaatttctgctgaaatctgcaagtaaaaaagtccaaaacttgaacagatttttttagaattcaagccaagaatttatccttctctttggcctgaaatttctcagttgaattatttctaaaagaaaacgaagaaaaaaattttaaaaaaaagaaaaaagaaagccttttgaaaataagcgtggcattctgtcaaggttttttggaaaaagtttttgcgtagattttatacgtaaaaagtttttctgaaatccggagggcttgaccttgacagaatttaagctggtgggctcggtagcgaattatctttggcttctgtttttatttttagtttatgattgtattatctcattctttcttaataatgagaataaattgcatactatcaattgattattacttctaaatgttttaaaaactctttacatttataaaaatcgtaataagaattctttaatatttcaatttgaaattttagaggtaaaaatttaccatatttcgaaaaatccagaatctcaggagtattctccagaagattttctaaaatgaaatcgaaattaatattggatgattctatgctttttaattttaatataaattcttcttgggaagtttttatctcaaaagaagaatccaagtcgaagtaaatattttgaatacctaaaatgtcaaaaataagtttaagcgttctgtttatttttgagccagtaaaagagtaaaatataagatttttattggttgaaagtaatggtcgttccttgaaaatatctgcaaaatcaaagattgaaaattctttctgtatttccgatataacatcctgacttggttcatcaagaaaatcatattcttttttagaaattagcacttccagcattttttctctgattttgtctgcgatattggctccgttgccctcaaagactggtttcttaccatcttttgcaggaattacttctattttctttgattttaagtcaattgctatgattttccagattcttgcagataagtaaatattttcatcttctctaatctgtagggttagtggaatttctcctactttatttcctttatgagatactttgaataaattttcggtttgaaaaacgctgtaaaactctctgttgttaacaattttctctccctcaattcctaaaatcaattctgaaccaagttgttcaagaagatctttctcaactaaaaattcaatgatttcttcgatttcattttctgatatatttttgaaagcacagttatgatgtaattcactcagcaatttttcttttgacattccagaactgccttttatgatagaaagcatttgatgaagcaaaatatcataaggcttttcattcaaagaaaccggctcaatatacttctcatcatataaaagccaacatgcaactgattgtaatagtgtccaacgattagtagcatacaaaaacaaattacttgctttgtcatctcttcgtccacttcttcctactctctggattaatgaagcaatgctatgtgtagcatcaatctgaacgacttggtccacacttccaatatcaattcctaattccaatgtggaagtacacgcgatactaaagttttcatatgtgttattctttgcaaagaattctacatattcccgcacttccttatctacggaagaatgatgggaaaagtaattttggtgtcctccaactttatcagaaatctttctcaatttcacggcaacttcctcaactcttcccctggcatttggaaaaatcaatgatttgctatttcttgtctggatatataaatcttttaataattcgagaggcagttctgcaccgctgccttcaaaatatctgaagactgcattaataggtttggggtttgtatcccgtatgatttttgtgctctcaacgtctccgaggaaacttttcagttctaaatattggttagaatcactgacggttgcagaaagtgctatcgttttgaatctggttttatttattttttgtaaacgtgataaaatagattgcaattgaacgcctctgtcggaacctaaaaaagagtgaacttcatcaattactacatattctaatgaagcaaacaaatgttttacgttataggatttattaacaaacattgcttccaaagattccggtgtaatcagaacgattccgttcggatttttcagcagtttatctttctgacttttgctcgcctcgccgtgccatttggttacactgatgtccaaatattcacacaattcttcaacacgtcgaaactggtcattaatcaaagcaatcaatggagaaatgtaaagaactttcacaccctcttctctaaaatcggttcttgataaaataggtagaaacgcagcttccgtttttccggaagctgttctggaaattaacacataattattctcagtcgataatattctttgaatggcggcttcctgaatcggacgcaaactttcccagcctttgtctctgatgtatttccttattggttcagaaagtagattgaacgacgtcatagttcttcaatactatccaagatattcaagtcatttggtcgctcatcttcaatttcaatatctccaaacaactgctttttgtcaacatccgggttttgacgaatgatattcagaatattcaagaaatcacgaataacttctctgggtgtcaagaactctgatgcacctggcttattaaacatttcttccataaaagcagaaatctcttcatctgaaatactgatttcagttttgtaattaaaatcaaagattaatttcaattttttcaaaagaacaaatatttcattatgatccaaaggcgtaagtttgatgacaggctgtgcaaagtcacgcatttccaaagtttcaaatttgttggtctgcaatctggattttaatgcctggtaactaaacaaacctcttctttcattttcaagaaattctcttgtcccggcgaaattgatgaataaattagagacctttccctgaaagcaatcattgtaaatcgtaagaattttttcatagtttttctcacgcattacggaggtagaaattttgtaaaggttgatagcttcgtcaagatttatcataaatccgctatatcccatacttacaaacaacttgcagaaatttttgagcatatcataaaaattctggtcattgataatctcccgtacacccaaatcctgccttgcttcggtctttgttttatattctcctttcagccattttaatgcattccttcttaaaaattcatcatttttaatatagccttcgtaatatttcacgatgactgaaccaaagtcaaaactacctacttcagtgatttcgttgatggttttcattatggtgttttgaatcagtccaagatattcttcattacggatatcaaccaatgaaatattgttttcctgtgctgtttttgaaataacctgctctatccatttttccaacaatgtctgcaaagcacctccttccggcttggtctggatagcaatattatccataattgcagaatataataaaacactttttccatcattagcataaagacggttatcaggagtaaagtctgcatttgcaactacaaatttttgctttagtgctactgtattgagcaaatgaagcataaatgacttaccgcttccaaaatctccaatccagaatttcgcaatgctgtgtccgttctttacgtcattcagtgcggtaataaaggcttctatttcctctgttcttcctactgttatatgttgcactccaatttttggaacaactccccctacaagagagttaataatggaagttgcttcttttggtttaatattatcaatcattgtttaatagttttttgtaataatccggaaatatggtcaaatagtcatcttcttcttcaatcaatacatcatccagtgtttcatagcaggattcattaattgaatcaatcaccgagctcatcatttggtttttgcttttcaagacttcttccaattcattctgtggaatgctgaagctgtttttttcaaagatttccaatacctctttctgaagttctgaaaggcgtaaatctaaattaaatcttgatatggcggattctgtattattatcgctggctatttgaatctgaacttctccggtttcattttcttctatagaatcagatgtttttatttcatcctccaattcgtcctgaagatattcattcagaagattgaccgttccggaatgctgtttctgaacttcttgtattgaatttctgtcgatgataattttttttcgttttggctcatatacagaagctattctattcagtgcattttcaagttgcctgtctttaataaaattattcagaatttcttcaaaatcttttaattgttcatcggttttaaaaagacttttctgaatggtcttattcatctgcttgttatcaaactttgatgatttcaaatcggaatctatgtaataaacgtaaagcttaagagaacttggcttatcctgtttcgccataaacttggaagcttcataaaaaatattttctaccgaaggattttttatgttttcatcggctagtctgataatttgattttcaaagtcggctatatccgtataagtttgtgttattgtttcaaatttagatttccaacgggtggtattgctttcgttcaataatttttctgtttcaatatcaggagaaacaatattcttctggtcatcaattaagaacacatctaattttgaaatcactttttcatagtatgatgtaaaaatttcaggtgaactgtaattaaactctgctgtcagtttccttttatttgagtagacctctctgacattgttttcgcttaatttcagaatatgtccataaatttctccttttactgaatcaaaagtatatttatagttttggctgccttttctatatcggtaatattttctcacaatcagatcagacaattcatccatcaggttaacgaatgaattatcactagaaacgtaattgctctgaagaaattccacagctctcaaaaactgtttcagtatttcggttctacagaattcaacgttattaaaaacattagtttgaagccagattctgttcaggatttcttcttgttcagttgaaagattaagctttttcttatattttttgccaagcttccagtaatcataatcatattgctgatttttttctctgaaatattctgcttcgtcatccatattaaattcttcaagcttctctagcagaaatgaaacaccatatgattttgttcgcggaaaagtatttcctagcatttctaattgatattcgatttttatataatccttatgaacttcaaaatcatttaataaatcgaaaagtagaataaaagcatagtttgtatttccattgagagaaagaatattcccctttaaaaattccgctctgaatttgtcataaaaatttcgctgctcctgtgtagcatagttaatttcatcataagaatatacatattgatgcggccaataaggaacagaagaataagatgatgacgaagacgaatactctgacgtaatctttatattacttatcaaagtgctcatcaaattagagacatcaataattgaatcgtccttcattttagattccacagagtttatctgatttttaggttgggatggaatgatctcgtttcttttttcattatacgttttttgaggttgtacttttatgggactagaacttgtattcttaaaagttactttattttcaggtgttttcttttggtttttgcttatcgcaatgataaaaaataaaattaccaggatgataaaaaaagtcatattctcctatgtttatatggcatcaaacacatcaaattcgtgaaccagaacaatggtatgtcctgactttctcaagtccaatgccttttcgacttttctaccatagcaggcatagctccagcaagcattgctggtatcgccaataatcagatagtctgttttttttgaaatagaatttacaggaataccacctttatctttaatggcattctgaagttcagttctggttcctctgctgagaattcctgtgacacagaacgttttattttcaaaaataatttcaggatcaactgcgcatattccagaaatatttatatctgccgttgctttatcaattgatgcttttacgtcactattactaagttcaacgaattgcctgataaatgccatcagtattaatctctcgtcttcatcaattttcttatcagaaaccacagaaagaacaagacttcgtatttcatcataaggataataggagttcaggtgttcattctctgaaagccatttgtgaagtttaagaatttctgtatcattgagttctccatcagataagattccgtgaaaaatcccctgaagttgttgcaaatcagaggtaatcccattatagtagatactgtcgtgttcatatttttggcatagccaataaagatcttcaatagcctcctttggtggaataccgttagataccgtattatcaatcagtgacataaattcccgaaatggatttttattcactaaatagtggtgttctcttgcccataactgcaattccctcatctcataagagtttattttatcatcggaaataattcctaataaaatgcctttgagagaattgattgccttatcagctcttgctttaactgtcacaatttgctgttctgagttttcaaagtttgccatagtttttatattcctttttaatagagattccaatatttggaatctagcaaaattaaattattagttttaatagagtttatggttttccgtaatcatatgtttgaaatctttaaaattaattaaaaatttgattaaatttaatttttgggaaatttaaaaggtggtacatgacttaaacgatgtctgaatggattatacgacggctgataatcaatatagcccgaagaatgcagattcttcgggcatttatgatatgtgtcttttgagcgaattttactgatgtacatcacttcatcgcgaaaaatactgccggatttcgaaaacggctgaaatttcagaactggaacctgcactaaaacaaaaaacgctgtaaacattaaatgtttacagcgttttagtttattttggtttttacctagcggagagtgagggattcgaacccccggacctgttacagtcaacagttttcaagactgccgcaatcgaccactctgccaactctccctaaactccggtagtaccgttgttttcagtggtgcaaatatagaaagttttttataactggcaaaatattttttaaaaaaattggcttttctatgcttttagagtaaacccaaaatttcaaacagttaaaaatatgatcattaagaactcaacagcaggtgtttagttttgatcgggcaacatttacttttaatatcaaatgttttactcgtagtaatattcagtagttacatcgccactaaaagctggatgcatgtcatgtttttgcatattcagttcaaatagtctttcgccatttttatttccaccccgtatttttaaagaataccatccgttttctaatgaaagtgttatactgttttcatcattaatagaagcagtatctttcaaataaccgatgcctacaattttcacctcattattagctgtctgaaatatccagcctttcgattctacctctacctcttcatcgttcaaaatctgttcattattcatggaaagccggaaagcataataatcttcctctactcctatgacaggaatagcaattccggatctggttatttcatctccatgttcattttctacaaaatattttaaaatattagtacctgaaagatgatgatcctgcagatactttgctaaaagctgtggactgaatatcacgaaacctttaagttcagagaatatttttttcatatatggattggatttggattagattttgcctgccacgataagtatgacaggcagcaatatggtctgtcagatgattatcatacgggtatctgtctgctatcagtattactttttattaattaatcatattttcttcattaaaagatataaaatcgttttgggatatattgtcaatactatttatcagcttatcttcggcagatatttcctgatcataaaactgctcaagatattcttctccttcatcatcatccccgtcaggattattagtaaaaaactcttcagatttcaggttattgattacatccaaagtatagtctattgtggattttatcttcgcctcctctccttttgcaattttaatgatattggttgcaaccaggacaatatttacagcaattgcagcctgataactactgtattcatcatcttcgggagccaaaccatcaagggcattaaacctctcaatatctgaaagatccaacccgttacctgtaaaaacacgactgaaaacatagtctgcaaactcagtaagctgctcacttccattcttgaagcgctgcgaataatcataattatcatctttaatttcttcttcaaaaagctgatacaggtctttaattcttatcaatgatgacagattaaatttgattttattttctttactaagctgtaatgatttttctttaactgaattttcgctcatgtctttttaattatattttggttgatattttccttcaggaatatggtatttccctccttcctgtctatttttactaaacttacctgttgtaccttcttcaaatttaacattattattgttcatgtgatgctcacaatcaatacaaatttttgtacttggctcaatttcattaattccttttttagcattcaccaaagcttcttcagcgtgaacattatctgctttactttgtatcacagtgactcccatttctttagcccattcttttatctgccttggcacatatttcttacttgaagaaacgtagtagttccccttcccgtcagttcctaccgctgtaacactaaatcctttggcatcaccaagtgtactgtgtgcatctctcaccagctcctgtaaaaagttaacaggatcattatgcagaccaaaaatatctacccaggtattactgtcgctaacaaaagcatacagggtatcattattacccaataatccgataggatcttttgatatgtacattccggaagaagaatcataatatctccatctgttataataaagtccttcaacttcctgatctgcatactggccaagctgccggaatggaataaaataaagttctcctgtatggtctctgaggtttccatagatatcaaactcagctttccagattaactctcctttatcattatgtgactgtattggccttccaatataatctgaaatgatgccgaagcgttctccatttataatttttgcgcaagggaaaagtgctcctctctcatacacccacgtggtaagattctcggttatttcattttctgattccagttcaccagcttcattgatgtatgttataggaaattcttcagtgttgtaactccactcatgcaaaagaacattagcatcccacacaaaccgggttactttattttttgtaatttttgaaattctgcgtccaagcgcatcatattcaaaagtcacctcttttccatccggacgttttactgtgcccagcaacccgttggcattccaggaataggcccaatctccggattcccattccggattccggatttcttctgaaaggtctgtatgtatattgggtaaatcggttccgtcaaacattttcggatggttcagccaatctgaagctatgggcttgtaataaggatgaaaatcttcttgtttttcattacgttccggcttgatgttattgataggccgtttactttttaaaagcaaatttccttcttcatcataatgatagaaccagtttttatcccgcattagctttccgcctttatcataaatacggtcagttcgtcttacgctttcatatagacaaccggtttcatcaggatttttatactgtacttcaccattggaatattctgctgccaccagacttccgaaagcatcatagtcaaatctggtccttccaccggtaactctgtccaatatatgtaacaggcggcttcctgcactccagttgtaatctttatggaacgtggtattgtttttattaacaataactttctggcttaccggcattccaatatgatcaaattcaaaggtgctttccacacctccggtcatttcgcgggaatgcatttgtccgttacggcttatttccagattcattttccagggcagatctgaattttgactggcagctgctactgttataagctgatcaaaatcattataggaataatcaatttctgcacccaaactgctctttaaactgatcaaattaccatgattatcgtattcatactgaatggagtgctcaccttgctgttcgctggtaaccagtcccagtctatttctctggaagataacgctgctgctttcattatctgcccttatcaatagtcctgaagtgtcatactgataggcttcccaggttccgtccggataatgggtctgtgttattcttcctgccagatcatactcataaaagatattattcccgtgaggcgttcttctttgggtaaccagtccgtctttatctctcataaagaatttcttctggccgtcaaaacctgtttcgccaatgatgtcattgttattatttctttcgaaagaatagatctcgcctttttcattggtaatgctcattaaattttcataagcatcatatccaaagactaatgtttcctcttttttatgggtctgcacattccggcgaacctgacgcttcaggcttcccatcggggtatagctcatgagccattcggcacgcccgtccgtagcatatacaggaagatcataggcatcataacggagttttaacggcaattgtccctgttcggacatttctataacccttcccattttatctctgttccaaagagttctgttcaaaggtttcggactaaaaatcagcagtcttccataggcatcatatttccagtactgctctgctccagcactattggtaagctgaataagctggtttctttcattatatccgtaatgagtaacaatatctctttttatgcttctttcaggaaatctctttccgtcaggatattcataggtgatagtttcttctgtaggatcggtatagcttaacaatttaccatcttcatcataatgccatgtttctgaagctcccgatggggaaaaacgggccgtaacctgtccaaattcattgtactggtaatgatattcttcgccatccggagtatggaagattttaatattacccatttcatcataagtatacccgtgaacacgtccttccggcgttcccatcatcttcagttcgttgtgggtagtgtagtcataccaggtttcacctccttctccatctacttttttataaaccagaaagttttcatcgtaatgatactcctctgttttattattttgttttgggtagataacttctgtgtaaccttcctcatcatgataatgaagctgaccttccatatatccatccgttcctttggtatggattactcttccctttttgtcgtattcccactgatagctcattccgttacgattggttcttcttaccacatggttttctccatcataatgaaacacaatggcctttttatgaatatcccagacatgggtaagattaccccgctcatcataatcataacgaacctgcagatctctctgctttttataacaatagtaaacttctgttacttttttgtactccggatgaataatggtttctatactacagccacttttaacatcttttatacttttaaggacaatattccggtcttcatattcatattccctgatggttccgtcaccatattcaatacggattactttatatatagttccttccgaaatatgatggaaacgttgatacgtatagatatcagttcctttacggattacccagatgctgctgcttggtctgtactgccatatcttctgatctctgaaatacgtcatctccccgcctatttcaggagcaggaatcagcattgctatattttcgtccgggtgcatccatccggcaaacttattatcttcttcagggagaataaacagatcatgattattgaaaacaccgtttccaagcgggccaaaatcataaggccggtcgctgtgccagatatttttccagattaaagatgtactgccctgaattacaaaatcatcccattcgaaaaccatggcaccggttgcaaaattcacaggttcaagtccgaaatgacacaatttcttggataaggcattggcaaatttgaatttattgaacggagcctttttaagaacactgttattaagcttttttaaaccgttagctcccaactttcctattttcttggttaagcttctcattaaaaacatacctgcaagacgcatcagcatttctcccggagtataaacatgcggcacaaaggctcctcccaccaatacaggcccgcccgtattgatctggatatacatgcttgaaaaattattgtagaaagcaaagtaagccagaggatttttctttggtttatcaggcattgcaggcagcatggtcattccgaaagggaatcccatacaggtaagtacctgctgaggctgatttccgctcattttacttccctgtgccaaaacagtctgcgagccataataaacctctccttcgtgtggagcttcctgaggaaaaggaataatataaacaggaatcaaagaagtgatatgtctgaatggaattaaaactcccatcacacttgtagttgtagttgctttgtgtcttccgtgaacatatattgaacctcccatcggaatgctttccggaagagacggcatcaggtttcttgcaaattgcggaatcggaatcgtgatggtaatgtaatccataatatcaaaaacaatcccgataaacggatgtggcagcggtaatggaatcagcataaatgaaggcggcggcggaatgagcgtccagtggatatcaattgccagtacaatatcaaaatgcttacttgtatgctgaatggctgtggagggcattgcaggagtgttaacctttatcagcttcactttgctttccggggctgctttttctgcagttacagcgctgccaccacctccccctccactgcctttcgccggctgcccagagtccccgcccgctatggatttaaccatggagacaggattcagtgaatcgaaattatttttcattccgttcttccatccctgtgtggttttatcccagcttaccgaggtaacatctgcatttaccttccaggagcggtccggattcatatccggttttgctaccttgatcggttttactgtttttttattcagatctgccatgattcttttaatttgagattagcctgctttcggtctttccacactcactttccagtcatcaccaaaatagctcttcatttcgttatccagtaatgtttttttatccgtatcaccttcatatttaagaataagcatagaggccacaaacctcagactgctctgttctcttgctgaagaatccatcagttttgctacatcaagacatttttcaaaatacctgatcattttatcttttgtcagaaccgtatcattcaacgtcccgatgattctgtaacactcaatagccattgcatattctccaattttctgagccgtttctgccgctttttcaaaagcattctgtgccctggattttttggaatttcctaataaatggcttccatagttcatatacatctgaacttccagcggagtatccggctctatttcttcaaatatggtttggtaggtgttttctgctttatccttttttttatctgccgtataagcctgggtaagcataaaataggcagaaatttctccctgtttattcttttgctctttagcaagcttcactgcttttttcagtgcatattccgcttctttgaacctttctttacttaaatggttactcgcgataaggatctgctgctgaaaatctgtatccggactgttctttttacggttggtatgggcagcagtattctgcattaactgatgaatatctacttctaccctaaaactatatgctgaggagatatttgacagagtcctgtaatggtgatgctctgcccagaccagtttaatatctttatttccagacttttcgcagattctgcaccattcttttacccacaaagaaagctcttctgcatcactaatccttaacggagctatataaatgaagatgctggaatccttgatactggggaagtttttctttaattccagtaaagggtaaaaggctttgtatgcatctgttttaaagttttcgtcaggttgtctgagttcccattcgggaatattttcttcacttttctttagcatttcatagaattctgtccattcatccaataaggtctgcccgaaagaattcatcccgttaaattcctgataatggagcaaaaaaacatcgtctccctcttcatcttcagaaagtttcgacttgataaatccgtcaaaaagatcggtttcatgtttttctcccaaacagatcagcatgggtttttcttcattctttgaaacaactttctgccattgcctttttaatttcaccaactccaaatctaccggattcatctgccttaattcagttttacagttccacttacaatatttgtctcgcttccgccaccaatattgatttttcctccgctgctgagattggcttcggtctctcctctcatggaaagtgttttggttccgatatccagcgtatcggatttgataccgattcctgaagtcggatcaccattttcaggacctaccccaactccgatacttgaggttccacctactccgatattaattccctgaacaaatatttcttttcctttgatctggatattcccatctttatccatataaatggaactgcttccacaattcagcgtgatagaaatcttgctgtctatggtgatgtttcctgctccatccagaaaaacggagttctgatctttatctctcacggtaattcctcccccgtcatccaggctcatcgtatgtccgcttttactgctcaggctcttaatattattaccggcacctccgcctccgccaacgcctccatggaacattcctcccatcacaaaaggacggtcaggatgctgatgggcaaaattgacaaccacctgatctccttcttccggaattgccatgaacccacggtttttacttactttttcacttccgccaccatcaggagtcattaccctgatatattctgttgtggcagagccattctgccagtcaaactgtaccttcacccgcccctgatttaaaggatctgtattggaaattaccttcgcaaactgagcatccgcttttggagtgtgaaactccgggcggggaataaatcctgtatctgatgcgatggcctcaaaggttcctgtataatatcctcttgcatctacttcgtgatacatttctgtaatcatcagtttggtaaagtaggttgtttcactgctttcagcttttctcatttcgatatcagcaatacagccgggatatagaaagggcacggttgtaactcctgaaataacaaatacttcagcagctttacttcctgctgttcctttctgggaattttcaacatccatgaaagacactgcttttataggagcaactctcagtgatggagttgtaaaggttttctctgaaatttcatacgcccttttcgctatatctgaagtatggttgatctttgagcttcctgcagttaatttttcatttttactgctgttgtagccataaaatgaaggattcacgtgctgtgctttcatttttattttaatatcacttacgctgcttccataggtaagttttacaggtttttcctgaggaggaagttttccgaaatgcaatacttcaccatcataataaaactgttccccataagcttctgcaattcttgccagatagttatagtgagtttcttcatattgtgagctgtaggaaacattcccatgggctgcatctaccctgaaatcgaaagtgttttgtcccaaaccttctttgattacctggtctgcaatactgttcagactgatttcctgtgatcccccaaaactctgaatatgaggtgctgcatctaaaagaacagttgggctggaacctgtaagaactatatttcccagacttcctttttcctgactgaaacctacttcagtaatcactcccacaaaattcctttccggaccgtcttcaacgtctttatacctgaagatcaccgtaattcttttccccaggaaattctgggcttcctcaagattatgattttctgagtttcctaaagtatcgtgagccagcatcagatcaaattcatgatgtcttacagcactttgttttaattgaaaatgtttgaaatgcttgattacttttccgtcaattacaatttcaagttttaccacacggttaattccggcaacttgatttccgggaatcgtattggcattataaattcctgaagtgggctgtttggaccacactttatcttctaccagagtgggaggattaggttgtttaacctggttcataaacatctgagagccgttttgaaccattcctgtataggcctgggcctgaaccattttttctgttgctttcttaatggttccactcgatttttcctgtaattccttagcagttctgctgactgcctgatctgtcaaggtttctttaatattctttacagcgggaattttatctttagaaacaggcattttgggtgaatgatcgtcctgaaacatagttgtaatattttgattgattggatgtcagatttttttaagcctaaaattgatctgagtaatgagatcagataaactttattatccgattccgcctataagccggagccggatatcgtgatcaaaacagggtattagaaaacggtaaaaaggaaaaacaaaatataaagcctgtttacgccctgttaatatcaggatttctcctgatttactattgtaatatgctggttttaatcattattaatttttgtattggattggtggtattacaaagataaaacggtaatcgttattcaggaaattttctccatataatctgaaattttgtagtagttctacgactttttattaataattctaaaacaaatgattaaaaaaaagaagcaaacaactctgtatcaattaaatatttaacaatttttaataattaaaagcagataatttatcacttaaaatagaaatacagtaaaaacagaggaacttttaacaacaaaaaccagctgtattatgcagctggtttatattttaaattcagtaatatctttcttattgttttctaagctctgctacttttttaagataaacatcgctatgatccagaaattcctgatcagtctgatgtactgtaatatgaggcataacgccttgccctcttttctggtccggaagattctgagcatcctgaatcacatgaacaattgagaagccggtctggattccggtgttggggagttcatacaccagtgggaggtgaccgttatgctcatagtagcctcctacagtttcttttccaatgacaatagcgttggtataggatttaatcagagaagccagatgggaggcagcagaagcaaccctttggtctaccaacagatacagctgccccttaaaggttctgtcattaggcataatggaaggatttttgtcatctgcccaatagtatttcccctgaaaattcttaggataaagctgttttaaataagcattcagcccttgcttatcctgaactccattggaaaggaaaagaggggttatcaccagcttttcttccaagggaacttcgttgaatttagtataggcataatgactgtcacggaaaggcctttgtgtaaggtaagaaaatactttttcatacagagctcctgtgccacccgtatttcccctgagatcaataatcagattctgtatgttttcaagttccagagtatccatcatctgatcaaggaaaacgctgaattttttataggcaggatcttcttttccggtggcaaaatcaaatcctcttaaagaaagcctgtaaataccttcaccttctttagtgaaactatatttttcagacagcagctttttatcaaagccaagtgaatgtctggattcctgaagctttttaaagttttccaatggtattcccggcagggaaatctcctttacaaccccattccatcgataccggatcgcataatttttatggtttccgaattctatataaaatttatccagcattcctctttcaaaacctgtggtttccttataaggcattgaatatccatctgaaaaataatactgagaaagacgcctgatcatctcttttgaaggaattccgttgatagaaaggatttctgcaccaaggggtattgctgtatctttagaatcctgaagcaggcgcccgtcaatattcttcagggtaataggcagatattcagatttctgggtaagatagtatgaggcgtggttaggtaaatctgtataattatgacagctcccttcaaatccggtaagtctggcaatgactttatagaaatcgaaaatatttttgcagtttcctgcttctgtttctgcctgctggtagatgctgtctatttgctttttacttctgtacacatacaatccggaatttgcctgttctctgatagaacggaatgctctcagatcttccacaaactgatcaggcgtgaactgaccattcaaaacaggaacgcttttggactcagtaacagaaacctttacggttttacttttttcaagataagatttggcccagattttcacttcatatttttttcctttttcaggagtaaaatagaaacgttcaacactttttatccccctggaatcatcctgttcttttaattttttcccatccataaacaatgcaactcccagattagcatcagcggattgtactgagatccatgttggttgatgagattgtggtgaatatttcagagtatctcctggtttaagctccgaatgagtttgtgcgtatgcactgtttaacaacagtaaaaggggaataataaaaggtctggccattataattttttgaatgggctaatatacaaattaacctcaaccctttgagtactcttcatttcttccctttaacactacaatttcacactcatttcctgcacttcctctgcagaaaatccatagatctgtggtgtttttacatccagaagattcagatagatgtataattctgccctgtgatggatttcatgttctatcatagcccgaagccatttccatacggaaatttcactattagccggcgtcagacatttacgtgtaagatccccgtctgaaaggctgttgatgatttccaggctctggctgtgcatttcgttgaaaaatttaacggtgttttcatagccgtcggcaagttcttttccacatcccggataggcacttctttttccggcgatggtttctccatacatataacgttcaatggctgcaatatgtcttatctgatcaccaatggtaaattttccgggtttataggtaaaatcaatatgttcgggaggaacaatttctataacacgattggttctttctcttatttttccataataatctatgaatgactgtactgtttttatttccatatcttttgttttatcaggtccttttttctgtaaagtgaatataagaaatctagagatataagattttggtttttaccataaatcatctataagattaaaaaaatccctaataagtgagtctaaaatttggaagcttgccaaataaccaatattttagttaaaaaataaccatgatgaaaacaggaatcttcttgtgtattattctgttgggttttaacagtatcacagcccaatccgcaaaaattgatactgaaaaacttcttgagtattatgaaacacaacgttatgccgatgcagctcagtatcttcagagcatatatcccggagaaacacaggatataaaagccctttcacaaatagcttattgtaatatgatggccggtaaactaccggaagcagagaaaaactatcttaaaattaacagtcttcagccgaacagcctgcctactctattcagcttggccggcattaattccagacggggaaatgttgctaatgccaaagcctatcttcagcagattattcagcttgacagccttaacttcagtgcttacaaacaacttgctgcttatgcagacaaacctgagtccagactcgattatctcaaaaaagccaatgctattaatgctactgatcctgatgtagcttatgacctttctttaacctacagtggcctcaaacaataccagcccgcttatgatgtattgaaaacagccatcgctgccgatgcggaaaatttcactttacagcaggctttattaccggttgcaaaccagctaaccaaatatccggaagtgattgagaccggcgaaaaactgctgaaaaaccatgctgacgtcaatgtaatgaacgatatgggacaggcttatttttatgtaaaagattatcagaaatgcattatgatgtacaggacattggaagatatgggagtgcaaaatgaaggcacattctattatatggccttaagctatcgtgagctgaaagattataataaagctgaaatctatgcacaaaaaacgattgatgaagctatttcaaaacacaccactctctattatgctgcactggcaggtatttatgaagccaaaaaccagtataacgaggcggtaaccgcttataaaagaggattgacattcggtaccagtaatattatttattaccgcttaggtcttctctatgacctcaatctgaagcagcctaaaaatgcagccatgtattatcagctatatcttaaaaacaagcctgaccaggaaaaggaaaaagagcagattgcttatgcccagggaagaattcctcttttaaaatagtaacctaacattttgtgattatagtcacaagtggaaactttgttaatccgttaattttgtattcaacaataaaaacaacatttatggacaatacaacccaaaacacagcagaacagtttatccggtatttaaatgaagaaaattttgacaaagcggaaagctgccttgatcctgattttaaatttataggagtattgggaaaaagagacggagcttcagtctatattaaagatatgaagcagatgaaattcaagtatgaaattcttaagacttttacgtccggagaagatgtatgcttctggtataatatcgacatgggagaaaaaacaatagaatcttcaggatggtatcaaatacaggatggaaagattcatactttaaaggtcctgtttgatccgagacctttacttgacaagtaaaataaattgaaaactttgtccccattcatatcctccgctcgtcataaaaaataaagataatttatgaaagaatttgcattgatcttcagactgaaagatatatctgatttcaaaccttctccggaacagattcgggagcgtatggcctggctgggaagcattgcagcccaaaataaactggtggataaagggaatactttattacctgctcccggtaccgctaaaactgtaaagcctgacaatattgtaacggacggcccttataccgagattaaggagttcatcagcggatatattattgtacgggcagaatctatagatgaagcagtggaaatggcgaaaggaaatcctatctttaaaatcggggggaatattgaagtccgagaagttttgaaggcggataagtaaacaggaagatggaagatggaagattggagatggaagttatggcagtttagatccatcccactttttttctccatactgtatattgaatgtctttgctatcaatttccggaatgtcttcagattccggaattttattgatatctgttccgtccagtggcggcaggtttactgtttcacgcactttgtttacattttccttactttctacagggtaaattgttccatcggcggtcagctgtgtcccatatctttgggatttactttgaaaaacctgaatccggtcatataaataagctttatgtaccggattaatatcactgccattttcttccatcatcacataacaggctttcataaattcaggctcgccgatagcatgctgaataataagccaggcagcatcatttgcttttgttcctacttttgagatggttggatatccaatttcggctatgatttcccgcagccgttctgcattagctttgtgaactttttccatttcaggatgataaccgccggataattcgccggctttcaaaagtttttctctaacagacagatctttgtcagccatttcgatcagttctttttcaaaagggagatggttcatattatgcttattgatgattgatgattgataattgaggaatatactctatataatttgatcaagaataaaacctgctctgttttctactgaagctttgggaacttctatggtcgtaaaaccatattcctgataaatttctttcatacactcaaaagtttccactgcctgttcaaaagtttgctttctttcagggtcattttcataaatctctttccatggcggaagaataaaaatatggttgtgataaaccatttctctggctttagattccatgaatgcaggaataggaatattctcaagtctcatgtaaccaagcgtatccagtattccgcggtcaaagaaaacaggttttgtatagcctattttacttatttccagataggtttttacagattcctcaaacatcagttctgcaaaaagttctttattgagccacggaactccttcgccaccggaatctatctgctgtttgataattttccttccttcttcaggcactgtaatcaattcatggcggcttaattcttccagcaatgtcgttttgccggctccgggccctcccgtcataatataaagtggtgaaatatcctgcttcatagatctgaattatattgtaattaaacccaggttttcaaatgatgtggggtttaattgttatttttaataatacttttatatgtattgatacggtcttcttcattgaacatattacataatatcaggagattgtccgtattgtatttttctgaaacctcctgtaatctctggccaacagatcgaggcgtttctgtaataatcctgtctaaaacagtaaagaactcttcttcatctttagttcccagaatcgtttcctcaacagcttccggggaaagaacagcatccggacttaccagctgccgggattgtaaaaactggtaagccattccataggcattccgtctcgcctcttgaatggtagctgccactgatacagctactgcaacctgtaaagaaggctgtggaaaatattttgtcgtatcaaattctctgagataagcatctgtattttctattccgttctcattgttcataaaagcagcaaatgaatatccgaccccatgctttgcagcttccctggcagaagtcattccagagcccagccacatgatttcggggatatgctgcacatgggtgggctgtgcaataagcccgctatatatactttcttcgtctctgatgaactgaatgatttcttccagctttgtctccatattggataggaccactggtttatgattattcaaagccattacagcatcttttagtcctccgggtgcctttcccagtcctaaaataaagcgttcaggatataaagttgacagcattttggtccattctgcaattttataggcagaataattccgcatcatgatgccggctgtccctatcttgatccggcttgttttactaagaacaattgcggctaaaagttcgggactggagctgccatacgcttctactccatgatgttcagagtacataatactatgaaatccagtttcttcagccattacagcaagattaatactgtttgtcaatgctgttgctgcatgatctcccattataacaggtgactggtctaatatccctaacttcagcttcattgtattgaatctattttatggtgaagttatgaaagctttgtttaactgaaaaatataatcttatcattctttaggcggaaagcggattccttcatccttaatcaggtcgtaaccaagtttcatgataatttcaataaccggaatggctttcttccttactttgtaaggctgtactctactttgatggattctgaattgcctatataacaggctttgtttctgatatgtttgtactgcttgtcaacaaaagaaacagatattgagcttactaaaacagcattttcaatttaatttttcagaaataagaccttacttctgatccttatatttgcgactgtctttaataatcgtaattattacaaagtaaatcaaaagtgcaagcatatgaagccctggtacaacaagcagcaaaaaccaccatacaagccctgctccgccactgctgtcaaatagtaaatgataatataatattgaattgtacaagcagaacaatatcatattgaaagcgccgaatttccaactatgcgtaaaggttaccataataagtaagaaacaaactattgaagctgcatataaaagctgattatcattcattgttcgttaaactatttatcatttattttaaactgctttgtttctaagcagatagcagccattagagaaactttttgtccgttaacacaattcataggtttcaaatctgttgatagttgtaagaatgcacttgcagatacaagaaaaagtaatagttgaaatgtttcatggtttgtttttagtgataacaattatacatagaattatcatattttacaaataacatttgccttgtggagtgtctattgtgtaaaagcatgctaacttaaaaaccatcataataactccaaaaaaagaaacctgaatatgtatttttaaattttatttatatcaattccaaataatttcaatactttccatttattgtcacaaatatttaatactttagctcaataatttgaacgaatgggaataatccttaaaccaattgacattgtagatgacatttcacaagaagaattccgtgaaaaatatctaaagccatgtaagcctgtagtaatcaaaaatatggcaagaaagtggcctgcctatcaaaaatggacgatggattatatgaaggaagtagtaggtgacgttgaagttcccctttatgacagttccaaagcagatcctgcagctcctattaatactccgacgacaaaaatgcctttcagtgagtatgttgatcttattcaaagagagcctacagacctgagaatctttttctttgatcctataaaattcgcgccaaaattgctggatgattatgttccgccaaaaaatcttatgggtggatttttagataaatatccaagtatgttctttggaggtaaaggctctgtgactttccttcattatgatattgatatgccacatattttccatacccatttcaatggcagaaagcatgtccttctgtttgaatacaaatggaaaacccgactttataagcttccttatgctacctatgctctggaagattatgatattgccaatcctgattttgaaaaattccctgcgttggacgggattgaaggaattgagtgcttactggaacatggagatactttatttatgcctaccggctggtggcactggatgaaatatctggacggctctttttctatttccctgcgtgcctgggataaaagctgggcggtaaaagcacattctctctggaatcttgctgttcagcgtaattttgataatttcatgaaaggacggtacaaaaagaggtatatggactggaaagaaaggaaagccgtagaaaaagccaatatcgctttgaaaaaaggacttccaaaataacggattttttttaaacatataacagatggatgattggccagaatcatccatcctttttttattaaccttcaggatgtgattcaaaaattaattaaattgcatactacgttccctaatatccgaatatatgtttgaaaagttgatagatagttttgaaaagctatgcctgcagatcattattgaaatactgctggttccggtaaccattttcaaattgtttcaggatccccgccgctgctatgatctgtctgcacacgagatggaaaaagaagaatccgaacgttttcacgactacctctctcctatcaaactttctgtttatacttctgtaatagtctctgtacttttaatggattacagcggagagcataatatcatttccaggattaagggattaagcatggtagaaaaagcactctttatatttctgatgaataatattactgctgtcctattcagtgttgctttattatggtacaaacaggaaaaagtaaataccgtgaccttccggacattgctgttttctttcatttatacaaccgtctatactactactcccttttttatattaatcagttcggctatgtttctggggcagacattaaatgtggaagcttacttggaccaccttggaaaagtgagtgagtatgggacaagagattatctgttttttcttgtctttctggtttttatcatcattggaattatcggagtgttcaagttgttcaaagcgctccattatattctgaagaataatttcagctatcatccttatgtggtatggtttttcacagtgctgttctttgttattcagctttattacgcaagaggatttatttaaaaaccaacataccagtctgttcatatttgtttacatttgtaaaaatcttacatcatgcctaaacctcgagaaagaatagtaaatactgcaatggttctcttccatacacaaggctataacaacacaggtattaaccagataattgacgaagctgatgtatcaaaagcaagcttttaccaacatttcaggtctaaagatgacctttgcatagagttccttaataaaaggtatgactattgggtttctgagcttgaaaaatttacatcggaagcaaaaacacttcaggaaaagttccagaagtcatttgatttcctgatgtacatgaatgaaaaagaagatttccgtggatgcagttttctgaatattctgtcggaaatccctgccgataaggaagaaattcatagggtaatccgtcatcataaaattaagctgagagaatccttcaatgaagatattcaaaatgaaatcatatcagcccacatctatcttctttttgaaagctcaatactgaccagccagctttacagatcgaatgaactgattgaaaaatctaaaatgattgtgcaggaaatactcaattcatcacgttaaacaaaatttaaatttttggctaaagccggtggattggtttataattgtaaggtaggctaaagcccacctctattgatgttgatatccggatgcataatagttgtttaagaaaaagatcttttatcttttatcttttatcttttatcttttatcttttatcttttatcttttatcttttatcttttatcttttatcttttatcttttatcttttatctttataaattctcctgtattaacaattattaaaaaaaccttaattttctcttcaaccctttttccctactgaggattacttttgttctgattttatctaaagaaggaaaaagtgaaaaaaatttttacaactgttttattttgtgcctctgtttttttctatgcacagaccggttctctttccggaaacatcaatgacgattctaaaatagccctgccgggagccaaaatctctcttagtccgggaaatatatataccacttcggatgagcacggaaactttgttttcctgaatgttcctcccggaacctacactatgaagatcgattatctgggatatggaactcatgagtataatgtaactgtggagcctgagaaaaacacccgccagaatattattttcgataaaaaagaaacatcaattgcagccatagtagtttcaggtgccactctgaaaaaccaggcaagagctttaaacaagcaaaaaaataacgctaatattaccaatgtcatttcttccgatcagatcggacgctttccggatgctaatattggagatgctttaaaacgtgttcccggaattactatacaaaatgatcagggtgaagccagaaatcttattatcagaggacttgctcccaatcttaactcagttaccctgaatggtgacagaattccttctgctgaaggcgataaccggaatgttcagatggacctgattccttctgacatgatctctacaatcgaggttaacaaaaccctgactccggatatggatgccgatgccatcggtggttccgtcaacctgattacaagggcttccccgaacggtcagagaatttcagctacgctcgccggaggatacaacccgattcgtgaaaaaggaaattatacagcaggatttgtttatggaaaccgttttttggataaaaaacttggcacagttttcagtttttcctataacaataacaattttggctcagataatattgaacctgtgtggagccaggccaatgattttgcccaaacggtttatgtaagcaaaatgggagttcgttattataatgaacaccgtatcaggcatagttttgatcttaatatggattatgaattcaattccaaaaacaagatctatgcttctgcaatgtacaacttcagaaatgataaagaaacccgatttgctttaggatataaaataaaaccggtatacaacgctgatgaaactgaaattacagattggaaaggaagcattacaagacagaataaaggaggtgatgccgataatgacaatacccgtcttgaaaaacagaaagttcagaactatgctttaagaggtgaacatttactaggttctaaagtagatcttgactggtccgtaaactatgctatcgccagtgaagataagcctcatcagcgttatatagaatttgaaaacagcaaaatgaatttttctccggacctcagtaatcctgagaaacccatgatcaatcttctcgcagcagacaatccgggaagctataaactgagcgatctttccgatgccaacagttttacacaggaaaaggaactgggggcaaaggtgaatgtgcgttttccgttttccgtgattgatggtcagaaaggacgtctccgtaccggtttccgcatgcgtctgaagaaaaaggaaagagaaaatgacttctatgcttttacgcctgtcaacaatatgggaagtcttttatccgttcctacaataaatctggatggtcagaacttccagccggggaattatgttccgggaacattcgttgatccttcttaccttggaaatctggatttattcaatcctgcgttgttcaatggcaagctgaaacctgaaaaatatttatccagcaactacaatgcaaaggagcagatttatgcaggttatatccgttgggaccaggattttaatgagcaactatcgatgatcgttggagcccgtgtagaaaccacacagattgattacaccggaaactatgtcatgaatgaaaaggatctgatagggcaaatcaataataccaatacctacacaaacgtacttccgaatatttcctttaaatatgttccggtgcaggatcttgtgcttcgggctgcatttacgacggcacttgcccgcccgaactactattcactggttccttatctgaatgtaatttcagaagatgaaatcgttgccgccggaaatccgaatctgaaagcaacgtatgcttacaattttgatttcatggcagaaaaatattttaaatctgtcgggattctttccggaggcgttttctacaaaaatctgaatgattttatttatacctattcgaaaaggaattataccgccaatgattttgcgaatgattttgcaggacaaaccaacccgattccggccggagaaagcaactggaagtttacccagcagcgtaacggtgacaatgtagatatttatggttttgaggtcgctttacaaagacagcttgactttattccgggagctttctggaaaggacttggagtgtacgtcaactatacttataccaaatcgaaggcaaaaggaattaccaatgaagaaggcgttgaaaggacagatgtaggatttccgggagctgcccctcatatgttcaacggatctttatcgtgggaaaacaaacgtttctcagccagagtttccatgaattatgcttctcattatattgatgagctgggtggcaaggcatttgatgaccgttattatgacaaacagtttttccttgatgccaatgcttcctacaagattacaagccagctcagagtttttgcagaggccaataatctgacgaatcaaccgttaagatactatcagggaatcccgagcagaaccgctcaggctgaatattacagaccgaggtttacgatgggagtgaaatttgatttttaaaacaaacatgaaaaacatacattatatactggcactttcagttcttccttttgtgatcaactgcagcgggcagcaccaattaacagaaaaattaaaaccaactgttatcacagaaacagttgttcatgataccgatgatcctgcgatatggatcaatcctcaggatgcttcaaaaagtatcatcatcggaacagataaagatacggatggtggcttgtatgcatttgaccttaacggaaaaatcatcaataaagttttaggattaaaacgtcccaacaatgttgatcttgaatatggttttattttaaatggaaaaaaaaccgatattgcagcagtcactgaaagagaaaccaatacagtaaaattatattctcttcccgaactgaaagaagtgggagaaatctctgtatttgaaggagaaacagcacgtggcccgatgggaatttcaatgtataaaaatccacagacagaagaaatatttatcattgtgggaaggaaatcaggtccggctgacggctatctatggcaatataagctttctgaaaaaaacggttccatcaccggagaagtggtacggaaatttgggaaatacagcggtatgaaagagattgaaagcattgctgtagatgacgaaatgggttatatctattattctgatgagcagtttggggttcacaaatattatgctgatccggaaaaaggaaatgaagaattatccgttttcggaaaaggcgattttacatctgatgtggaaggaatttcgatctatcctacttccaaagggaaaggatatattctggtttccaatcagcagaatgatactttcaatgtctatttaagggaagatcaatctaagggaagaattgcagaaatccctgtttctacactggaaagtgacggttctgaagtgaccaatgttaacttaggtccgaaatttccaaaaggcgtttttgttgcgatgagcaatggcagagtatttcattattatgactggagaatggttgaaaaagcaatacaatctgcggtaaaggctaaaaaataaaagaattttgaaccattaaggctgatataaggttttaagagtattaagttgagttacaagtatgagattgcttcacctttggttcgcaatgacaggttgcccatcttaatactcttcattttttcattattcttaatggtttataatcttaatagtttttcaacgcaaagttgattctaagggtagcaatattttaggaagcaaagaaagagttgatttgcaatcaaccgatgaagctggtgtttatctataagctttttaagcagcttgctgcagctctttgctaccttaaaagtaaaaaattatctcttagactttgcgttaaaatttaattctattcttataaggtaaagcttattctaatactcattatttttaattcttttcactgaatatgtttcctcaaaaaatctgcggtgaatgatgttttatttttcaaaagatccgtaggagttccttcaaacaatacttctcctccaaatttccctgcgccgggccccatatcaataatccagtctgcctgtgaaataatatcaagattgtgttcgataacaatcagcgtattactatgatttacaagaccgttaaaaaatgtaagcagtttttgggtatcgcttggatgcagccctgtgcttggttcatccagaataataatctgattggtatttttcagttctcttgtcagtttcaggcgttgtctttcgcctccggaaaagctgtccagcctttgtcctaatgtcagataatcaagtcccaactttatcagaagatcaaaatttttaagaacaaattcttctttaaaaaaatcaacggcctcagaaaccgtcatgttcataacttctgcaattgtttttccatggtatgtatacttcagcacgtcgggatcaaatcctgaacctccacaaacctcacaaggctgttcaatatcatccataaaagcaaggtcaattttttctattcccaatcctttacagtttttacaggctccttcactgtttctgctgaacagcttgtctgaaacctgattagattgtgcaaaaagcttacgtacagtatccgatattccgagataagtaagcaaattggagcgggcacttgcagcgaacaacgactgatcaataatggtcacatccggataaagctcaggtaaaatacgattaataagagtacttttaccggatcctgccactccggttacgactgtcattattccggtcgggatttttacagtcacgtttttaagattatacctgttggcatttttaatttccagataaccatcaggttttctgaattcttgtttgatggaaggtttctttgcgaaataagaacctgttttacctgccgatttttttaaatttttaaatgttccgtcatacaccacctcccctccatttcttcctgaaccgggaccaatatcaataacccggtcagccattttaatcaggtcaggatcatgctctacaattaaaacagaatttcccttatctctgatctgctgtatgatagtgatgatattctgcagatctttcggatgaagtccgatactgggttcatcaaaaatatataagaggtctaccaggctgtttcccagactccgaaccatttttatacgctgagactctcctccggaaagggtattggtacttcggtccaaagtcagatactgcagcccgatcgtaatgatattctgcagttttgctgaaagctctttaataacgacttcatatgcccctgcatccagagaggtaataaattccagcagctcgtctacggaaagcgccatacagtctgcgatattcattccctgaattttacaggataatattttttcattcagacgttttccgttgcatgaagggcaggttttggtgatcacaatatttttcagggcatcttttcttgtgatgttttctttagaatcttttttcaggaatgctttttcaattcttggaacaataccttcgtattttactgtttttccccattccttatgaggatgtttaggtttgtgctccggtgcgtacaacaagatttcccattctttatcggtgaaatctttcagctttttatcattatcgaaatagcctgataaagtatatcttgttaaacgccatccgcctggctgaaaagtcggaaaccttacggctccttcatgcagagatttttcacgatcaattaaggcattcacattcaatgtctgaacaaatcccaatccttcacattccaggcacattccctgtggatgattgaatgaaaaaacattggaatatcctacgaacggctctcccattctggaaaacaaaagtcgtaaagaagcagacacgtccgctgccgttcccaccgtagatctggcattgccgcccaaccgtttttgattgataatgattggaacattcagattttcaattttatctacatccggaaggccataatgctgcaaacggtttctgataaagctgttctgtgtttcattgatctgcctttgtgcctcggctcctatggtttcaaaaaccaatgatgattttccggagcccgatacccccgtaaagaccacgatcctgtattttgggatttttatggaaatatttttgagattattctgacgggcattcgtaatttctatattttccatgataaaaatacttaactttgttaatatttaactaagttaagcatatttgtaatgaaacccattgaaaaagaattttttaacacatttactgatttccagtgccttattctggcacacatgaaccggggtgatattaacggtgtaacggctgctcattataatattattgaatttattttaagaaaaggaaccgctacgggaagagaaatatcaacagcgtttaacatcagtcaggcagccatttcaaagcagctgaaatttctgatcagtcatgattttattatcagaaaacaggaagaaagagatcacagaaagtttaatctttcggtgaccgataagggaaggtttatcatagaaaattctgagacattccgtaagaatattacacggcaggcagcttctatacttacttctaaagaactggaaaatttcaattatctactgggtaaagttttaagtgatataaaattgtaatactcaattcttatttataggtaccaaatactctgtcccagatagaagtatagaatccgaaatttttactttcatccaaatgatgctgattgtgaaacctggttgttcccacaaaaaagcgatcaaaggaagctggaaaaaactccctgttcagatgtcctatggttccccagatcagattaagcaaaagataaatggaaatggaaactacagaaaaatcatatcctataagtaaagccagcatcatgagcccgaatcctatcgtttcaaaaggatgaagaacaaagagactcaaaaaatttgtactgacatgctcatgatgttttccgtgcagcattttatacaggtaaggtaaatgcgcggtaaaatggaagaaatacatcagcaggtccatcaaaagaagcaaagaaacaacttccattgctattcccatgaaggattctgtatgtccaagcactatccatccgtttttccataaaaaagctccgagtaacataacaaaactgttacataatatggtaagcagacttaagtaaaaatcagatctcttgacaggatgatttttctcctgcaacagacttttacggcatgttttttcaataaaaataaatagacttatggaaaacaggtagagaaaaatattgacaatcaggctgaatatgatccattccggccaggaaaactgccagaatatatttaaataaccggaaagctcagcttgattaaaattcataaatccttcatccttcaacttgatatcataaaggtatgaatttcaccgcaaagtcagctataaagtctgtatctgtgctatttctgtcttgcctttcttctgagttcccgaagtcttgaggttagcttttttcttaaatcattatgatatgcgcggtaatttttgatgctgttttccaggttcttcttattaagcagatactcttcatacagatggctcagttctgaaatctgggtaatcacctctgaaggctggctttcaggatcttccgcagcttctatcagcagacgataatattcaatacggctggtcaggttcatgtgaagttttggttctattccctgcatggttttatgattttatggtgtttctgaatagattgaagcaacaggctaaaagactaaatggcaaaatggcaaagagacttttatagattgtactttaattattctatattttatttttatttgtcattattaaaaatccgcaatcagctattttgcctttcactattttactctttcgctttttcgcttttcgatataagttacttccccgctacgataggcggcacatcactctgaaataaaattctgatatttccattcttttctttatctgctgatttgaaatatcctccgttcaaagcagaagcgataagggtttcatcaggatctcccagaggtaacaacggaagtcctgcatattcattaacgattacctgtggtgaaattccattgctgtattctccggagccactggcattaaatactttgtagattactgggtgaatctgccaggaaatttttctgggtttacgtttatcttccactacaaatcctgccatatctttccccaaagtggtgtttccaatctgaatgacctgcatatacggcttcagattattgatgacaatttcagcggcagatgctgtactgttggaagtaaggatgaaaactttctgtaaacctaacgcattggcccgtagagttgtgaaatctaaagctttggaatcataggcaatttgctctgcaaatgttctttttacttcaccaccatttttatttcctttaaaaataatgaatggtgaaacggatgaaagaccggcaggaatcagggaacaaagtgcagccgcagaagatacggaacctccataattgtaacggagatcaagaatcagctcctgcacaccggcagctttaaattctgcaaatttttgattcagagcctgggtcatcccgtccggaaaatcatagatatacaggtaacccacttttttactgtttttatcaaaaatcttagataagatgggttgttcaaaagagaagccgtaataaacggtaatatttttttcattgatgacagctccattctgccattttccaacggtaagttctacaacggtctgatctttaatggatgcagccatagcttcagcattggcggccgtcattactttcccgttgactttggtaataatcataccccgttccagccctgcattgaaagccggagagttttgaaggaccagcttaaccacagtaactacttcattattggccagctgaactacggtataatcaaaaccgtacatattccttatagaacgtggataggtagaggaatcttcagtattcaccatgaaagaaaaccggtcttggggagatagcaggcttttaaaaaaatctttggcaggaagtctgtaatccggttttgcaggcatctgctctgcccagtaatagtatcgtttcatactgtcctgaacccagagattcacagcttctgtgcttccttccggaaaaacaggtgcgctttcgtcattattatttgtacatgaaatgagaaaggctgcgatcgcaaagcatagaagttttaaaaagtttttcatacgtattacagatattctgccacatcaatatctcctttcactacccattccccattttccattttttcctgaaggacgatcatattggctcctgtgtgctgttttaatttcacctgaatcattttagatcctgcatagggttctgtagttcccggcttgtataattcaagataaaccggagcggttgagctgaaaaaactatagactttcactgcagtaaaattatctttactgatattatcaaattcagccagcactactccgttttctcttttcagaataccttttacatttttcagagaagttccggaaagttcgcccaggtttggaaaaataaattcaaatcctacttttccgagattcacctggggttttacagcataagtttgcaggtaaatccccggaagattaaaaaagtaaagatctttatagttctctatattgtcataagtaatattgtattttgcaatttcagcgcctgtttcattgttataaacagacagtttattggtttctccctgatccagtacaaactgaagccgggtttctattttattggtataagacgtttttccgtcaatggttacaggctgaccgttaaacctcagctgtagctcatcaggttttgaaaatcctttgatattaacttctccgggtttctgtactttatcatataactccatcgtattgttgtctgtgcatgaaaacagtacagtgaataacagtagtaatgcgaagattttattcatctttcttcaattatttcttgtaactttaaaaatattgcccggcccgtgagccgggcaatacacaattataaaaaaactagttggatatgttccggatagcttttttcaaagactctccgttatttatatttaaaatttcatggtgattctcccatcagattctaaaggatcagaataatgattatttcttaataaatttcagtctttccgtagtctttccatcagtaatttccgcgatatacgctcctggtgtaagaccagccagatgaatcgttttggaatactgagcggttaatactttttgtcctgctgcattgtagatactgactacggttatattttctttcaatgccggattaagctgcagctgcaaagattcttttaccggattttctgcaatttgtgttacaattttgtttctttttacatccttagttcccaaaaatgaatcggcataaattcctatttcatcaatattaatgttctggatattatttccgcttgcttttctgttggcccacatcccgatatagattttctttcctgcaaaagcagaaagatctacaagggattctacaaactccgtgagatccaccggaaatggattggcagaatctcctacctgtattttataggcacttgaaatatcattgccattggcgtctaccgtcattgcctgaaaatcagataatgcaggaacttctttctgtggtgtgcttacatagataaaaagatctctggcaacaatggtatgagtagatctctgtcttcctatataagctgctaaagtgacagttcctgaaacatttgtaagatcaatctggggagaaataatccagtcattttctgttccaaatcctgtagcatttccggttggaaccaaactgatcgaatggcgaagaacacctgctgttccataggttagcgatgttccgttgtgatagatgttttgtccctgtacccatccgttgccattgctgttcagatcatggaaggtccatccctgaagatcagcaggagtgtcaaaagagtttccccataccagagactgtgctgcagccaggtgggataaaaacagaacagatgataaaattatttttttcataatgctgatgattaagattttgaataaagcaaggaatcagcatgtgctgttccctgcttttttaaagatttttattattctacaatcgtgaaattgtattttgtccagattccctggaagtttccacagtttcttggagatacattccagcttccttcgttgtagaacggctggctcataccccatagagatgcaggagtgccagtggcaaggttagctgcagggattcctgctgtacctgtacccgtaactgaagtagtaaatccgtgaatctggatggtattgtatgctgaagctgaagaaagttcagaacctgtaccttctactttgattccaacaggatatcctgtaactacggcattgtttaatgttaatcttccgtgtcttctgatgtgaataccgttttcatacaaagcacctttagcagagttcttaggacctacgatagtaaggttgttgattaccgggtgagtcaataatgatgtagaagaaccatctgcattgttatcaagctcaataccgttagaatccgggctagctccgctaagactgtgtgtagagttataatctgccaaagctaatgcacaagtaatcgttcctgtatatccgttatcgaaatcgaaattatcatcatccgcagcaaaagaaacaaggtttgaagcgtttacagtaccaccaaagaattcaaaagagtcatctttcccgaaagatacctggatatgatccagagtcgttccgcttcctactcctcctaaagtaagaccgttgatttcatttcctgagttcggagctaaaagatcgtatcctgcaaactcaatacgtacatatttcaatgttccaccgttatgagaagaattggtaccaccgtaatagaaatcaggaccggataatccttcgattgtttttgtgaaaggcgtgtttgtaggagcatctcctaatataataacccctccgaaatcaccaggagcagcagtagtatcttcgtttccatccagcaatttgtagctggtgaagatgattggctgagcttctgtacctgttgcattgatttttcctgttttagcaattaccaacactcctgtagctgtattgttagtgtttggcttagctttaatgaatgtacccggctggattgttaatgtagcaccattttttacggttacaactccatctaattcaactacaccgctccatgtagtatttgtagtaatagcaccacttacgctggttaccggaagagccgaagctgtaaggtactcagcagaagtagatttcatttcgaatggagatgatgaatccgccagttgatcgttttgacaagctgtaagagataatgctgccactgcaattagagttagtcttttcattgttataatttttaataaatccggtcgtgttattttttataccagatcagttttttattcaggaataccttcctcttattccttcgatttgttttttggtgttcctcccatcgctgcaggaggagctgcattgcgggagttcccttgagaatcgttaaagcccgggaaaacttataacaccggctttgtcagaactgtactgttgtgcgcatcaacagtttaatcagttttgatcaggctgccggaacctgtacgctgctataattaagatatctttctgtatctgttgatatacttttaaaaagtataattcacactcaggctgaacattcttccgctgtaggcccgaaacataattttatcaatatttttatcgtacctgtctgtagctcccggaagaagatcccatgcttccctgtctgtaccgacattactgccgcctccgtttttttcagcgagataagaattgaagttgttgtaatattccttaaccctgttaaaaatgtttctcacattaaattttacttcaaagtttctgtcgcggagaaatttataggagatctgggcatctgccactgcataaggacgctggatttcctctcctttgtaagcataccctacggtgatatactgatctcctttagcattgtataaaaaactcagtcccaaacgatcaccatcatacgtcaatccaagattataggcataaggagtctgtccgtaaagcggtcttttcacttcgtaagtttcatcattgtctcccgttttatacagatctttaaaagccactactttcgtatcgttataggtgaagtttccgcttatgaaaagcttttccagaaaggttccatctgcaataaatcctaaattctttcttacctcagcttccactcccaataattttgcatttttcgaattaccattatagagatacaaatttccttcgctggaaatatgtccttcacgttctatgggtctgtctatatttttataatacaaccctgcagaaaatatttctcccaacccgggaaaccattcaaatttgaaatcataattattaatgacagaggatgtcatttcggtattatagatcaaaccattggcaatcgggtcaaaatatggcaaaccggttctttcattaaactgtggacggatgacagatttattataggcaagtctcagattgatcttgttggtagggctatatgtaaaattcgcagaaggcatccattgccatggtttatcatcaatggccgctctttctacattctttgtatcacttggatctaattgctgtgaaataagatcatatttaaagtattctgcacgaagtccccaaactaaccttaattttttccaacggttatcaaacatcacaaagaccgcatgctgactaacctctccttcatacttgtcatttttatacaatgccttggtttcccagccaataccacccggaacataatgggagccattaaaccattcagcaagcgaaccatacatcgtcaaatagttcttttcgctgttcggaacgtcccggttttcgtcaacacgaagaaaaaacttctgctgttggttggtattgttttttatagcaccggcatatcctgttttaatggtatttttaaagcttcctgcatccatatcccacttaacggacgcaccgtaattgtaatctgtttctttgttttctatatatcctctgtaaaaatcggctccggaattatagatcttatgaaatgtgagaatttcatttccgataaagtcgtacctggtaatatactgtgtgtaatctttggtatcagatgccactcctgtacgggctgcaaaccaactgatctctgtatttcccattttatggcttccttccagtttattttgtaaaagggtttgaaaaatcgggtaattggtattatccgtataaggcctgtccaggtttttgatctgttccggatcattattggggataacaccgttataaaaataattataagctaattctgcattggcagccattccacttccggttgaatattcattccatccggttactcttgtcagtgtattatcaaaaatatgggtataggaattacggaacgagattctgtttttcccaagttgcaatccaaaattaagcatccctgccagtgtagaattgtaattataggaagctccgctgtttttgaaattatagaatggaatctgtccgtttgcatctggcattcccgtggtatccaaccagtttcctcttcctgtatggtctatgtccagtttattctgttcatttctgatgacgaatgctccggcaaaaccccatttattattgtttttaagcgcgtaggtcctccctaatgccagctggatattagatcccatatcacctttggttgtataagtgctgaaattgtcattcgtaaactgtctggactgctcaaaaaatcttgaatctgtccagttcatcggctcaagtcccttggggaagtcccttgtcccgtcatcatacccgaaataatcgtactttcctcgtttacgggtcagaaattctttgaaggcagactggtcattatacgaagttcccatggttactgttgtaaaattttcgttgggaatatctttggtccttacttccacataccctcctgcgaagctggcattcatatcaggtgttgcagatttgcttaccactacaccttctaccatggcagtaggaatgatatcgaatgaaaaattctggttataggcttccgtacttggaagattgatcccatccatggctgcagtattccaacgttctcccatagaccgtaccactacatatttattatcaatggtggtaattcctgttacccttttcagagttcctcccacatcgctgtccggagttttggaaatctgttctgctgagataccgtcgctcatctgggccgctttcttctgctgtgcaagaagcccggcctgggtatctgccttgcgggctgcagtaatcacaacttccttgatgtctgttattttatcggatgctttgtttaaagcaaatgacacagaattggtttcattattgataacagataatttctgaactctcagcgtattatatttaggtgcttttatcgtcaggttataagttcctgagggaagatctaccgtaaaatctccattattatctgttactgcagttttctgagcaatactcacctcagctccgatcacaggattccctacctcatctacgattttaccggaaatacgtccgtttcccggtacagaaatgttagaattttcatattttatcgaaataagatcaccatgcagacggtacacaaccggaaggccattggtaatatccttcaggcagttgttgacagaagtattttcacatttcactccttttaccttcagctcttttatatctactttggaataagccagtctcatccccgtttttcctgcaaattcttccaaaacttcaatcaacggtctgttggctggtacagaaaatgttactttctgaaccagctcctgagcttctgcggctacagtaaaaaataaggctgctatggtaatcccacatttcaaacttttcatacttaaagtgttctcttgattatgattatttaatttttaatagtgattattttttcaggatataggtgttttcttttttctgcacttccagcccaaggataaaagccagcgattcaatattttcaccgacctttcctccggtaaagtctgccgtgatttttctgtcctcagcttctttaggatacaatactttggtgttatagctgttttccagaacagttaccacctcttttagcgggacatcattaaagcttaaagacaatattgaagaaaccttgccggctgatttcctgactggtttcaatgatatgaccgcagttgtatgggcaatcccgaaattggtccatttttgattcggtgtaaggaaagaaaccggaactcccggagaagatacagccaccttcccttcataaagatcaaccgcttttttcttcccggattgtgaaattttaaatacggttcccaatactttggtgctgaagccgtctgcacgaacaatgaaagggtgtagttttgatttggccacggagaatatggcatccccttttaaatccaccactctggtatccgcaggaaatgattttgctacggtcatttcagctcccggtaaaagggtaactaccgatccgtcttcaagatgaacagtacggtttcctgatttggccatataaacatcaggcctgataaacatggtgtaggtgaaaattcctcccaaggacaaaagcagaataataaccgcagcaattttatataatagatgtgtttttaagttttttgcagatgaaaccgaaataatatctgttggagaaaaataatgttccaatccggataaaaccctttctttagatgctttcctatgaacagcatccagttctttttcagcttggattttccattgttttaaaagttcattttctttttcagaaaccggatcttccgaaacatcccgttcccaaagtctgaaaacaaaggcttcaatatttttataagtcaaatgttttttcatagagtctttcatcgtattcacaaatacttctatctataagacagtgaaaatgaaaaacttccccggggcattcttaacgttatattcacattacaacctaattgttaataattttcgtactttttcacatttactcaacattaacatcccatttaggcctcttttttcagaaatatttaatcttaccatccccaaagttcacaaaaagttaattttcctttaggtaattttgtaacagaatatgagcccaacagactatacattattaaagaaaataaaatcaggtgaccgccctgcatttatgctgctgtatgaccgatactgggatagtctatatagctttgtttttgtacggacccgggataaagaaattactgaagaaatccttcagaacctttgggtgaagctccttgagcatacagataccatacagactgacgattctgaaagtgcaaaaggttatcttctccgccatctccattaccggattattgatttttataacagctataaaaagactcctcctacgctgagcatagatgagtttgatattccacatgaaattgatacggcggatacggattattttgaaatccttgaggaaaatgaaatttctgctttattactgatgattgatgaagtggtttcccggcttccttcaacagaacagcaggtatatgatatgagaatcaggaaaaatatgtctgtcagcgaaacggcagaagcattggggctcagcaataaaactgtaagtaataaattaagcagagccttgggtgaaatcagggaacagctgaatcctgagtatcagtcatctaaaaaactggtttctatcttgtttttgatggagattttgacgaggtattgagatgtggttcgggatgcgaggtgcgtggttttgtgaatagtcaatttgctaagcagtcaattgtcaatttttataatgcctatcaaaattcacagcaaagcggattcaccttttaacgtcaatggtcaatttgctatgcagtcaatcgtcaatttttataacgtctatcaaaattctcagcgaagcggattcactattcactattcactattcactattcactattcactaaaaaccggcagtgatgcactgctaaagctcggtattttaaagtcggcaaggctggagtttatattttcgtcattatttgtgaaaataatggttttcattcctgctgcttttgctgcttttaatcctgaatggctgtcctcaatcgcaatacagtgctcaggagaaatcccaagattttttgcagaagtaagataaacagcgggatgaggttttccctggatttcgaattctgatgaatgaatggtatcaaaaagatctctaacctcaagcttttcaagaacagcatgggccacccgtaagggagcgtttgtagccaatcctattttataatcattgttcttaagatttctgatgaattcctgaacaccggacattgtacaatcattggtgtgtatcatttcaatcaccctggtaaccactttattttccagatcagatgcatcaaaattttcccatgggaatctttcataccagaattctgttacttcctgtgttgtcatatactttgtttgtgcggcaagttcttctgttacctttacgccataggatgaaaaaacatccagctcggcctgggcccagaatttttctgaatctaccagtacaccgtccatatcaaatattactgcttttaaagccatattctgagttatgattatgaattaaatgataatgattggctgattttatagacacagcgctgtcccccggaaataatatgatctattctttccactttatagtcttttcctatcagggattggaaattggatagttcggcacggcagaaaccctgacattcagcggcggcagcacatatcgggcaatgattttcaatcagaaaataattttggccttcttttttccattctgccatataaccttcttcacttcggacttttgccaaagattcaagacgctgctccaaagactgtgttttggaaagtattttttcataacggtcgtgagtgttcttttcgcggtcgctgatcagcaagtttaaagcattttcacccaaaagatttttcacagatttcagaagctgaacagttacatccgcatgggtatccggaaactgagccaaccctttttcagtaagagtataataagcagatgggcgtcctacgccttcgcttttcaccgaagaccggatcaatccttcctctgcaagattcagtaaatgttttcttgcaccttctttggtaatcgataattcttctgcaataagaagtgaagtagcttcccctctcatctttaaaaacatcagaatacgatctgcagccggtttcttcatttgccaatatttaggttgttttattttccaacaacaaatatagtcattttctataacctcaaaaaataaagcttaaattaaacatttacaacactttattattttcattcattactccaataaaacaacaataaagttgttttattcaaatatatttttacctttgtcatacattaattaaaaaaataaatacgatgaacccatttacattaccgcagttaccatacgcttatgatgctttggctccgtttatagataaagaaacaatgacgattcatcatcagaaacaccaccaggcttatgtagataatctgaatgcagcgctggaacaaaccaatgaaactaatgctgatcttgattcgctactgcaaaggatcagtgagtacagtccagctgtaagaaataatggaggcgggcattataatcactctttattctgggaaattctttctcctgaacctaagttgaatcctgaaggtatgcttcatgatgacattacagccacttttggaagtctggaagaacttaaagcaggaatgaaaaaagccggtctggctcagtttggttcaggatgggtgtggctgtacgtaaaattcaacggatctctggccatcagttctactcctaaccaggataacccgatgatggacattctttcgatgaacagaggttttccgattcttggaatagatgtatgggaacatgcttattatctgaactatcagaataaacgtgcagattatctggatgccttctggtctgtactggattggtctgccgttaagaaaaaatatgaagaagcgttgtcaaaaataagatagttaacatgaatttttaataagctatgactgaggaaatttttatcaataaggcaaaagcttcaggcattattgcttttgacctttcagactacaaaccgacaacggaaattgtagagcttgatattaaacatcatcttttcatgggaatgattgtcaaggaaaaagaatttaaagaatccattgctgaagtagatttttctgtatatgatgaaaaagcagtaggaattatctgctctacagaggccatcgtcccgccctgggcgtacatgatgatcatggaaaagctttttccttacgcttcttacgtggatttaaataacgcagaaacaattctgcttgatctctggaagcgccgtctcatttatgctgatctgaaacagtacagaaaccagaaagtggttgtccgggccaatgccagccatgatccttctttgtatttgttagcggccggactgctgaaacctttggttaaaactttaatgtatggcgaaataggactgcccaaagtaatttttaaacaataaaaaatgaaagcaattatattcaacggatcactggaaagaagaaccatatctacttccggactgatttcggattatttttcagagcggctgaaaatgtcaggcattcagactgatatttttacacttgcagattccggaattccattatttgatgttacactcaccaaaactcccttggcagtggaacgcatggttcagatgtttactgatgctgatctgcatatatggctggctcctctttatcatggcagcattccgggagtgatgaaaaactgcctggactggctcgaagtaaccgctaacagatacgaaccttatctcaccgataaaacagtaggaatggtatgctgggcagacggcctacaggccatgcagggaatcaatacgatggattctattgccaaatcgttacgtgcctggccgctgccattcagtgtgcctgttgtaagatcatcattgtttgcatctgacaattcaacacaaatttcggatctctattccggtaagtttgataagcttatcagcattgcaacttctaaaaaaatagaaagttcaggattaacaaaatcagcagaccagctgtcagactgatcttgccgtgtaagtggatgatttgttggcagattgatgatttaaaaataaaaattagcacgctttatgctgcttattttcaaagaacagtgttgaactgctataattaagtttaaggggatttccgaatcgttctccgtggaagaaatcccttttttaaaccttaaaatttcgtgatatggctataaaaataacagatgcctgcatcaactgtggagcctgcgaacctgaatgccccaattcagccatttatgaaggagccattgactggcgctggaaagataagacaaagctttcagggcatatcaaattcccggatggtacggaggctgatgctgatgcatataatgaagcagtttctgatgaagtctattatatcgtttccggaaaatgtactgaatgtaaaggctttcatgaagagccacaatgcaaggcagtatgccctgttgactgctgtgtggatgatcctgatcatcgtgaaagtgaagaggtactactggagcggcagaaattcatgcacagtgcctgaattgtacccaacattttgtaacaagaagccagcattttctacttattgagaaacacaatatcagtcatttaaataacacctgtattatatgaaaccgatattattttttcttgccttactgccggctttattatccgctcagacggatattccaaagatcaaaaaagaatacacccggcttttagaaacttcctcatatggaaacaattcaaaagccggtaaatattatgatgtcaatggaatcaaaatgtattgtgaaacgtatggccagggacagcctttgctcctcatccacggaaacggaggatctattgtagatttttctaaacagattccttatttttcaaaaaaatataaagtgattgtcgctgacagcagagcgcatggaaagtctcaggataaaggagaggcacttacctatgaaatgatgtcggatgattatgctgagctgcttcagaaaatgaaaattgattcagcatttgtcataggctggagcgatggagcgattaacgggctgttgctgagcatgaggcatcctgaaaaggtaaaaaaactcatcattacaggagcaaatttaagaccggattctactgcagtacaagcagatgtattcaaaagagtaagcagtaattattcaaaatttaaagagctgtttgcccagaagaaagataaaacagatctggattatacggttctaaaatataaaagattattaagtgagcagcccaatatagatcctaaggcactccacagcattaaggttcccgtccttgttgtcgggggagattatgatgtcatcaaaccggagcataccctggaaattttccggaatatccctgaagccaatttatggatattacccaactccgggcacagtactttggtggtatacactgatgaatttaacgccaaagcagataatttctttaaaacaaaattcagaaccattacagaccgcgaccgggagttctgacataaataaactctgaaatttcaaaaatttcaatattttatatttaatttcaatagaggcgggttttaacccgccttcttatatttctttttctttccgctttagattctgtgttaacttccaaatattttttatacatttatatttataaaagcgaccttgagttagcttgcgtagggtgaaggtctttgatttttaccctactttcttcaaaatctgtctggtaaaggaataaagaagtgaggacatttctaaaatatacttcctgagttatttagccaaaactgttctctcaccccttttgctttgtatgtaaatttattcttttgcaaacataggagccaaaacttatttggctttaatctcagtataaattctttgagtaaaaggagtttctgacccgacctcaacaccatatttcaatacagctccagcaaacagctccagttcgttttctttctttcctgaattgatatcaagctgtaaggaagttggagtttcaaaaggaaatgtggaagctttttcgaatgtcttatcaatgatatcttcctgaagataaattccttttttatcggcaatctgctgtatttctttcataatttctgtagcttcctttttctgcggttcatcagtacagacacttcctatggaagaattatgtttagcagttaccagtccgaagctggcaatgaatatgaatttcgtccagatatccgtttgtgaattgtctttaaaatcaaaatcaattttactttctttcaggagttctgtaatccattctgcaggagcagaaaaatgcgcaggatctcttccgataatcattttccctgcttttcccttatgttctacaattcctctttctttaatatgggaagccacatagatacaggttggaagaacagtatgttcagggattatttttcgtatcctgtcataaatatccgccccgttcatcataggaagcaatatggtattttcattaatgaccggaagcaactgccggcatacattttcaaggtcatattcctttacacagatcaatacaaggtcaggatttttaatatcactgatgtgctgtaatatggcatcaggatgagtctgtggatgagaatgctccggagataacagagtcaatccgttttcttttaccttctcatacgtttctccgcgggcaataaaggaaacattatactttcgggaagtttcattggcctgattgattttaaaaccaaaatatccacctacaccacctaatcctacaacgacaatatgttttttattcatgaattatttttaagcaaatatcagcgataacatctgatataccacttgacaaatgaaaagaaattatactttgtaaatatcccttctgatcctgctcagtgagctgtctttaattccgagataagaagctattacttttaatggaacataccggaaaatttcaggatctttcttcatcaggctggcatatcttgtggaagccttctgactggccatttcaatcagcctgtcatgaatattataataattaagcacaaaaagaagcctgctgaactccctgaattctggaatattatgaaaattatgctgtacattctccaatcctgtttcccagaaaatacaatccgttacggtctgatatatctctttggttggctgctgcctgaaaaaagacagaaaatcattaacaaaacagggtgccgtataaatatttgttgtgatttcctcattatcttcgttcagaatataggagcggacatatcctttttcgagaaaataagttttggtgctgatcacatttttatccagcaaaacagtgtttgcctttaactcaaaacggctgaatttttctgtgattttttcaaccacttcttttctgattgtaaataaggaatgaaaataggtgttaagtgatgttttgtccattaaaatgttctcataaataaaattgagtcatctaaattagagataattcgtgaaagtctggttaatcagatgctttacaaccaccccgtcaaaaattctttgaattttcgccacccctccagaggaggggaatctttgcatcaaacggaatgatatctaataaaaaacaaaaaccctttaaaccttatgtttagagggcttttatttttttgtaaaaaagttattcttcggagagaacttcatcataagtaacaggatctgtaacctcctgatattgttcccattctgcttcaagctgtttattggttttcatatcttcttcaagcttcaaagtttcacgatattgttttgcttctgctgccattgtccatttacaagtaattcccatggaatcaatataacttctgacatcgtgaatatttaatctaaaaaactcttttcttggattaattttattaagctgactttttaaaaactttttatgaagttgtttttctaatgctggggcgtcttcagcatatatcatggcatgaacatcgaactcaaaagggacacttgcatctccgagctcacgaacacgatctaaaggatccaaacgtcttgtcataccaattttataaacatcttctccaaatgaaccgatatttgaaataacatatacatttccggttctggtctgctgagccattgagattgctcgttgatttttctcttcggcctgaataagtttttgctgtaattcttcaagttgctgctgaaaaagtatcttttgttcttcattagctctggctacctgagattcagccttctcaatcagtctctttaaagtttgttcttctttttcagcctctttcattgctttttcatagtctttacgagctctttcttcttcccggatctgctcacgaatttgtctttgctcttcctgttcctgccatttcaactcctgagcaactacagcccatcttagttcttcaattcttgcactatgataaacttcagatattctcgcatttctaaaagcctggccattaaaattaaccaactggaaagcatcgtccatcttttgtttcaatattccaaagttatctttctttactgacgctaaaatagaatctacttttccgttataggcatcaataacaaaatcaatagcagtatttcttcttgattcatccatataatcacagataccagcctgtctgctaacaatcattagtttattgttatgcctaagctttttaagtttatcaccagcttctttatgactgaaatcttccgcaagctcatccaataaagtataagttggcacaagatattcattgccatatccttcaataacatttttcattgcttttattctatcagcaatctgatccgcttctcttaaacttctgtaagcatctcctcctattgattctgctctcaattcggcgttatctacaatacgtttcgcttcatttacagcattttcatacagtaattcaatctctcgtattttcttctcagtactttcttttgcattcctgcgaagctcgcgagcttcaagctgcgcactagaaagctcttggcctgccttatctcttaatctcaagctatctctttctgcttttttaagaagataatcacattcaactttaacatcaataatatcctgatactttctcaatgcatcattatgttgtgaaagttcaactatttttctgtttaaagtattattatcaagctgtaatttggaaacctctattttcaaacgactattctctccttttagatttgttatttgagtatctttttgaagagattcttttttaaacttccctgatgtactgaatgcatacagcatcaatataaataaaataataatcaataaaattgccatggttgaaatttttatcaggcaatattaaataaaaaatacaggctcaacttacggaaaaccgtaactaaaagggctatatttcaaagggcacaatctaattgaaaaagtattgtcatcgaatcacgaggaattgtgccgtactttgtaatttataacaaattttgtaattttcttaactaaaatcagctgtacaggcaaaattatggaaaatgacttcacttacaatttcatcgaacctgaccaagaaatcgcggattttgtggaaaatctgggaacatttcaaaatctttcggatgaagctaaagaagtggttattattcctgacggaagagttgatctttttttctcccaatcagcttcagagccttttcatgttacccttctcggtttagaaacctatcctgaacaaaggtatattacccctcatacaattgcttttgttgtaagttttaagcctcttgctgttgaatatattctgaatacctccattgccaatttactgaacctgggaaaagaacttgcccctgatttctggaatttcagtgcagacgatttaaaagatttcaacaactgctgtatgaaagctacccaaaagataaggcaactgcttcctgcaaaagcagatgaaaggaaattaaagcttttcgaactggtttatgcttcaaaaggtgaaatgagtgtgcaggaactttccgaaaaaacaggctggagcagcaggcagatcaaccgttattttaccaaacagcttggtttgtcgttaaaggcctactctactattttacgcttcagagcttcactggaacacatcgcacagggaagattatttccggaactcaattatgccgatcagaatcacttcatcaaagaagtaaagaaattttccggagttgctcccaaagaattatcccaaaataaaaacgaccgatttgtactattatcagtattgaaaggaaaataaatttgcattgtaaaatttaaattaacaatgctgatagacaataaatcaatagcaatcgttggtggcggtcctgccggacttacactggcaagacttttacagctgaaaggagctgatgtaaaagtatatgaaagagacttcaataaaaatgcccgtgtccagggttctccacttgacatgcacgaagattcgggtttggcagccatccgtaaagcaggattattagatgagtttaagaaaaccttccgtcccggagctgacagagcactgattgtgaatgaaaaagcagaaatattttttagtgatcaccaaacaaagcctgaagaagattttgggtatgaacattttcgtccggaaatagaccgcggcccattaagaaatatgctgctggattctctccagccagaaacggtagtctgggacagtcattttatctctatggaacgtcagaatggaggctggttgctgcatttcaaaaacggaacttctgcgtatgccgatcttgttattgcgggagacggagccaattccaaaatacggccttatcttactgatattaaacccgtttattccggagtgatcatgctggaaggaaatgtttcaaaggaaaatgctcctaatattgatgcaatggtgaaaggaggaaaaataatggctttcggaaacagtcaaaatattttacttggtcagaaaggtaacggagatattgggttttatgccagttttaaagctgatgaaaactggcctgccgcaagtgggctcaacttttctgatcatacccagatgctgaaatggtttaaaacagaatattctgaatggagccctgtgtgggaagaattgtttgaaaacgctgtaaccccttttattccgcgcctgatctattatatgccctttgatcagacctgggaagcccaacctaacctgaccttaattggtgatgctgctcatgtaatgcctccattcgcaggagaaggaactaatatggctatgctggatgctttggagttgagtgagcatttaacagataaccattataatacgttacgtgaagctatttccagctatgaagagaagatgcgtgaaagagctgccgttgccacacgggaatctctggaaaatggggaaaggatgcattctgatacttcattaacaaccatgcttgacttttttaatggtcattgagttctataacaaaggctgccttcaattgaagacagcctttttccctcttaaaaataattttttttctctccgttagatccagatacggagattcatatgtgttatttcttgatcaactttgtattataagtgttcttgtcatcttttatagtgatcacatacataccttttaccaaagaagcaacattgattctttgtccgtctgtttttccttcctgaacaagtcttccatctgcgctgtaaattttgtaatcacccttacctttaaagtttttcacttcaataaaggtatctgcaggattaggataaactgatatttcggatgattttgtatctgctgtttctctcacggcaagtgtactggcagtaatcttcacaggaagatccataatgcctcctgcctggctttccagttcgccgcacacatcattcggagccgtattgaagaacttgcctacgattctcattcttaataatttatctccggaataagtagttgttggaactgtaaagttaaggttacccattccaacatttcctgtaggagatgcgccggatgtctgggcgactttttctgatgcttcgaaaattccatttctgttataatcaatccataccgataaatttacctgcataccgctctgtaataaatttcctattcttggcgagattgtataggtattaccttgtgtcaaattaacaatcttggttgcatcctcacttaaatctttatatgatcttgctgtagcatctgtataatctatattggcaactgctactttcaaaattgaacccaagtaaggtgatcctgagtttaatatacagtaatccacacctgtttttaatccttttgttttaaaggtataattattagagaaagctccgggaacggaattgactacagccgccacctgaacttcataactggtttcatcttctaaattattcagaacagcagaattagcctggctaagaacattagaccagtttactgttcctgcttttctgtaattaacagagtaagtagctcccggaacactgttccaggatattcttgcggatgttttgaaaatctcagtatctatagcggcaattcctgtaggagacgctgtagaagatgtaggcgcactccctaccgtaacggcaggagacacggcataaaaaatattccctacagctgatattcttaactttactgttccgcttacattccctggcatttgtgcactatagcttccggtatttggcgttgcagctgcaagattcgtccaggttgtaccgttatctgtagtataatctattttcacactcgctgtattataaggggcagcatttgtattggcaacatcccagtagattgtatttaccgcgttattatacagtactgaagatggagtaagtccattgaatttgaatggtccgtcatttcctacagttacggtagttgttgagctggaaaccatcgggcgctgagcgttaagatctcttactgttacagcatagttcaatgttcgtgggatataggataccgtttcccatctttgcttatctgtcaggcttccattcatcacacttgcgaagtttggaaaataccttcttccgttgggtgttccgggaactgatcttgttaaagcccctttcggattgtatccccatccgctatcaccggaaattgtagaaaattcatctgtactgtcattctgttcccaggtgtaatttacagaatcattttcggcatccgttgctgaagcttcaagataataagccgttcctttaggaatgctataagcaaccagaggattaatagccggagcagtgttattgataatattttgagaaactccgcaattaagtttattttctaaattggttaacacctgatcaattgatttataatggaaatatccatctgcattagcctgaacattatcataggtaattccggcatatcccataattgttgttccgccgccaggctccacgttggctccctgattggcatctgtgacagaagtatttgaaaacgtatggtttgcgcccagctgatgtcccatttcatgtgctgcagtaaaatcaaaaacctcacctacgggcacaggtccttgtgtataggcagaacctttttttatttcagtattcgttgcgggatctacgcagacaatgccgattcctcctgcatttccacttctctccgcattctgattaagaacatgcccgatatcataattggcatttcctactgctgaattaagtgtttgctgtaattgaagatttaaattacctgtataaggatctgttgccggatccagatagataatctgcggaaaattctgtactgttaaatgagctccaaaatcacgctcaaaaacaccatttatacgggtcattgtattattcatagcagccagaaccactcctttttttacatcatctgttgcattggccggagttcctgcagctgttaattgatactggctgtattctcctgtaacggacaatgccattctgaaatctctgtattttgtgttggtaggtctgctggtaattccaactccggaaagcatttttttaccattctccaccaatttattaatattcttaaaatcatgttcttctgtgtcacatttgaagccatgttctccatcgttctttgttttatagaatactccgtaagtctgcttatctgcagtaatgggttctataaactgaaacacaccatcctttatgatcatagactgcatatcaattggagaagtactgaaccttaaatacttggaaggatcatctagtccaactcccacataagatcccaactgatatttttctaccagagatctgtccatcacaggattgctatacactgcaaatttttcaatcttcccttctacagttggtaaagaaataataacaggctttgcattttttcctgtttcttctgcatttttaagcatttctctaagagatttcagatctaccctgtaagaatactgtacttctactccttctcttatctgcgaacttttttgagaaacagattcccatctctgggcattgaaaaccgtaaaacaagacgctaatgcgcaaacgaataaaattctttttttcataaatatatttaagttattttgatagaatgctgaaaattttagtaaaacgacggacaggtccgtcattgtcataaattcaataaaatgaaattaatcatataaaattcacaacaaaactctctacaaaacttatatattttaaataaaaaacaaaaaaaaccgctactacacagatacaacaaatacattaattatttgactatcaataaattatattatcaacaacttgtatttaacaatattacaatcttggaatcattaaagtttcaatcagaaaagttccttaaagacatattgaaaatcagaaagaaaatagtacttaaatgatacttatgcagttattaaaaaggataaatgatgaaaagtgagagggcaaaaaataagtaagttaagaatgaactgcagatttttctcattcatagataaaaaaaccggataaaacacaactatctacatatcaacagcttagaataacacatacgcgatgtagtacccgtgtagtatcgatttttttcatcttttagttaaaaattttcatatttgacaccgagaccacgaaaaaatccgagtggtgaaaagagaatatttcgagtactgtctgacctgatgaatcagacagttttttttattatgccagggtgtcaaagaaatgataaatatctgtttctttgggaatgttcagtttttttctgattctgtattttttctgctgaacacttctatgctgaaccaaagtataacttgcaatttccttagatgtaaaatgaagtttcagcatggcacaaaaaacaagttcagaattttcaagccccggattaatgattaaaagctgatgtataaattcaggataggcttctttaaaacgatccagaaattcaggatcattttttttaccaagctctataatttcctcctgcttattgtcattcattcttactttgaggttttcagcttccatagcgagaatttttttccgttttcccaacgcaataataattctccaggcatatagtcccaacaaacaaagaccagcaaacgagaggaaaaaaatccaatataccttattctgatggcggtcagcatcttgttgggcttctgtaataaaggatgccatatcctggttgatagcagccagcaaagatgtattggttttgtaaaaagcatccgtgtacttcttcagataaaagtaggccttctccttatctccggttttttcatacaataccctcagatcattatagatatattttccataataggcgtagatacgctttgtcttttcattgatttccaaagctttaccaaaagcttcctctgccttatcatattgtttgtttttgagaaaatattctcccattatggtatttgcatagagtgcaataccatctgccttgcctctcatattggctttgttgtaggcaagcgttatatatttataggcagagtcattatttttatgcatatagacataatcacttatagcacagtctgccaaacctgtatcatcaagcttttttgccctatggaaatattcgagtgctttattataatcctttttttgaacgagatagattgcctgtcttaagtaaatactgaaaagaagatcatttttgagcggcgacggatcgcttttccggataaaactcatcgcttcatcattatactgaaaagccttatcaagcctcctgagctctacattgaagcgaccgtaaacattataaaatctggctttatgaatgttgtcatctgaagcatccagaattttctttgcattatcaaaaagaatctgggacttcggaaagttctccagtgagatattaagttctgccagattgatataacataaagccttgccgtctccataattcatcttatcggcctgtctgtaatatcttttattaagatcaatcaaagaatcatagtttccggcaagccggaatttttcattctgtttcagtaaagacacgtcaaaagctttttcagtctctttttttgaatgagattggcacgaaacgataataacaagtaaaacggcaagaaaaatatgtctcatatgtttctttatttaagctacattcctatttaaataatgtttaataaaatgattttctcagaatagagagtgtttatattttacattttcaatggttatttccggcaggtcaacagtggaatctattgataaacaaaatcctgcaggttttattgtgatcagttactattatgtcagattttcaagaaaatcgtaaatatccgtttctccgggaatgttcagcctttttctgatcctgtactttttctgctgaacagatttgtgctgtacaaaagtataatctgcaatttccttggatgaaaaacgtaatttcagcattgcgcagaaagcgagctcagaattttcaagatccggattgatttccagaagggtttttataaattcaggatataattctttgaacttcatcaagaaagaagagtcattctttttggccaggtccattatttcctccaattgttttgcctgaacatgattcttcaatgcttcagtttgctctttcagggtatttttctttttttgcaatttattaatcagcttctgtacatatactcctgaaacggtaagaactgttacggaaagtgcaataaatagcggaagatcatttctatgccaatcagattcctgctttacttctgaaataaaatcttcggtagctttattcatggcggcaaatctggcagcatcaaaacgcttctcctcttccatatatttcttcagataaaagtaggctttgcctccgtcattttttttcttgtacacttctgcaagtgatttgtatacgtcttttatatgtgaagaataggtacgtcttgtcctgatattaatttcaagtgcttttttaagagctttttcggcctgttcactgttatcaatttcattataataataccccatggtataatatacccaaagcgattccacatctgttgttttctgactcagcattttttcatctgccctggcaatgtatatccctgcagaatcaggtttatgggtatataaatagtattgagccaccatacaattggtataggccgaattttccagtgtatttgccttgatgaaacattttagagatgttcccagccatcctttccatgcatagtaaatgcctttgtttacataaagcctcggaagaagtttctgagtgagttttgtattttttgcctgttttaaataataaaatgctttgttattgcattctatagctttatcatatactttaagatgtgagtaatacagactgtaatcatcatagaacgttgctttgtgataagcattttcagaatgtatcaggtctttttctgctttactgaaaaaaaaacgggctttttcataattgcctgcggatacattgactcctgccatattaaggtaacaaagtccttttcctgctgtatatttcattttggcagcctttttcagataatttttatttaaactgacaaaggcttcatattcaccggacaattgcagctcagcgctttgggttaataaggaaacatcaaaattctctttttctttgtcctgggtattacgatgacaggaaagcaggcatataaataatcctatacagattgtatagtttatcattctctttatgtcggttggatatgtttttttatacttaaaatcaatttttcccatgccacttttccctgtatctaaatatctacctatgcatatttattgaaatatgcagataaatttatgtcataatttttccccaataagtgttataaatatacataatttcctaaacttattatgaaataaacaatctgttttgctaaaatgtaacattaaaataaagtaacaccagttcccttaaacatacatttttcttaaaattttcagataaacagcgtaaatattctaccttaaaaaaactatgctttaattatgataagactacctgaaatgaaaattgttacaaatagattaagtgaattatttaaaatttagtctgcaagccagaacagtgtgtacattttgtatgttgatataaatgaaaatagccaatctgctttttatgaatattgacttttcatcgtcacaattgtcagattcaaagtgcaatttgtccgatttatcatattttctgaagaatatatttcaaaagttttgaaatttgaataaaaataacagatatgaatcgttttttcaaaaaattaaaaacaaaaaatatcctggttatagtacttgtaatttttattggaatacaattttacagacccgacattaaaccagagcctataaccggtgagattcaggttcccaatgatgtaaaagccatactacggcggtcatgtttcgactgccattccaatcagaccgagcttaaatggtttgaccagattgcccctgcttcctggctggtagcagatcatattaaaaaaggaaaagaaggactgaatttctctgaatgggataaactggcacctcccgtacaaaatgcaaaactttgggagtcttttaatcatattaaactgaattcaatgcctcttaaaagctatgaattggttcatcctgaagccagactttctgaaaaagatattcagatcctgaaaaaatatgtattttctctggctccaaaagtgcctgatacagcaaaggctactgcctataaaaaacagcttcagcaggtcagcacaatacataccacagaatcaaaactgttatttcctactgcattaaacggaatcagctatattcctgattataaaaactggaaaccgataagttctaccgagagactggataatgggacaatgcgtattatattcggaaatgatattgcggtaacagcagcaaaggaacaccggacaaatccatggcctgacggaagcatactggcaaaggtagcttgggaccaaatcgttgacagtgatggcaatatcactaccggagcttttaaacaggtggaatatatgatcaaggattctaaaaaatttgcctctaccaaaggatggggatgggcaaggtttttatctccaaaacttgagccctacggaaagacagcagactttgctaatgaatgcatcagctgccatcgcccgatgaaagacaatgatttcgtttttacttctcctcttaatcattaagctatgaagaatccgattatttatttaatactgtatgtatttgtattgagctgtggctccaaacaggaatacgaatccgtgaatgagaaggcttcccttcctgaaaagtttgattttaatgccatgaacttaaaggtagtcacttcttcaatcaatcataagaaccagacaatgatgactctttatggtaataaaccagcaatggaagagctaaaagacaaacccgaaaaggaggaaagtaaagaaagaatactggccctgattacctggtcacaaaaagaagacccttattggtatggagcaaaaattcctgatcgtctgttgtctgtagaagttatcaaaagcagatatccgctgtcagacaattttgacattcagtataaaaaatacgaaggaccggcacttaaaaaagtatccgcaagcggaactgaaagaatccctgcaattcttaacatgaaaccttcaataatgccctagccgattttcaaaaacacatataaaatgatattcactaaaactattaaaatggaaaaattcacattcagttcaaatcttataacaggatgcatttcagcgttactgtttttgacctctgttgcatgctcaaaggacaatcaggatgagtcttctgaacctgctgtaaaagaagtgcagttacggaatgatgccaatcttggaaatatcctgaccgataaagagggacgtactctttattattttgccaacgatgctactgcagcaaacaattgtacaggaggatgcgaaccaatatggcctgtcttcaatgtggataatctttcatctgaaaagttgggaacaggattagaactctctgattttacaacaataactacgggttcaggtaagaaacaggtaacttacaaaggacggcctctttactactatgctcctttggtaaatggtgtcaacgtaaaagaagaagccgggaaaaccggtggagaaaatattggaggcgtatggtttgttgcaaaacctgattatacgatcatgcttaccaatgcccaacttataggacatgatggaaaaaattatacatccgcgtatacagaaggtacaggaaaaactttatattttacggacgctaaaggagtaacactgtacacctttacgaatgacaaacaaaataaaaataattttacggcctccgatttctcaaataatggagcatggcctatttatgaaacggataaaatagtggtgccttccggactggacaaaacacttttcggttctatcacagtatctggaagaaaacagcttacctataaagggtggcctctttaccgtttcgggcaggataatatgattatgggatctaacaaaggtatctcattcccatctccgggtatctggccggtacctgtgagtaatatggctgcagctatgccttaactttgtgttttcataggaatctaagtgctaaatagcggaaaactacccttcgctatttagcttttgtatctttataactgcttaactttctgatttttatttatgatttatgcaaagtatataaataccaacggaaaaaaggtattcaggattgatccgagaatcattctctttagttctctttttatgggaattctggcttctgtgcccaaaatactccgtatacagataaccctgggagagctaatgattgatttttccatttcgtttttatattccttatttgtttggtattttaatatttacagcctgcctaaattttctattcagaatatatcgacaagtttctttaataaaaagcttttgatcagtctgtcacttggcgttgttgtgatggctgtcctcgtatttttacatcacattatttttccaaagtatgggtataacaccatgatattgatgtatgaattcagagctatactgattaatctgacgatttatatgtttctgtatcttttgtatcagagctataattcccagcagatcagcttggagctggaacagatcagaacagataatcttcacgcccagtatgaactgctaaaacagcagattaatccacattttttattcaacagtctcaatacattgaaatctatgattgatataaaagatgaaggttcaggagattttgttgtcagactcgcagatttttaccgttttactttagataacagaaagctggaccttattcccttaaaaaaagagctcgccatactggatgcctatgtttttctcctgatttcaagatttgaagacggcatagaatttaaaatagacattcaggaagaactattgaattcctacattcctccatttaccctgcaattgttgtgtgaaaactgtatcaaacacaatattgtgtcactggcacatccactgatcataaaactatatagtgaagatgaatatattattatcgaaaacaattttcagccgaagaatacgcctcaggaatctgcagggataggaattgaaaatataagagaacgttacaagcactttgctgaaaaagagctgatcatcctgcaaaatggcatcaattttaccgttaaattacccatagtaaatgaaagttttagtaatagaagatgagataaaaaccgcaaaggctttggggcggatgattgttgcagtgcagccggaagctaccgtagtgcaatatattgaaagtgttgctatggcagtcgcctatctttcagaaaatccaactcctgatattatatttatggatattcagctcgcagacggaaactgttttgaaatattcggccaggtcagtataaaagttccggttgttttctgtacagcctttgacgaatatgccatagaggcatttaaaagcaacggagtagattatatcttaaagccttttgagaaaaaagacatcgaatcggcatttgaaaagatagagagacttaaaaatttctttcagcactccccttctcctgaccggcagctggaagatatattggccaatctgacaacaggcagaggtaagaccaattttctggttttttccaataataaatacagtaatattcctattgacaagattgcctttttttacagccagtttggaagcacagtactggtaacttccgatcagaaggagtattcaataccgcagtctctggatgaagtgggacagttggtttcggcagctcaatttttcaggatcaacagacaatacctgatcaacttttctgcaattgtggaagtggaacattatttttcgcgcaagcttcttgtcagtttaaagattacaactcctgaaaaacttctggtgacgaaagataaatcctcccgttttcttctgtggcttgaagaacggtaaaatcattctttgaaagcctatttctataactacaaacaacaggttaaacaaaaataaaaacggacaaaccattgcaaaatatttttaggtctacttggttttgtacgattttttaaaacaactaattcatccaaaatttctccaaccttttctgaactatggcttacccgttttatctcctgcaaaactttctgatacgctttatcataacggcttccctgagctataatctcacctttatacaccaaagcaaattttctgttactgcttattgagcctatagcatcaggattaacacctcctttttttccaatactctccataatagcagcggcattatgctccataaagaatgtcccgttttgtatcaatgcatcacattctgatgtttttgaaatgaaccatgcactggtaattacccattccgttggattaaacatacgaaggtctttcctttgaaaaacgccgcagttcaagtccaaactagtaaacagtataaaaatgaataatccgctcaattgattgagcggattattcctagtcttcccctgtaatacttaaataaataggtttattttcttccaaacattcttcacatattttgtatgctctaaaaaaaatatttatccaattatcctgagggtttttacccaaaggagtaaaatttatacctataattttacccgaaaattcgatttttgttcttacatccggttcaggaattcttgttgataacaattctttgattttatcctcaagaattatttttaatttttctgtttcttccttgtttaaaggttcatctttaaaaggaatttttgataatttttctttaaacaaatctaaagccaagccttccgcaaaagcgaaattacgccatgatgcgcctttatattcatcatttcttgtccattcatctattgttttatcacctttgatagtgttatgtatattaattcgcataaataattattttaaaaagttaagttccacataatttctagttattttctcatcgtccaaaatccttattctagtaaatccaaatttcttggcttgttttcccgcaaatgttgaaaaagcagcctgttctatactcataccagcatctcttgctttccaaaactgatccaaattgatggattgtccaccataatcagtataaatatccgccttgatccaaacgcttacagttccatctactttcccatacttttttgcatttaaaaaatactttaaaccgtcctcatagacaatctgccctaatgcagcatatttatctgtaacttcttttggaatattcagatcaccatataacaaatgttctccttcttctattggtaaacctcttaatctatatttatcatccaaaagtttaatggtacttttaatatcaatttctttacctctgtatattaatttataaaaaagctcatttctattcggtgatcttgtaagctgcccaatattattaccaaattcatcaaataaattaaacaacattttaactcctttttctggtgcttttcctaaaagtgaaacatcttctacagatacaattcttcttcggttgacaatggtttctaaatattctccaactttctccgagctataacttacttttcttatatcctgcaaaactttctgatacgtcttatcataacggcttccctgagctataatctcacctttatacaccaaagcaaattttctgttactgcttattgagcctatagcatcaggattaacacctcctttttttccaatactctccataatagcagcggcatcaagctccataaagaatgccccgttttgtatcaatgcatcacattctgatgtttttgaaatgaaccctgcgctcggaattacccattctgtctgttgaaacaggcgtaaagaacttcgttcaaatcgtcctgcatttaaatccaaaaataaggaaatagcggaagctttcaaaccctgctgtacattttttgcagctttgggcagcaatacaaaaattcccctgtaaacagaaacaataagctgtggtgcagctacaatagctccgccaactccatagataagatcccagtctttcagaaactgttctccacctggaagctttcttatctcttcccgaaatgcctgtatggtaagatcaggtaatgccaaactaagatctgctgcggcagctaataacaggtacgggtttcctgtagtagcaagagttcctactcccagaataatagcggcaatatctgctgcaatacgcaatctatcgtttattattgcccacttttctgcatctgctaaagcttttacataaattgccggaactttcgtaatcgtagtaaccccatcaaactcttcttcaagatacaccatttctaatggcaaaaactgccttccttcgtccaagtctttgtatattgtttcttgcgtgctgcttttagcaattgtacttaccccaagatcatctgttacgtaattttcttcttcaatgtattgttcctgctgttgttgcagaaaaaatgtttcctcatcagactgaccaaataatcctaaaatagttcccgaaagttcgttaactttagtgtttactctatagccttttttaattttaaaaattggtgcatcttcttttatcgtgtgatgttgtgcgaaagaccgcataattccggcaaaaatgattcggttagattgtggttttccatctacataacttatatcatctaggttataataaatcctgttgcaaagctcaggttcttttttgaaccgattcatgatgtaaccgggagaagaagttttgaagatatttaccaaggcagaacttccgtctttccaaccactaaaaaatccagtatcatcatattctgtaagagtgataagatgctgcatcaccttttcgttatccaatgctattctttcaaaaacaaaatccggagtattggtataaagaaatattaactgttccggagtactcgcttggttaaaatagaattcgtaaattttagaaaaatatccgagataattatatgaagtgtctttttcaaaatcaccgtaaccaacgtattgtattaaatttttaaattcttcataagaaaaagtttccagcataattgctttgtttctacgcagctcttcagtgtctgcatttctgtgaaaaaaatattttaaccggaaatatagttttcttacatttaaatctatatcaaactctatttcattttgtctttggactaaatctacaagttctgtatttttactgagataagtttttaatcttattatgttttctttattgtctttaattgacgtttgttctgcgtgccaatcataattattaacatcatagtctaaaatataataattgaaaagagtatttcttcttcgaagttccgagcacagaaactgtttgttgataaaatcatccgttctccaatcttctaatagcttttgtggagatattagtttttccattttctttgtttttagttgttaaacatttcaattcattcaaaggaaaaagttctttggtgaccatattctcggtgaatttttcagtttggttttcgtccaatatcaaaagctccaaataatattcttcatctgacagaagccttgcatttttaagtttgtactgtacctgtacctgatcaacaatctcagtattcttattgagatatgtttttaatcggatgatattgtctttacgccattctttactgctggtttctctaagttcaagtgtttccataattttttcttttttgaaaaaggcagggctttaaggccctgccagtaattaataattcttaagaaagtgcatctaggttctctttgtgtttttccacaaattcatccagataggaaaccagaagttctgtaaaaccagctttattgtttttcaggagccaaagcatatactgatagcttggtacttttaccagatcggtattcatatcatctccgggttctgcaacaggaagctctataagatgattgtctccgtcacgaaggtagctccaggtttctttatagatgagccattcgggagttgggagaggtatattaacttcttttccggtttccatatctttcaaaacctgctcatatcttaagcagataaactgcagtttagatttggcatcaatatccagcacccggatatgtctttcgaattgtggaagtcttggatgagcctgtagcggcagctctgcaagatgtaatggtgtattttcaatactgttaaggatttccttaatattttctggtataattaaatttttgttcataatttttgttttttaagacaataatatttttccaagtacactcattgttagtgacccttggccgccacttcctcttgagagataaaatctccttggctgtagattaaaggttgaattaaattgctgataagtcacgccattgctttccgcaattacatatacaattccgttataataagcaatgtgaaaggtttcatttctgattggcaaaagatctccctgataaatgatccagcttccatcacctccataatttgaaaaaccataaaatactccatcatctccacgaattccgccagaaaagggacctacgaaattagcaccaaaattactttggctattattaactgaaaaagagaccataaatccggcgttaatatctgagatggaaattaaattatccgtttgtgcagatgagccttgagcaattgatatagaagtatccgtgattgttgaactgcctgttagcatagtccaattagcaattcccgtaaacttactataggtaagtcctgcctttacaatgagttctggtgagctggcatttgttaacccattatgtgtcacgaataccttataatatccttctggttttgtactccagttgatcccaaaattcaaattattgggaaagttatgcatcactgtaaagttatctacactatattcttctggaactgccagattgataccgttcacgtcttttactcttttcactttgatatatgcgttggcagaaacattatctacaaagagatttaatcctactaatgttgtgtactgaataaagttctttgaattatcaataaacgggagcaataacacatctattcttggggctccggttgaataattctcagtagaaagtttcatacggtttctccactcagttttttcagcatcattcagcagcaggggataattggaaatcatattttttccgttactccatgaaagctgcccggacggattttgaaccatcattctgttaaaagttgtgtctgcagatttatcgctcagcccggttatcgaataataaaatccggaagcattaagggtccagttagcaccaagagttaatcctgcaccagaaacactagttaaagaggagtttgctatattttttcccaaatcacctgcaggaagtttagcaacatttccattatcatttaatcctatgattttaggataatcctggacagttccatctgtcagaggaatctctagtttcttagctaatttctctcttgttttgatattatacttagcctggcttgctattccttctgctaaaagatctgcatttgaaatgctgacatggctatcagctaattccaggggaatggtaccatcaacaaccgcatgggtttttaaatcaccgttttcgtcaacggcataatccgtgtaagatagagagccaggagctgctacctggtaaatagcattcgtttctctttctccaatgggaggtaattcattgacacgtataatttttcctataattggcattttttttatttttttagattaataactattttatttccagtctcctgaaataactttctgtccttccagcgattctactccaaggaggttgtcattggattcaaaattggttccgcagatttctcccaattcatcatcaaacttcactcccggctcacagttacaaggcaaagctttttcaactttcagcccaatagatcctgcctgaagaatggtaagagaagtaggaattttctctctccatggctctccttcttttgtcgcttttggtgagtgtaattcatccacaatggataagaataaaggatcatcaataacaggaacttcgcctccattccagatttgtcctgtggcaaggaaatgtctcaccgcttcctcgaatcccggtcttactgtaacaataactcttgccatccccgactgcataaaggctctgaaggtaggatcattatcatcaaactgatataaatctgcccaggattttctttctccccaataatagggatagaaataataactcatgatttcccattcaaatgcctgttccataaatttgataaatgcagcatattgatccagtttttcatctactttaatgtctgtattctgaaaggtttctacagaagcattatcattggtataatatctttttttaccaaacgtgagtaatgcatcaggactctggttcagcatataggagatacagtttcttcttaaaatagtattttctatttttctgtagaatcccggattggatcctttgatctgagcgcctacagcttttgcatctgccaatgcagtttcatatttgctgagctccactttataggcttcaataattttattgaatgctttctgcagccagccatttttatattcttcctgcaatacacatttgatattaaccgttgcatggaaataatgggcatttgttgttgcaatagtaataggaacctctcttacaaattttaaaaaggcattggacgcaccatttcctcctactaacaaactagccccatttccccaaccattataacctgggaatgcattactgctttgcacaacataggattcagtgatataatgctccggaatagcaataagatcagattttgaagaggcttgtttcgactcagtggatgagtaatcaatggattttccaacatataccacaggctccagcttttcatctacttcaacattataatagcccagccagtattttagttttgtagaatctgtaagagcactccagtctttgatttgcatcccggcggattctctcggatcaataggttttaccaattgattttcgatagcattacttaccttcattcctaatgaatgtaattttgccggctcaggaatcataaactcaaacatcattcgctttccatagttaaaaatctggtttttgactactttgtctacccagcggtaaactcctactacatgattgctgcctttggtattatcaaaaccatgtttgttattttcctcatattcttcaaggatcttatcaattcgttcttctttcactttggtgacaatcctttccagggctctggcagtaacatctttagcctcggtaacggcctgtctgttactttcttctttggaactatgagtagcatagttagcagcagtatttaacatgtatcttggagaagcacttcctccccatgatgcgttaaatcctgcctgggctgcaaaatccttagattcctgaagaactttagaaatttcactttgcatctcattcctttccgtggaagttgtatccgtcaatttctctttttcagattccgtagatttagtcgtttgagattcacttctttttaatcttcgtgaagatttttctctatactctcttgccataatattttcgatgtgtgaaacatctccttctacataacagtaagtactttgttctacctttcggtaatctgcaataccaatatttttcattccaaagcctgatgggatgaatggctgatcctcctcaggtgtggtcggggtatctttatttttcagacaaacgcttccttcacctgtcagattataggtttttgttactgaatcgattcctcctgcagtatatattgtcataggaattttgcaggtatatatctgtccgtcatcaagagtaagttctgcttcaagctggcagccattctttatagcatctgtaatttgcaactgaggtaaaatgccatcgctaaacagggatagataatctcctccgcctgctacctgtaattgatttgaggtttgaactacattcccattattatccaatatgttgatagttcctgaagctgatgaaaataacgacgtagtatcttgaggcgtcatgcttaataaccatctgtccgaatagttctgaaaagatctggtccttaacaaaacaggcaaacagttaccggtttctttattttttaatgtaaatgttccagacccttcaaatctgtaaatcctatctgctgtctgcaacagcttccctttcataaggtagacaagaccatcattaagagtaacttctccttccaatagtaaaatctcctgtttttccagactatcatttggaatatcctctccgttactgaataaagtagttacattgggaacatcataagtataagctaatgtaccgcttaccaaaatctgctgatcatacgattttatattataacttccgcttataatgtgtttaggggcgttaatatcagtagtcagaagcatagtatgacttccaaaacccattccccagcggatagttctggcaaaaaatgaaatttcctctgtatttactgattgtgtaacaggaataacaacccctcctaccgttgtagaaacctgcggagtaaggtttgtgttattcaagatcgtttgctgtagctgctggctgttttgttcgatggtctgaaaaagctctgtgaaggttgaaactttattcaatgcgctcaccaaatcaggagtaccaaagattcgttgcaaggactcgttatttccctggcttagttgccgctgcagatcttctgcctgaatttcaggacgaaaattaaaagtaaaggctttaacttccggaacaggaatatattttaaacttgataacccttcacgattatctgccgccaggaaaatttccttctgatattcttgttctttgacaagggcatcgtatctggcctgttcgggccttacctcttcctgatattgtttgtaggcagtattataagccgctgcgtattctttttgataattcttctcaagctgttctaaagttcttttaagttcctcattcccttttaaatttactgtggcttcagcaaatttcaaggcactatcgttaaaaggtatactttgtataatgcttttctctcttgaaacagccctatttgaagaagcagactttgcactaaaaagttccttaggaagaacaactttagcattaataacatcttcatactccgcttgagtaattccataataattggaaagaatatgatccagatgtaaaaattgcattaaagtttcctttgcataaaaatctttttgggtaactacctgataaataagattatcccaaatattagagtctatttcaatgataggttttggggtctccctgtaagccttgattttagcatcaaattcctctttggttgcttttactttattttttgcaacccagactgatagttcataaaattgtatacttttagctttaagggatacttctgtttctattgttaaacctgtgatcttttcacaaacatttttcaaagactctccggcttctactcttgggtcaattactcccttctgtcttagatagtttctgaaaataaatcttttctccctattctttggatcagataattctgcgctgcgcatcgttgcaaatctgaataaagtttgtgagctattattttgattaattgcttccattttttaattttgttttggtattttataaaaggttaagatctgaagctactttttagtagtatgtcttcaggttttagccttatttttttaggtggtttccggcaaaagatatccacccggaattttaaagtcaagtttcattttcgtgttttttcttgaagcaaatatccattagagaagcgacagaactcgtcgtgttaaattttactttagaaaaaaatgaaaccctgattataagagctataatctcatggagaaaacaacaaaatgagtttatagatagtattaatagaaatttgtcaacattgcaaattagcttgatcatcaaaagctagtgcctatttagatagtaaattagaatgatgtttgctaaatattagggttaacaaaaagaataaatattttcagcgattaatcttgcaaaagcacattataacagaaagtatgtttaataaagtctagcaagtactaaatggtaaataaagaaaaatcaaacccaaggtagtttcaattgagaatctacctttacgaggctttctgaaatgtcataaatgtggcaaaatgcttacaggaagcgcatcaaaggggaaaatggggatctattataatgattatcattgctcaagctcatgtggtgttcactttaaagcagaaactgcaaatgagcttcttgtcaaacaacttaagtacctgattccaaaagaaggaatgattggtatttttatagaagcatttattaaaaattttaacgtgcaaacaaaatctcaaaatcaggaaagaacaagtctactgagacaaattgaggaattaaaaaaattgtactaataaaactaagtaattagaagataaattaaataatttatgttctgtccatacggaaatcaaagatttatttaagttcggattaaaacagatagctaatctcgatatacggtatcagaagggcaaacagcagaaaagagacaaataataagttcgatgttccctgaatatttagaatttaatggcaaccaacatcgaactccaagattaaattctgctattcatcttatctatcagaatagcaataaattaaacagtaaaaaaaatgggacaaacctagcttttgtagatttgtcccaacaagtgacccggctgggattcgaacccaggacccatacattaaaagtgtattgctctaccagctgagctaccgagtcggccgcttactttttcaagtaaatccctttgtttaagggactgcaaagatagaaactttttctttatttacaatactttccaacgattttacgcactcaattccgctaacctttacagaatcagagacaaaaattttgaatctgtaacaggtactttgctatagatttttgaaagcatactcatcataaaccgtgttaatgagattatccgaattgatgtttcttgaaaaaattggataatgaaaacgatccagcttattaaggatacggatcagatccatcttttccttatgattgaggttacctgcaacgatattggttgcctggcggatcttttccatttgtttttccagaacaatcagtcctctttcagaaatacggattaatttacttcgtttatccagatcagagtctgtctgttcaataagtccctggcgcaacagtcttgcaataataagcataccgaccggcttatcatgaatattttttttgataagtgccatcttggtcatctcaccaaaagcctttaaattaattaaataaataaaatcttcctgggttgaaaattcagagtctgatattgcggatttggaataggttttcgcgtagcggttaaggtgaaccaataatgtacttattgcgctttccggtgttcttccattctctttgccctcccaatagggttcttcaaaagaatctgcatgttgcgtattctcctgatcagaaatccaggatttaaaaccttcaatagtacagggataggaattaggatcagcatctgattcaaattgctcaaggagcgtcataaagtctttgataagggcaaaattcatttcaataaaaatagtatacaaatatactttattttaggtaaatttcctctattttttattccatacggtacaacatttgcagtttaaagtttaattatcaacgatatgaacgaaataaaaacagacaggttagacccggttacggataaacatctgattgatgaatattttaacctggcagtaaaaaaggaattaaatatcgacattgacgttagttccgaatacattgctgcacataatatcgtttcaaaaaaatcaattctcgttaaaacattttcggatgccgttatgggaaaccctgatctttatcttttacttcgttcgttaattcaaaatgtaaacacttattctttaacaaaaagccagattatcagtacactgaagaaataaaaagaatctctcaaaacttatgagagattcttttttggtaaattgaacttcgttatacctgttctgtgatatgctttgccaccattgcctcaagatcatccagattaaatggttttgaaacataatcatccgcctgtgcttcagaagctaaagcagcaatatcattatttgccgtaacataaatgaccggaatgtgattaaattcttcactgtttttaagaagctttgtagcctctaccccaccgatgcggggaatccagttatccataagaataatatccggctgatattctgctactttctcaaggatgtcatgagatgtttctgaaattttaacatcatagccattttcttcaaatatgatggtgatgacttctaaaatagcagtatcatcatcaaaaattaaaattctctttttattcatattattgaggttattctattacaactgattgatataatccgctaaattatcaggcctgataattaaatcataatcaatttcttctaccgcatgtctgggcatatattccacttctgcagtttcaggatcctgaatccacacctgcccgttatactttttaatataagacagaccttctactccatcagcattggctcccgataaaagtattccaaccatatgttctccgtaaatttccgctgcagacctgaaagtaacatctatggaaggcctggaataattcatcttttcagagctgtccagtgacatatttttcttattttcaaacagtaaatggtaatcagcaggaacaatgtacagggtacggttattaatttcggttttatcttctatttccaccaccggtattctgataaactgctgcagcaaagtccgcaggatatctccggattgggctttacggtgaacgaccactacaatcggaatattcaggttgtcatcaagatttttgatcatttcgatgatgacctgtaagcttcctgccgatccgccaataacaattaattcaatattcgtctctgatttcatgattgcattattaatggtgatcaagctttttccagattttctggtcttcagtctgatgataattcttttcaatggtagaaaaccgaagtgtttcttttgccccgagagcaagaaaaccaagattttcaaggctgttgtcaaaaagtctgaacaccctttcctgaagttctctgtcaaaatagatcaaaacatttctgcagataatcagctgaaaactgttaaaagaactgtctgaaaccagattgtgagtagataaaataagcttttcctgtaaacttttatcaaacttcacactatcataattagcggtataataatcagaaaaatcccttatcccgcctgaaagcatatagttttcagaatataatttcatctgatgcagcggaaagactccggctcttgcggtctcaagaacagcaggattcaaatcagtaccataaatcagcgatttatcatacaagccggcttctttcagcagaattgctatcgaataggcttcttcccctgttgaacaacctgctatccagattcttatcaacggataagtacctaattgcggcagcactttttctcttaatgctttgaaaaaaggaggatctctgaacatttcggtaacgtttaccgtaacttcttctataaaacgtttcagatactccggatcgttcatgataatatatctgagctctgcaaaactggtgagcctgtccaaaagacatattctgtttacccttcttttgaacgacgctctgctgtagccggaaaaatcatatccgtacatctcatatacatcgttgatcagatactcaacttcctgatcttttatgatacttggttccagcatgtattacaacttttctattgcttttattagaagatccacatctatcggttttgaaacataatcatccgctccggcttccatacatttctgacggtcttcaggcattgcctgtgcagtaacagcaataacaggaatatctttgatttcaggggtatctcttatgattctaacggcttcgtagccatctattccaggcatcatcatatccataagaacaacagaaaactgagggtctgatttcaggatatcaaaagcttcctgagccattgtacaggtttcaacagcatatccacgggccttcagggtcagtttcaatgcaaatatattacgtggatcatcatccacaattaaaattttcttactcatcagaactatatctgtttaactttcatataaccaaacgcgaaggagcgataataactgatcaatatctacaggttttgagatataatccgaagctccggcggtaatgcatttttcacgttctccaatcattgatttcgccgttatagctataataggcagtcttttaaatgccggcatttttctgatctgctttatggtttcataaccatccatttcaggcatcatcatatccattaagataacatcaacatcaggatggtgattgatctgctcaagggcatgttttccatccatcgctacaatcacatccaccttgtatttttccagtgccttggttaaagaaaaaatattgcggacatcatcatcagtaatcagtacttttttaccacttaacacttccgtcagagaacccagcattcttcccgtattgttttctgctgaattgtttttttcttccaccagatgcaggaacagcccaacttcatccagaattctctggtacgaatgtgctgtttttactacaattgaatctgcatactgttttattttaagttcttcttctttagaaaggtgatgctctgtgaagataatgatcggaagattttcaagtccttcatggcttttgatggattctattacgtggtagtcatttccttttgaacttccaatgtccagaataacgcagtcaacaagatctgaagtcagtgttttcacactatcttccacagtatgttctactgataatgagatattaaaattgctcaggaagtaagataatgcgctggcatgcttggcattttcttctacaataaggactttctgagatccttttttcaatgcttcttcaatttttctgaatacatcagtcattttatccagggcaaccggcttattgataaagtccactgcacctttcatcagactttcctttttgagatgaagaacagacatcatatgcacgggaatatgttttatatcggcggcagacttcagttcatccattacctcccagccatcttttacaggaagctgtacatccagcaaaatagcatgaggacggtatttctgagctgcagaaagtgcatggtctccccttactacaacaatacctttataatgctgtaaatgtgcgtatttcaataaagcttttgcaaagttgatgtcatcttcaatgatgagaataactttatccccttcttgaatattttctctgtcatctgccacatcttcaggaatttcaagtgtattaagaggagtcacttttatttcgccttcatccaggatattctgaatttcttcaacatcttcacgaatgacctctacaatatcctgatctgtttcggaatgagtaatttctgtaacagcatgtacaggaatgataaagctgaattcactgcctttgtctacttcgcttttcagaacaagttcacctccaagaagtctggcaatttcacggctaattgacaaacctaagcctgtacccccgaatttgcgtttggtagagccgtcggcctgctggaaggcttcaaagataattttttgcttatcctctgcaatcccgacacctgtatctttaactgaaaatataataaaatccggtttttcagtgtgttttctgatatgcaggtcaatgcttcctttcgtagtaaattttaatgcgttggataatagatttctcaacacctgatcaattctaagacggtcgctttcaatcaccttctgtacatcttcatcaatcacaatgttaaacggcaatgctttttcctgaaatacaggattgaataaactctttaaatcttttactacttcttcaatgatgaccttctgatattccagggtcatttttccggattctatttttgcaagatccagaatctcgtcaataagtgttaataaactcgatcctgaactatggataactcttgcagattctacctggtcttcattgagattctcatccggattttccgtcattaaacgtgataaaagaagaatggagttcagaggagtgcgcaattcatgagacatgttggccaagaattctgacttgtatttggtacttaatgccagttcctctacttttttctgaatctcattgttacgttctgcaatcagatgatttttttcttccagcaatctggaacgctcttcaagttccgcgttagcctgcatcagttcttcctgctgcaccttaagttcttcttccgaagcctgaagtttctgtgtttgagcctccaattcggtattcaggttttccagctcagaatgctgaacctgcagttcttcagactgtgcttgagtttcttccagcaactgctgttctttttccctgctttttgcagcgctgagggcaattcctatattaacgcagcagtcctcaaaataactcactctgtcttcatcaaaattagaagttgagccaagctccaagactccgataatatgaccatctgcaaaaagcgggatcagcatgattccgtaaattttaattgtactgctggcaaaggttaccacgaagtcatcttcatgaaggttattgtaaacctgtgttttagcactaacaaaagtttgtcctaccatcccttcgccaggctcaaaagctcttttcatattggattccagtccgaatgccttgttaagctttaaaataccttcatcatacagatacaatgaaccgttgatacagttcccatattcaatcagctgcatcaacgccttattggaaacttcctgaaccgatttggttcctaccagagattcattcagtaacgcaagacctttctggcgccagtcgctcttattaatcttctcaaaagagattttgagggattctgtcatatggttgagagattctacaagatctccgagatcatcctgagcattatctactgcccgttcactgtaatcaccgttagctaccctgttcgcaattttctgaatagcacttacacggcgtgtcatttcttcatctttttctttaagcattctttccagcttatccctgcggataagatctgcacgcatcttcagataaaaaaacgtggttaccacaatggcagcaatggccgaaaaaattataaagagaacggttgtccctgaggagcggttaagatctttatttttaatttcaagctgactttcttcatattgtacaaaatcattgacaatcttacggcactgatccatatatgccttcccgtccgtaatttgctgctgggtcataatgatgccctttcgtctgttttcaaccagttgcttcagattccccatcaccttgtcaactgcaatctttaatcctgcaagtctttctgattgattctggtcatctatacccaaagattcagcacgtatcagggcgtttggatattctctcaatccccgtttataaggttcaagaaaatcttctctaccggtaagctgataccctctgtttcctgtttctgcatccagtaaagcaaccagcacatctttaactgctgttacggaacgcctgcttttagaaaggctttcacggtgattcatctgattccggatactccaataggaagccagtgagctggctatcaaaatcaaaagcgaaagacctactccaaactggagatttcgtataatttttttcggcattaaaattaatttagtggtaatgtgaaataaaaggtagaaccttctcctacgatactggaaaccccaacgcttccatgatgctgtttgatgatctcggagcagataaataatccgatccccattccctgaaactgcagtgaagattcttccacgcgatagaattttttgaatacagcatcctgtttaaaatccgggataccgattccaaagtcggttacattaactcttacttcttccgcttcttcatctacaaaagtggtaacaataacctggttattatgaggcgaatatttaatggcattggtcagaaaattgatcagtacctgttctatacggatttcatccagaggaattaaaatatccggtttggttccgtggcgttcaatttttacctgacgctggtcatgagtctgcaatatggtttcaatagcattactgatgacactttcaagattaaccggttttttattgattttcagttttccgttttctattttagaaacatccagcagatcggtaataagcgtattcagtttctcaatctgcccctgcactttcgttacaaatcctgcttcagagctttctttatcaagctttagttttctttccagtaattgtacataggctttaatgcttgtcagaggagtcttcagctcatggcttgcaatgcttaagaattcatctttttctttttcaactttcttctgatcatcaatatccgtaaaggttcccacccattttttaatgcggttttcatcataaaccggagttattctgagcagatgataacggtaatgaccggaaatgacattcttaattctgacttccatttcgagggcttttccctttttccggcatctcgccagttcttcctttatattcagatcatcaggatgcgtttcgggaaaatccagttcggaatcggaatactggtaccatttaccattaacgaaatccacagctccggattcattgagagtgaaggcaatctggggaagtgactcaagcattaagtgaaaatgatcaatctgtgacttcatggtgacctgagactctcttcttccttttacctccagctcaagattctgctgtgtctttttcatggcaatgttttgctcctgaaggttatagaaagtctttaccttaagcagaagaatttcaggatcaacaggtttggtcacataatctttagctccggaggcatatccgcgtgttataaagcgtttatctgtattgacagcagataagaatatgatggggacatcttttgttttgctgtaatcagcaagcgtttctgcaacttcaaaaccgtccatatccggcatttgaacatccaaaataattaaggcatagtcatttttcagggctttaccaagagcctcttcaccggaattggcagtttccacctgaaaatccttagattcaagtagtttttgcagtgagtaaaggttattttggttgtcatcaacaattaaaatcataaaaattaaaatcaataattagttacagctagtttagtttcaaaaatactcacaatatttgagaaaacagtaatttttaaaggtatttggaggtataatccataccacacttttcaaataaaatttcaatggcataaggattgaaatgttattactatttttaaaactttcttcataattttcagaaaaaaaacaagcctatgaaaaaaacgataagttgtatgaatatagatgagaaaattttgtattcattcggcggcgaacgggttacttataaacctaaagatttcattttccgggagggagagcattcacaatattatttccagatcataagcggaaaggtaaagctgaacaccttcaacgaaaatggaaaagaatttattctgaatattcttggtaaaaaccagagttttggtgacccattattgtttattgaaaagctttatcctacgaatgccgtcagtttacaagctactgaaattataagaatgcctaaaagtaacttcatggaaatgcttcagcagcatcctgatctttcccttgaaatgaatatatgcctctcccaaagattatactacaacagcctgatgatccataatatggcttcctcagatccttctcaacgtttaaaaggcttactggattaccttaaaagttatcatgacggagattgccaacactgtttccctatagagcttacccgccagcaaatggcagaccttacaggtttaagagtagaaacgatcatccgaactgtgaaaaagatggttaagaatgaagtgataaaactggacggacgtaaaattttgtactaatcaaacaaacgaaaaacactcaaatatagaatacaaataaaccacatttataataaatgaccagagcatcaagaactctggtcattcatcaaactaactttaatttgttttctttctccattctgccttcacatcttctgcagcatcttttgtcttttcccaggcttcatccgctttatctttaatgtcgtcccaggcatcagaaatattggatttcactctttccatccagtcttcctgtgttgcttcttcatcattatttcttttttcattgatataatctctggctttatctgccaggtcactgattttccattttgcatcggtagctgcattcttcagcgtattttccgtttcgtttactgcattttctgctttgttgtaatctgaattattcataatataatatttaagtatttggtatataaataaacaatgttcatgcctaaaaaacagacattatgttaaaatattcttaaaattaaaaatgataagaattttactttttctttccacttaggcttctgatcattccttggaagataactccatggaatggcagcaccataaaccaatacaatctgccccaaaggccttttggacgaaataccgctttttgccagattttatttctgtaaattttaaacatcagccaggcttctcccggcagcttcatctcagcgaataatataagctttccttcctgacggtcagcatataaaacccgccagaagtctaatgcatcaccatctctaagttctgaaggatgtcttcgtccccttctcaatcccggaccgccaacgagtttatcaaggaaccctcttattttccaaagatcctgtccgtaccagccatgatcacctcctaactgaaagacccggttcatgcaggcttccctgtcatcaaactcttcgctccggaggtcagtaaaacaaccgtatttcggtacatcatggtattctttcaatgttgaatcattacggctgctgatgaaactgtctttccagctggaaataatctcattggcctgaatttttgcaaatgttcttttcaatgctgtatcataggaaaacggctgcacaccggtaattaatttgatttcagcaagactttcgggacggcagaccacttctactttcatgcttccaaccaatgctttagccaggttataagaggttgaagtaataaaatagagccagtatgaagagagtctgggcgtcattacagggagtgtaaaaattgttcttttcaggcctcttacttttgcaaactgcaggagcatgtctttataagtcaatacatcatcacagccaatgtcaaaatttttctgataagcagcttctttaaacaaaacgaaaatcaggaaatccagaacattcgcaatccctatcggctgacattgggtatagagccatttgggagctaccatgacaggcagcttttcaacgagatcccttatgatttcaaatgatgcgcttcctgaaccaatgataattcctgcacgaagaactgttgcgggaactctgcaattcatcagaattttttcaacttcgtatcttgaattcagatgctttgacagttctttttcattcaccaagcctgagagatatacaatatgtttacattgcgttttctcaatgtaagcggaaaagttggcggcacatttcttctctgagtcttcataatcagcagtattgctcatggaatgcatcagataataagcccctgcaatatcttcgggaatatttttaagcgtttccggcttcagaaaatcaacttcaataacttcaatgagttgttcatcgatatccatgtctcttgtaaaacggcctatgtccctgcagcagcaaacgactttatatccctgcgcagcaatcacgctgatcattcttttaccgatatagccggtagctcctgtaagcagtattttttccataattattggatttaacagatcaatacatatgctgcctgtctgaagttcgttatattttttctaaaaaatgaccaaaatagtctttctttttaacaagatagcctgcattaatctcattggaatcaatttccaaaggaatcctgcttttgagaatgatactgctgttctcaacagatttaaccttgtcaggattgttggttaaaagattaatttccttcacatgaagcaggttcagcatttccactgccgcatcaaagtttcttccgtctgccggcagacccagcctgagattagcttcaacagtgtctaacccctgctcctgaagcgcatatgctctcagcttattgatgatcccaatatttcttccctcctggcggagataaatgatcattcccccattttcagacatatatttcatggctgcatcaagttgctgaccgcattcgcattttttagaatgaaaaacttccccggtaatacactccgaatgaaaacggacattgacagttttattacaatctgtattttctgctaccagaaccaaatgcgggctccagtctttttcattttccgaaaacgcatatacggtaaatgttccgtaatctgtaggtatttttgattgtgcctgtatggtaagcataggtttcgattttaatttaaggttgagaatctatttgtcaaaaggatttttcttatcctgttttacccagatgagttcagaggtatcatatccgatttcctttgctttggaaataaagtcctgttttatattttcaggaattgttttttcacgggaaagaatccacagatactccaggttttttccggctactaaagcatatttgtaattttccagcgccactacattatatccggcatagaacggtccgaaaaagcttacctttaaggcagctgtatttttgtcacctctgaattttgctgtcccgttggccgacacccatttttcctttttggtattatacccgctgttgacgacattaacacttccatctttattaagactatactgagccatagcattgtcgagatctttttcaaaacgataatcaaatctggcaatttcataccatgtacccaaatatttattgacatcaaactgattcacaggttgtgctttttctggcatagaagaacatgatgagactatgaatatccataatccacaggcagcaataagtttaagaattaagttatttttcatttttagtaatttttttaaagaaataaatattcaacagaaactggctgtaaccatatacagcatcttctatgggaatggtgcccattctgattcctaaaaattcttcgggattataattaacaaccggtgatggaattaaagatcctgtcaggattccattcacagcaaaaaatccaggcattaaaatcagatagaccagactggcttttcctatccactcttttttagcaataaaatgaaggtagcataacgtgaagattgtaacaattacggtgagcaaagtatatattctgtcacaatacagaaaacccgttaccgcgagcgcaataactgatgtaaatacgatgagattattaaacatgtcagcccagtccatattaaaaaacttttcaaagcagtaataggtaaaaacacaggcgaagggaatacaataaaaaaacagccattcttcaacaggaagccctgcaattttaaatcctaaggtgtacctgagatcaaaccaccacactcctttaccggtaaaccatatatcccagataataaaaggaaccgccacaatggtagatgatatcagaaacttcccgaaaagcctgttaaactgtatccttccgtcaaaagaagccagaaagcagataataactgtaaaaaaattaatcagtatgtaagtgtagggcatcattttttatcgaaatacattttaaaatattgaacaggcacccataaaaagccgaagcattctcctttttcttttcccagatgcttatgatgctgtttgtgggcacgtcttatcgcaagcaaataaggatttttggttttggtaaaaatctttgctctctgatggataaaaatatcatgtacaaagaaataggccattccgtaaagacttattccgaggccaatataaaaccaataactgaattcctgctttacccccagatataataaagctatggccggacttgcaaaaatgaaaaagaaaaggtcatttctttcaagttttccttcattgctgtggtcatgatggtcacggtggagcacccacaggaaaccatgcataatatatcgatggatgagccatgtagcaccttccatgccaataaaaacacccaaaacgatcagaaaattcattgttaattatttttgctgttaaaacgatcattcagaattctgtatctgaaatcaaatatgctgttcagtttttcttttatgaacaagctatgagcgatccgacctagaaaacccaacggaagctcataatctactgtatctttcatcaatactcctttttcattgggaataaattcgtgaaaatgattccagtatttataaggtcctgattcctggaaatcagtaaaacttttaagttcatctacctgtgtgatgatggttttccatctcatgggaatccccagcaaaggagaaacacgataattgatctccattcctttgaaaacaggcttatccttaacatctgacagcacaacaaaattcatacttgccggggttatttcagataaattatgaggggatgaaaaaaacttccaggcggtttcaatggtacagttcaactgctgttctctgtataatctgtatttcattacttattttttattctagattttccaatgaattaattaccatttttaccatcacagataggcagatttatatcttatatagcttttgaatgctaccagcagcttctgtgaattcgcaatcctgatcctgttctgtaaaatgtgatgagaactggctttctttattttttcaaacaatgacaggtagtatttataagccagataaacaccaaacattgaagagccgggcagttttttaatcccttgtaatgcttctctgaactcttcgtcaatttctttttcaatccggactttcacatcattatcgaaaacagacatgtttaaagctgggaaatacgtccgtcccaatatctggtaatcatctttgagatcccgtaaaaaattaactttctgaaaagcggaaccaagcttcattgcatatggtttaagctcttcaaactgttgtttatttcctccggtaaatatttgcaggcacataagtccgacaacttctgctgagccgtagatatactcattatacaaagcagaattgtaatctattttttgcaggtccatttccatactgtgcaaaaactgattgataagctggatatcaattttgtactgacgaaccgtttcctgaaatgaatgcagaatgggattgatcgatataccgtcttccagcgcgctgtaggtttcagcttttaacctagttaagagtttttctttatcataaccatgaaaactgtctacaatttcatccgcaagccgtacgtaaccataaatggcataaatggcgggtcttatggaaggttttaatgccaatatccctaatgaaaaactggtactgtatttccgggtagtatatttgctcacctcgcaagacaactcatcaaacaattttttcatattaattaagttttagtttactgacttcagatgctacaattttaccggaaataactgatggcggtactcccggcccgggaacagtgagctgccccgtataaaaaaggttcatgatctttttattcctgatttttggcttcagcactgctgtttgggataaagtgttagataatccgtacgcattgccctgataggcattataatctgaaataaaatcacttacacaataactttttttgtattcaatccttgaaataaggtgactttcgcctgtatgtttttctattctttcgagcatttccatcaggtatttttccctcaccggttcttcatcatgaattcccggagccaaaggcaacaacagaaaaagattctcgcagtcttcaggtgctacgcccggatctgtttttgaaggacaacaagaataaaaaagaggttttgcaggccattttttatttttataaatgcagtctatatgattatccagctcattttcaaagaaaagtgtatggtgttttaagtgaggaattttacctttaattccgagataatatataagacatgaaggcgcaaaggttttggattcccagtaagcattcttgtaattccgaagggatttgggaatcagggtttccgtatgatggtaatctgatgaggcaatgacggcgtcaaattcataatctttatcatttaccctgattgaggttaccttcccgtcttctgtattaattttctgaacatcatgattaaaataaaacacaactccttgtttttctgccaccttctgcatcgccagaacaagctgatagaagcctcccatgggatatttcgttcccaagacatatccaccataattcataaggctgtatagcgccggtatattctggggagaagctccgaggaagatgacaggaaactccattaatgaccttagtttttcatcagaaaaatatccggatacatattttcggaaattactgagaagatccagttttacagcacttccagctatttttaaagaagcgaattccagccagctgtagcagggtttggtaacaaattctttcattcccacttcatatttatattttgcagattccatgaatttgtcatactgcttacctgctccgttctcaatcttttcaaacagggctcttatttcatcattctttctgggaacacagatcttttcgcctgaaaaaaccatttcaaattgaggatccaaagccacaagtttaaaaaaatcatctgccttcatattaaaatccctgaaaaaatcttcaataatatcaggcatccaataccagctgggacccatatcaaaaacatatccttcttcagttgtaaactgtcttgcgcggccaccgggctgatcgtgcttttcaaatacatgtacttcatttccggatttagcggcataagcagctgctgaaagcccggaaaaaccagaacctataacagctattctttttctcaaattttccttattcattgttattgatttatcagttgggacaatccggcttaattcagttttttataggctatatccagcagatccattgcttcaagattcattttgtatacagcatggtgaaattcatctaatttggaaagtatggcgatgagcagcattttctcggaatgattgagatttccggtgaccatttttgaggctttacggatttcatccatatgctgatccagcatcttaaggccttcttcagttatctgaatatgtttggctcttttatctttttctgaaacagtctgttctatccagccattcttaagtaaacggttaatgatgagtattcctgcaggtttttcatgaacattatgtcttatgagttccatttttgacatggctcccatagatttcaggctgatcagataaatgaaatcatcctggctggaaaatcctgaattattaatggcagacttagaataagactttgcatacctgctcattcttatcaacaaagtattgattacgctttcttcacttcgtcccatttctttacctatccatccgggctcctctgagagataatgttctttatgggaagattcgatccattctataaaaccctgaagattgttgctgtaaatagctttttcttcattttcatcagcgaattgcttaataagttccacaactgcttttataagatcataattcatatcaaacaaattagtatacaaatatacttataaaaacataataagtatataaataaactatatggattaaaaaacaaacacacaactcattgatttacagcgtatttatttttaaattaaaagttgttaattaagaaatatgatatatttataaactttacagggatgtttaaataaaacctggatttggtaagctatcggtctgctttgattttcagaccataagaaagctgaagaatagtatggtgattatgatcttaaataactgttactatgatcattaattaaccttaaaatatttttttaatttaaattcgtattactttgtgtaatggaaagccaaacggaatggatattaaaattctataatagaaaattatgtaacagtaaatatgagtatcactttttataaaccgaaatcagatctgttaagccggtatattgaaggcttttattttatttctgagcatgatacgttaaaatcaaatcaatattggacatttcccagtaatttctgccttgcaacgatttgtcaggacacagagttaattcctgaagaaaacaaaatcacaataagaagatcaatccataaaagagtgcattcatttctcttttacaacatttccaggccaattaacgttacttacgaagagcctagaaatgaactgacgatatatttcaaacctcttgctatttttcatttctttcctaaagtgtctttttcatcagctgcagaccattttgagaatttcaatccttaccctgattaccaatctaacattcaggatctgttgaaaatgaataacaaagatgaacaggcacatgtgttagaaaaatatcttctctccaaactttataatccgaagcttgaaacgatgcaaaacattctgcaaaaagttgaagaaggatggaaattaaatgacattgctgaatctatgggtatgtccaggcaatatcttcacagaacatttttaaaatacatgggaaagtctccctctctgtataaaagaatacaccgcttcagacagattacttcttctctgcaaacgaatgaaaaattcatttcattatcgcacgagaatttattttttgaccagcctcattttaacagggaattcaaagcgttaacaggtgtggttcctaccttatttttcaaaaacattaatgattcaaaagatatgctctggctttttgtttagtggtttacattcatacaatgttcagggtattggtatttataattttgtacatgaacaatagacaagagatgatcagattactttttattctttggggaacattagcttttggacaatcggttaacctgtccgtcataaggaaacaactgcgtattcttgagaaggagaattactttagcggtgttgttttgattgccaaaggtgagaaaacgatctataagcacgcttttgggtatgctaatatggccgacaaaattcccaataaagcagataccaaatttaatttggcttctatgaataaaatgtttacaggattagccattatgcaattagccgaaaagggaaagatttcgctaaatgacagagttggtcaatatttacccgaattccccaataaactcgtagccgattccgttaccattcatcaattattgacacatacttcaggaatgggaaacttttgggccgaacatgacaaactagcgaaagaaaaatttaaaacggtaagtgattatttgccgctttacgtgcatcaggaattactattctctcccgggaagggttttcaatacagtaattcgggatacatggttttaggactgatcattgaaaaagtttccggattaaattatttcgattatgtaagaacttacattttcgaacccgcaaaaatgaaggatacagattcttatgatctggaagaagcaatcccgaatatggcaacaggatatacaatgctatcagaaaaaccaggacaatggaaaaacaatatgtatagtaacgtagtcaaaggcacgccagcaggtggagggtactcaacagctgaggaccttctgagattttctctggctcttcagcaaaacacgatacttgggaaagaatttacaaagctgtattccattggtaaagtgcaatataaagaaggttcttacgcttatggtatcgttgagagctttttaaatggtcaaagaatgcttggacatacaggcggacatttcggaatagcaaacgaactgatgattttcccggaatccggctataccgttgtaattttaacaaacggagaagttgaaaattattgggaagtttccaatctcattaaaaagcaattaaccggaagtacaaatgcaacagataactttttctatacaaaagatcttatccggacagtggaaaaaagtggtctttctgccggaataaaaaaactagaagccgattccaacaaaaaatatatccttaaggagaatttaatagaaaggtatgggcaaaagtttctcttcgaaaaaaagtatactcaggcaattgatctgtttcaactgtctgcgactcagtttcctgattctgccacaccttattacaacctaagtgaagcttacagattagctcatcaaaaggaaaaagctattgaagctttgaaaatctatttaaagagagaaccgctggataaggaagctgaaattaagtatgaaaatttaaaaagcagtaaatagtaattaaggatagtcttactatttttcccaatgctgccactaaggacaaaaacaatcatattcatccataaaaaaaagagacaactttaatagttgtctctttcagtgacccggctgggattcgaacccaggacccatacattaaaagtgtattgctctaccagctgagctaccgagtcggccacttattttttaagtaaatccctttgtttaagggactgcaaagataggaaaacccacgttaaatccaaactttccggcgcttttttataataaattttaagtcaaaaaagtcaaacacctgtttataaatcaattacactatttatttttttattgaattttttcagcaataatcatagttgacagataaactgccatttttgggtaaaaaattgtttggaagaataaaaaacaaattatatcttagcaactaagataattacaaaataagtaaattaatgacaaaatataatattcaaaatttcagagaggccagcagagcctattctgatgccagtatttttatgcacgaggccattgccagaaaagcggggctttccagtaccgatcataaatacctgggccttattctacagtatgaatcggttaccgccggcgaaatttctaagttcacgggccttacaaccggtgctgtaacaggcttgatagatcgtctggagaaaaagaaccttctgaaaagacagtttattcaggaagaccgaagaaaagtgatcattatcccaaatgttgagaacagcatgaaattactgggccccattttcgatgaactgcagcaaaaaacacttcgcttaatttccaccttttcaaaaaaagaagtagaaaccattgagcgctatttcagggaagcaacaattcttatgaaagaaacagcagaccatttaaataaccaataaaaactataaaaccatggaaaacttagccacaacttatctaacgcgcgcagaaatatggctttgcattacgaccttactctattttcttatgaatggcgcacagatttttgagacgcttatttttgttcccaaatgggcctcttccccacccgagacattcaggtttcttcaggatggaaaaggggcaagcctgaagtttttctggattatactccactcattgcatgaaatagcttttattcttgctattattttctgctggaaaataggtccggtaaggaactggcttttagtattatttatcattcatgccgctgtaagagtatggacacttactttttttgcgcccaatatcatccagtttcagaatctggcttcagcttcttcggttccggaacaaatcttaacaaaaatatcgctttggaaaacgcttaactatattcgggtagcagtttatattgcggtttcaataggctttattcctctctgcattaaacttttcgggcttcgccagtgatgaactggccacagtgtttaaaatataaaaaaaagagactgccttatcagacagtctcagcactctactataaaatcagctgataagctatacttttcattaaaacttttccctacgcaggtgaaagtcgacgtgacttcagataaagggcagtacggttcaggtaaggaaaaagaaaaatcaataacagtgacgcagcaagaagccacaccatcatttcataataatccattgcaaaacggacatgatcctgaacattcatccttccaatcaacagcttattggccgcttttacggctttaccttcaggcattcctctcgcaacaagtttagcggtctgctgatgaagaaaatttttaacagccggatccacagcacttaaatgatcctgaaatgcattataatggcggcttttttcaaacagttcaaaaaaattgatcagtgcaatgctgatacaaaatccaagataccgtactgccagggctgttgcagcagctgaggggccaatggcagcaggaactgaggagataataaaaataatcgtcgggaccataatcaatccaacacccaatccctgaatgaataatggaatataataattaaactcatcagcctgaacatcaaaagagtaatacattaatccatggaaaataagaagcattaaaaatccgggaccccagatatatcttatatttttcttctgtaaaaccatacagcaggcgataatcacacctgtaaccaatcctgcaagattgaagatattgatataggaaatatgaagcggatccagatgcagctcagatgaaaaatagctattgacaattcctgatgcaaaccggcagatatacatcacaaaaaggatcagcagacctaccttaaaatttctgtacctgaaaacacgcagatcaatataaggtcttttgatagcctgctgacgaaatacggatatcaatgccagaacagcaattccaatgatacttcccataatccgcctgtcttccagccaataatattcctgtccgaaaatagtaatatacccaatcagcaccagcatcgtactgaacagcccaaaactttgccagtcaagcttgtacagatgaaaccttgcatgcgttctgtaattgctcatggccagtgcaagaaagataagtcccggaaggtatgagaatatggctgtcttataaacgatattaaaattataggaatcaataagatctgctgtgatcagattattaaagggcaaagcgcagatcagaatcccgaagaatactgaaaagctgatctcccgccctctttcactgctcagccttgtaaaaatgagcgtcaatgaaaggtttacgtttcctgcaaacaacattccctgcatgaagcgtatcggaaacagtatatagatttcacgtgtacaatagcataccaggcaggccaatatttgcagcgtggtaaaaagcagaaaatattctttcgcagccaggaaactgaaaaatcttctttcaaggctgtaaaagcctacatatccggcatagaacagtgcgactgaaaactggatatctgccggctcacttccgtaatatccggccgctgcattcacattcgcaagcgggagaaaaaagataatgatccccggcagtgtcattgaaaaaaggatgattttaacaagccattcaggagcccattttttaaaataaggcatctgtcttttagccattggaatgttttttattggcatatacatttacattcattcctactttcagaatatcaatgtcttttctttgcccatccaccctgattcttacaggaatacgctgcacaattttcacgtaattcccggtggagttatccggcggaagcaatgagaagcttgaacctgttgccggggaaagtgaaataatcgtccctttaaactctctgtcaggataagagtctgctacaatttttacatgatctccgatgtgcatgtccttgatctgcgtttctttataattggccactacccatttgtcggtttcattattaactataaatgcaagtgtttctcctgcatcaatcatctgccctacttcaacggttcttcttcccatccttccgtcatatgctgcagtaacggctgtatagctcacatccaacttgtggcggtccagcaacgcttccaatctggcaatttctgccaggacaaccgttttttccgcccggatatcatttattttagacattgaagctgcataattatcctgtgaggatctgtaatcactttcattaatgtcaagagttgcttttacatcttcaagacgctgtctggtggcagattcttcatcatacagttttttgtacctgttataatcaagtttttgtttccaaacctttgctttattggcatctacctgatccattgctgcggcagcttctttttctgtagtttctgtagtactttccaggactttcaattgcgcgtaggctttacggagggctgcctgcgtttgtttttcctgaaggacatattcacggttatcaataattaaaagggtatctccttttttcacttcctgattttcctcaaattttacagcgacaataaatcctccggctcttgaaataatcgggtttacatattcctgaacctgagcatcattggtctgttcatatgcataatagttctttaaggtgaaaccgccccagacagcaagtgcagcaacgatagcaagtgaaatccatcctgtgatcttcgtgatcagtctgtccgttggagtatatttttttttcattgtattataaaacgcctgtaatattttgtagtaaataataattgttctgtgccataatctttgccgcttccagttcaaattttgtctgaagaagctgtatatctgcatccagcagttctgtaataagggaagtctggctgaagtaagtatttttgatgattcttgcattttcctttgcctgagctacattggcttctgccactttgatctgttccagagcttcctgatatctcagataggcttcctttacctgctgtcttactttatcctctgtatctttatgtgcctcttcttctttttcaaactccagctgtgccgcctttaccttttgcgtattatgatacagggaagagatggaaaacgaagcttttattcccactattcccaacgaataccaatatggattgtaaggatacaggaaaatctgtggattggcgtaatagaattctccatacatcccgactttaggtcttacattggcttttacctgcttcagtttaattacacttaatgcggtctgctgctcagaaacgtggtagtcaaaagaatgatccagcgccattttcaaatactcattataagaagtattcgcattccactgatcagatggtgcttcaggaataacaatctggtcatctggaattcccagaataatattcagcttttgtgtagcgataaggatatcattttctatagtgaccaacgccattttcctttttgaaagctcaagttcaatccttaaaacatcactttttaaaaccactccgtttttataaagcgactgtatttctttcagctgggttttctgatcttcaatatcctgcttaataagatctctgaagattaatgttttctgcaactccagataaagtgcagctgttttataatgaatatcagaaaccgactgctctttcaggatgtccttaattttctgaagggtttggttttccttaattttcagattcagcttgttcccgttgtaaatattcaggtaaaaatccgctccggctctgtacagcgtgtggatgacttcatgctgtgcaggtttcgaaaaaatcccgttttcatagatgggaatgttggaggctttttctgctgaacctttgatttctatttccggaaggcgctcttttttagcatcttttacttcggcttcggcaatgtctgcattgatggtattgattctgatatgacggctgttttcttcagctctctgccatgcgtcttttaaggagagtcgaatggtatcccttgttgaactgcctgtctgagccgatatggtataggaaactcccagcatcagcagtccggcgacataaattttcatttgaatttttgaattattgcactgcaaatttattggcaatccggagattatttttatctaaaatagtcaacttttacatgattccggccaaatgattatatttgcgttttcattgatattttaattttttatgggattaattgctgcgcttccggatattgataaagacgataaaagtgtatttgtcatgcatgagaaatcggaaaagctgattccttttcataagcataccaaaggacagctgagttatgtggaagggggtatcgcttacattaccattgataacaaaacctatgtggtaccggccaggcatttcttctggattccgcaaggaatggaacatattttggaaatcggacacactgcaacggtcttgcgttctctttatttttatgctcatgatgatgtttcagatcctttttacagcagactgggaatttatccggcctctgaactgctgatccagatgataaaatatactgaaatatgggatgaaaaacatgttactgcaaaagatgaaaactttgaatttcttgtggcattaaaaaaaatccttcccaaaacccatcagcagccattacctattattcttccggctactcaccataaacagatgatgaaaattgtatcttatctggaatggaatatcggggaaagacttactctggcccatgtaagcagcaagttcggtttgagtgaacgttctttgtcccggctgttcaaagcggatatggatatttctttcctgcagtacctgaaaaccttaagaattgtcaaggctattgaactccttttaaatacggacaagcccatcaatgaaatagcagacgatgtcggttacagctctatcagtgctttcagcgatacttttcatgaattcacccagtccagaccttcggatttaaggaagagcaataaagccattcagaaccttacagattaaattgattctgaatgaaataaaaagcctttaaactgattgtttaaaggcttttctctatcattactgtgtcactttcattatcgcattggtaatctcaatttctttttttcctgaataagcggaatcaaaaggttccataacattgaataaatactgataaaaaggagcaatctgacggacattttcggattccttcactgctttttctttccccatctgctgaagtccctctataaaaacattgaattttttgtcaatgggctccatcgattttaaaaggtatgcatgcgctttttcattttgtcccaagcttttataagcgtcagtaacggctgaaacaacgagtgcatattccatcggctttgacctcatctgtctttttgccatcgctttaaatgatggtgagagactttgatagtaatcatattcttcaaatatcccattcttaagtatttcggccagctgaagtcctttctgttcctgtcctgcaacaatatatccggtaacaatggcactcaatgaacgtgggtcattgtatttctccacaggaatttcttttgccgcaagatccagtaattccagcgcctcagttttctgtccgcttaccataagtgctgatactgctctgctcaccgacactctgtagcccagaatatttgacgttgctgtttcatcataataattactccgatctttaaaatttccccatctgaaatttttgaccacatgataaagagaattggcatctacccctcctctatctccaccggatccctgaggagtacggataggcaccagtctgtagctgaaaccatcaaactgcagatattcatcgagataaaaaatattttcactttcatacattccgcctgatgaaaagtttatcgggcgcttccagtcaaaattcgcgagcatatccagcatcatcaggttacttttgtaaagggtattcgcttcataattaatcacaatctgatctgctgcattcggaatatcagcttgattaataatacctgcctttacagcattttccttgttcacaggcagaacaaatttactcaccggaagaatattatatttttcatattgcttttcaccaaagtacattttcagaagttcgtctttttcagatgatttcagtttcaggaatttaatagcatctcttaacgtcagagaatcctgtgtcaggtatttcctgaagtcctggaaagcggtttccggtgctccctgctctttcagcatctggaaaagcccttcccagtcttcttttttcatcagatacacctgatcattcactccgtctctatattcctcatgtgtcagttcacccggaattcccatagcattgtaggttcttcttttcacctggtcaatattccatggagtggctaaaagggtgaaattgactgttttcacatcatccctgaatctttctgtttcctgaatagcccacaccggaaaggtatcattatctccataaataaaaatgatatcatctttaggcagtgaacgtaacaatgaataggcataatcacgggctgctgtttttttgcttctgtcatgcgaagtataattctgaaatcccatcataaaaggaattccaagcaacacgactcccaaaacaatattggcagcattcgattttaccttggactgaatcagccaaaggattgctccggctcccagaccaatccagatggcaaaagcatagaaagaacctaccatggcgtaatctctttcccttacttcaaacggttttactccggtatagaagacaattcccacgctggtcaggataaacagcgaaagaatggcataaaatcttccaaaatcccttttaagatggaaaaagaaaccaatcaatcccagaatcaatggtaaaaagaaaaattttacagtactttcgttcttaaaccgggcaggcatatgatcctgatctccgagtaaagcattatcaataaaagaaaatcctgaaatccagtttccattggtgctttccatatggccctggagatcgttctgtcttccaacaaaattccacatcagatatctgacaaaataatatccgttctggaacgaaatgaaataatccatattctgtgcaaatgaagggcgctttaccttaatcagatcatagggttttactttcaggtagtcctctgcagtaatagagtctccttcatattttgctctcagttcatcaaaaatacgatgagcttcaggattgtctgctacctcttcgttatcataattgaaagtaaaatcaggagccccatacaaagaaacataattagccatcacttctttatcttcattgaacatccttggcataaagcttatgtgagatttattaaaaacataattgaatctttcccctgtttttctgtaggttccggttttttcatctttttcataaatgtctccggtgatctctcttttgtagcttccgtcttcatctttttccagtccgtttttatcgagaaatgcagtgtaattctgtccgtagatggtaggccagtctccatattgcaccctgttataataatctctcattccgatggctgtgtccggatcattaagattcattggcggattggcattagccctgatgggaatcaccagccagcatgaaaatccgataatcatataaaccagagacaaaatggctgtctggtacagctttttttttgtttttctcgcatatttaatcagcagataactcataactgtcataagaacaaacgctgcaattgtccctgaatggaaaggaagccctaaaccgttcacaaagaaaatttcaagctgtccaaacaaggtcataatcaaagggaaaataatcttgaacacgaaggcaagaattcccaaagtaaccagattggctatgataaaacttttccaggaaaaggtataatttcttgcataatataccaggcatatagccggaatagccagcatacacatcatatgtactcccacagaaagtcctatgatgaaaaaaataagaataatccatctttcgctgtcagcagctttagattcattctcccatttggtgatcagccaaactaacaatgcaataaacagagaagccattgcatacacctcaccttctactgctgaaaaccagaaggtatctgaaaaggtaaaacataaggccccgacaaccccggcaaaaaggatagagatttcctgatgttttgtaatatcttcaaaatctttatgtaaaagacgtcttaaaaaatgggtgatcgtccagaacagaaacagaatggtgaaggcactgaataaagccgacatcgcattgatcacaatggaataattttcggtattccccaatgcaaaaatactcgccacggctcccacaatctgaaataaagcagctcccggagcatgggttacctccagttttacagctgaagagatgtattcgccacaatcccaaaagctgagagaatgttcaatggttgaaaggtaagtaataagcgcaacagcgaaaaggaaccatcccagtacggtgttccattttttaaaagaccagtttttcatatcatattttccaatatgtatatgacaaccggggaaaagggtttattacatttactttattttattctaaaaccacaaaagtcaccaaaagtcttggtgtagttaattaagttgaaaaacaatgctgcaaaaagttcatataagaaaaagtaaatcaacgatttaaaataacttaagtatgctttaatactcaaaaacttttatgacttttgtggtttaaaatatgcatgtttattcaatagtaaaattttaataggtattattcaatcctccatccaaaggaatacttgttccggtaagataatttgcatattctgaagccagaaaagctaccagatgtccatattcttccggctgcccgaatcttttcatcggaattttattttcccttgccttttttatttcttcttcagaatttccggtttgctgggattcatgggcaacaagtttctgaattctttcagtatcaaaatatcctgtcaacacattatttaccgtaatattatgttgtgcaatttcattggaaagtgttttagcccaagcaatcactgcggaacggatagaattagataatgcgagatttccaattggttcttttactgaaagtgatgaaacattaatgatacgcccgtttttctgttggatcatgtgaggcaaagccagtaatgtagtttcacaaaccgttttaaaaagaagatcaaaagctttctgataatcatctgtgtttttatcaactgcaaggccgggttccggaccatttgtattattaacaaggatatctaccggatgttcattaaaatatcctccaattattttcttatagctttcaaaatccgaaaagtcagcaacaagatatgcatgtttctgaccggcattaataaccggaagagatgaaacaaaatctttaagtttagcttcattgcgagccataacggtaacattggccccgcattttgccagctctatggcgattcctgctcctattccctgagtggctcctcccactaaagcgttttttgaaaaaagttgaatattcataagatttttggatatcgtaattggtatagataaatgtaagaaaaaacctccagattatattttggaggtttatttttttaagctcagacccttatttattttacgactgtagcttccagttccacttttaaagtttcaaacaaacctttcacttcaagcattgttacggcctgctgaattttatgcccgccaatccattcctgaagaataggaaaatgaggccagagttcttccgtagaagtagtataaatatttaatcttacaataccgccgcattcataccctgctgtagtaatcacttcttccaggttggcaatagcctgttccagctgtgatttcatgtccttatcactggacgttccatcaggatcaatagctgcctgtcctgagcagtataaggtactttcaacatttttcacctccaccgcctgggagtaacttctttcatcctgccatttccatggattaactgttcttttttccattgtcttgaatttgttatttgttacggtacaaaattgcagaacaaatacagcagatccccgtgatccggatcacgattataatgtgagttcaatcacaatgttacaaaggcagacggctcagagtttctctggaaacccctaagtaggcagccaaaagagacttcggaacacgttgtacaagggaaggataattctttaaaagttgctcatagcgttctttaattcctgttgtcatcatggaaatggtacgctgctgagcagtgataaagcccatataggccttttcaaggaaaaaatgttccagctttgggagttgcccgcaaagttttctgtaatcttccagtttaatacaaagtacttctgtatcctccagacattccagagacattgttgccaaggtttgctgatagtaagccggaaaatctgtttcccaccagtcttccatggcaaaccctacaatatgttcttttccggtttcatcggtgtaaacaagttttaacagacctttcaatacaaaatagttgtaaggaaccgcttcccttcctgcactaaaaactgatgttttttatattttttataggtaaagcaggatgatatgaattcaaattcatcatcattaagaggaattattttttcaatatgggtcctaagctggtgcagcatattctctttattatggtaaaagtactcttttttcagtaagacatttaaattcgttcatatcaactcctatttctgtaagaacaggcaggataaagggaatcatcattattaaaaattatggcccgtcgttcagcagttcatcaatctgcttgtaaaatgaatctttactgtaatctgctaatcctttatgatgcagacggatttctccttttttatccaatacaacagttgtgggtaatgacccactgtaaagtactccgggaatattgccagctggtaccagaaaaggaaccgtaaagcctttctcttttaaataagattttcccagaccaacattatcatccagatttactgtaagaaatacaaagtccggatggtttctatatcggtcatataatttctgaacagacggaaactccgccctgcaaggaggacaccatgatgcccagaagttaatgaagattactttattttgtaaagcggaaacatcgatcatttttccatcttcatttttcagcataaagccattataagaagcgtggcttgaagtattctttatttcttttgcatctgatatgccggaatttaggattccggtggaagcaacctgcctcatgagccatgcctttgcatccttattcaccaacaggataatgaataacacagtaagaacagcagtagagccatttttcttcagccagattttcagattttccatattcttccgcttaattccctgccaatataagactaatattctgatcgaaaagacacacgaatattttttaaagcaaaatcccttaatttgcgagacggcttaaacaaaataatctaaaacctgatcacatcagtaataaaatttatccgcagccgttaataagttactttcaatatagccagtgaaaacaagagatatatccccatccaatgcttaatattgtctttttatgtaccaaacttattttaaattgctctcacattttcaaaaatctggttttttccaagggatttatttcataattaacacattacgtgtaacaaatcccctattcatccaactaatcaaacattatcaaaaaattaattcatagataagagatctaccactttaaaataaactaatgcaaacatcctttctaaaaattaccgcggccacggctgcgctctgtttcagtactctcgcaatagcccaaaaaacctattccgtaagtgggacggtgaaagacaaaaaaaacggtgagctgctcatcggagtatctgtaaaggtaagtgaagatcccgccattaatgttgttgccaatgaatatggcttttattccctttcactgccggagggaaattatactcttattatttcgaatccgggatataaggattttgaacagcagatcaaagtagaccagaatataaaacttgatcttcctcttattccgcaagaaacagagacaaaagccattgacgaagtagtggtaaccgctataaaaaaggataaaaacttaacgtctgctcaaatgggagcggaaacattaaacattaaaaacatcgaaaaacttcctgtccttttcggggaaaaggatgtgatgaaaaccatacagcttttaccgggtatcaaaagtaatggtgaaggaagcagcggattcagtgtaagaggcggcgctacagaccaaaacctgatattgctggatgaagcaccagtttataatgcatctcaccttcttggttttttcagtacgttcaacagtgatgccctgaaggatgccagcatcattaaaggaaacagccccgcacaatatggaggccggctttcttccgtactggatgttaaaatgaaggatggaaataataaagactataacgtaaacggaggaatcggtcttatcagcagcaggctaagtgtggaaggccctattcaaaaagaaaagtcgtcattcattgtttcaggaagaagaacgtatgccgatttgttccttaagaccagtaaggattataaagacaacaagttgtacttttatgatcttaacctgaaggccaattatcagatcaatgaaaacaaccgtatttacctgtcgggctatttcggaagagatgttctgggactgggagatactttcaatacagactggggaaatacaacagccactttgagatggaacagtattatcagcagtaagctattttccaatacatcatttatttacagtaattatgattataaaatcagtctgaaaaatgatgatacggtatttgatttaaattcaaaaatccgtgattggaatctgaagcaggattttacctggtttgcaggaaacaagcattctgtaaaattcgggctgcagtctatttatcacaccttaactccaagcagtgcttcaggtactacggtgagcagttttgcaagaaatccgagatactcctgggaaaatgcagtttacatcaatgatgattataaagcaacggagaagctgaccatcaattacggcgcaagactttccatgttcagtgtattgggaggtgatacctttaatacttatgagaatggaatacttaccgatagtaaattcttagagaagggaaaattcgggaaaacctatgtaaatcttgaaccgcgtatcagtgccaactaccgcatcaacgaagtgagcagtgtgaaaggaggctattccagaaacactcagaatcttcacctgttaagcaacagcaacagcggaaatcctaccgaccagtggatcggaagcagctatacggtaaaaccggaaattgcagaccagatcagtcttggatacagcagaaattttaataacaacaattatgaattgaatgctgaggtatactataaagacatgaaaaaccagatcgacttcaaaaacggggctcagattggctttgatacaggagcggatgtagaaagtgaactgttattcggaaaaggaagagcgtacgggctggaacttatcgccaaaaagaagagcggaaaacttacaggatggatttcgtatacgctttccaaaacggaaagaaagatcaacggaatcaataacaacgaatggtacaacgccagaatggataaaacacacgacctttctattgttgcaacgtatcagcttaatccgaaatggagtttttcaggactgttcgtttacagtacaggaaatgctgttaccttccctaccggaaaatatgagctgaacgggcaaaccatattccagtacagcaacagaaatgcagacagaatgcctgcttatcacagaatggacttaagtgctacttatgagcctagttccaataagcgtttccgcggttcatggacatttggtatttataatttgtatggccgtgaaaatgcctacaccattaattttgaagacaatcctgaccgtcccggaacaacccgtgccatgcagacctctttattccgctgggtacctaacatcacttataatttcaaattctaaatcatgaaaaatactttttatatcatattatctctcctggcattaacttcttgtgaaaaggaagtcgatcttgatctgaatgatcagagcggaaacattgtcattgaaggaaatgttacaaaccagccaggtccttacaccgtaaaaatcacaaaatcagttggtttttcagagcctaatcaataccccgctgttaccggcgcccaggttattttaagtgatgacgtgggacagtccgaaacacttcagtatacaggaaacggagtgtaccaaacctcaacttttacggggtcacccggcagaacctatacattgaaagtacaggctgaaggaaaagaatatactgcccagagcaaaatgcctgaagtggtttatttcgacggattgaagcaaagctcttttaagtttggtgataagactacttataccctcttaccactttttactgacccaataatgcttgggaaccgttatctttttatttttacgatcaatgatctccctaaaaaatacatgaataccatttcagacaatgtcaataacggattgcccaaccagcaacctctgatccttcctaatgatgataacaaaggcagagatcacgaagtagttgcaggagataaaattcatgtggaaatgcagtctatagacacaaatgtattcacctattacagtgcattgcttcagatttcaggtggtaatggaggaaccgctactccaaccaatcctccgagcaatatcagcaacggagcattggggtatttttcagcgcacacaacagacacggaaacttttgtaatccagcctcctgtaactccataaatttaaaaaggatattcatcgcagaatatccttttttatttttcgtttatctgaatcttcttttcagggaataataccgatacaaaagtttatcataccggatgacaaagaataataatccggcagtcactatcagcgttttcagctgaataatgctgtaaacaaaacctccaataatacatcccgaaaaaaaacaggcaacaatcaccagtttcagggcaatattttttttaagctggcgctgttcattttcccgctccttaaataacagctttgaaagctctattcccagatcggtaaacagcccggtaagatgggtagttctcactacagactgggatactcttgttaccaatgaattctgaacccccattgcaaaaagcaaaagcccggcaattgtataaggagatattgaaatacctaatggcttccctcctgatattcctacaaagctcaatatcagaatttcagtaatcaaaggaatgaggtgtggacgaaacattttacgccctgatgaaaattctaccataaagcttgagcagaacgcaccgccaagaaaacacagaataaagatgaagtatataaatgctttgcagtaatgatccagaagaatctcttcagaaaaaaaggcaaaatgcccggttatattcgtagtaagcactttaacagacaaaacacctgcaatattcacgattccggcaacaaatgaaagtgcggatgccagcttaaggttatgaaaataggttctgtttttccctctatgtctgaacattctgaatctctaagatatgtattgctgtaaaaaaacagctggataaaataaataagtaaaaaaaaataatttagaaatgtcagtatcaactgtgaaaaacatgtccgcttaaatatctatccagtgttctttataaatttactattgctctttattataaaacctgttgttttaataatgataacagatctgaaactgcgtccaaaagacctcgctgaaatgtctgtttcttatttcaggatcaatttcattacttttgtaaaagtaatccgttcaggaaaaaaatgttgtgatgctgatcatctttaaatgtgatttaagttaaaaactgagcgtattaacagcctgtaaagtaaaattatgatctcaaaatttattttcaacaatcaatatctttttgatgaacttcctgagtatgataaaaacctgcttacaggagcaatgaaaaccaaaaattaccgtaaaaatgaacctgtatttactgacggaacaaagcctaatggcgtttattatctgaatgaagggaaaataaagaaatataaggtggataatgacggaagggaacagattatttacatttacacctccggtgagtttttaggttattcagctattctgagtaatgaatcttacggtgacacagcatcaacactggaaaattctgtgatttcctttatttcaaaagacagttttcttgatattctcaatcagtcatcagtactttcaaggctgctgctgaagtctttaagtcatgaattcagtgtgatggccaatcttattgcagtattgtcccatcggaccgttcgggaaagagctgctctcagcttactgattcttcatgataagtataaatcaaatggcacaccagacaatgaagtattcattaccctttcgcgcatagatcttgccaatatggttggaactgccagagagactttggcccgcatcatcaatgattttaaacaggaaaaattaatcagatctgaaggacggaaaatacaaattaccgactttaagcagctaattcatattgctaatttttattagtaaagtaaatttctccgttttctactgacaaactgctgtcataagcacctgttacctttgtttaaaattagtttaaacaaataaagtacccttatgaaacttacctcattaagactcatcagtaaagacattaaagcagcagtagcattttatgaacaggttataggtatagctgccacatggtatacagaagattttgcagaactctctactgattctatcacaatcgctatcggaagtacccggacaatgcaaatgttctcagaaggtctgacagattttgcaggaacaaaatcaaccataatagaatttctggttaaagatgtaaacgaagaatatgaaagaattaaagagatagcatctgaaatcatccaggagccaacaacaatgccttggggaaaccgatctctgctgttctgtgacccggatggaaatatgatcaactttttcacccggtaagcgaagaggctgtgaaaaagttcagttaagttttaaacaactttatcagcaaaaaaataaaacctcactggccaacagcgaggtttttattctgatttttaaaagtcagtcttattttcccaggaattcaatagctttggcaacaaatgtatcatggtactggtaaaaagaagcgtgtcccgaattaggaaaaataaccagttctgcatggtctaaatgctgagccatatttttagcattctgaacagacaccggaaggtcattttcaccatgaacaatcagtaccggatttttaatcttttctatttctgtaagggcatcagcattaggctgggcccagctcaatacagctgtaaactgtgcgttggaagcagcatcactcaatggaatatctctgtctgtagtacggagctgaattctggcaaaagaagcttttccttccgcaatactctgtgcagattctgtaaatccgaatttaagaaatgaagcttcaggactcaatcctgcagttcctgcaacaatcgcaggcagattagacaacccgattgcgccctgtggtcctgtcccggttaaaattactttattgatcagtgacggattggtcagcgttattcgctgtgcaacaaatccacccatagaaaatcccatgatattcactttggtcagatttaacgctttgataaagtctaccgcatcatcggccattgcctgaacagtattgggagttgttccttttgaggaagatacacctttattatcaaagataattactttatactgttttgcaagaccatctgtcactgcaggatcccagtcatccatggaaccgcctaatcccggcagcaataccaatggaattccatcttcttttcctaaaacacggtatgcaatggagtttcccttaacgtttatgaattgggttttggcagtttggtggttcctgttttgtacctcctgtatcgtgggaggctcattttcttcagtgcaggatactgtcgctacagtaaaaagagttaggcataataagcttaaggcggagatttttctgattgttttcattgtagtttatttttgtttgattatggtgcaaacataaaacacaaaaacaggcagaacacctgaaagctttatcaacaggacattttggtgactcaattagacatttggaatagtgaaaattaaaacaggatgttcaaaatgttcttaaaacgttctattttgtttttaacatgctaagagttttcatcgctttatcagcatcttcttttgctacaaatatatggtcatggaaataagcggcgactacattacagctgatattttcgttttttagggcattggcaaaggcagcggtaagccctatggcttccagtgaagagtggacagtaagagttatccatgaagagatatagctgtaagccatactccattcatctgctatggttttctccagcacaatggtaacagcttcatgttcacggaagaaaaacagaatcttctctatctccggaacttctccgagggttttaacagtacaaaatacatattctccagcattcaataccggttccatcttttgaagcaatatcgctaagtctttttctcctgacattttttttgcctacaaaactaaggtacagatggcagcattcatttatcatttgataaaaaaatattcaatattattttatcagcaggtttaaagagattttctattcaaaaataaaaaaggaggcttgctgcctcctctttgtttttgtactgtaacctattaactgaacttcactatatgtgtttgtgttttttttgatcatttggttttttttaagaagtccgtttaaggttattcatacacttctttaatttcatcattgtgttattaattttcatcatttgtgtttttataactatcgtttattatttgtatagttataaatcatcatttgtttttttgtgtatgaaattctaataatcggagcaattctcatttgctttttcattatttaaatttcacattacaaaggaacaacattataaaataaaatcctctataaaccccatcgatacatgtcgattcatttatagatatttatcgataaatatgatattctgataaaatgaagtgataaacagcctttaaaaattatagtttatgatgggttttgataaggtcaacaagctcaaccatattttcgatcttcagtttttcaaagatattttttttgattgtgcttactgtattttgtttgatattcaggctgtttgaaatttccaggtttccgtacccttcagcatagagttctgcaatctgcagttctcttttggtcaaaatgctgagaggacttatcagatcaggattgtaaacgaactgtactaaaagattgcgtaaaagatcagaaaaatattctcctttttcgataaaagttgtaaccgcctcctttacctcttcttcttcactcagtttgctgaggtaaccgttagcaccggctttgataaatttaagtccgtgcagctcctcttcaagtccagtaaaaatcaaaattttaatatcaggatttatactcttcatctgaggaataatatgaagactgtttccgtccgggaaatgagcatcaatgatagccatctctatcccttttgattctaccaactccaatacctgatgtaaagatgaagtctggtaaaccctggcgttaggagcaatatcactgataacaatttccattccctgacgtacaatactgtgatcgtctgcaagcaggaatataatttctttatttagaattgatgtttccattagtattacgatttaaattgatcctgaatgtcacttttgttcctttgtgcagtttactttcaactgatatatcaccatcgaaaagctctacaatttcttttacaagattaaggccaagccctgctccaagattatctacttcatcagacaccattccctgataataggggtcaaaaattttaccaagatcagattctgatattcccactccggtatctcctacagttgtaatgagggtaattttattttctccggccggttctgtagacattacaagatcgatctgaccgttttctgtgaatttgttggcatttccgagaatattcatgaaaatctgattgattctgatattatccgaatataccattatatcttcagggattctgtccgttaccacaaacctgttgtttctggtttccagataaggggtaattacctttacgatagaactgatctcgttcttaagattaaaaactgattttataagttctttttcagcattttcatttttggtgtattccagaatctgattggactgcagaagcaaagtactgttcgtaaactttattgatttgagataatccctgattgtttcatcctctgtggttctgtggatcttatcaatgaaaatattgatgatttttaatggcgatcgcagatcatggctcaacattccaagaatcctgtttttaaaattaagattctttttaatctctttattcgcagcattaagtttttgttcataaataaatgcgactcttgtaaaatacatgatcagaatagatacgataaacatcagaatcattaatcccaataccagataagttcttattctgttattgtttgaactctgctcgttatattctttttccagttgggatttaaaatcattgattgcattttcgtacacctctatcaacccgttgctatacaccagcagcttactgaagttactataaaactggaggctgcttttctgattacgggcggcaaggagctgtacttttttcacttcagctgcgtaatgtttatccatagactttaatgtattgtccattttggattttacttcggaaagatccagcgttttgttgttcgtcatcgtaattaccgtactctccttctgtacatctacctttcctgttacagcatcttttagacgtccgaaaaagcctttctttttaatggtatcggcataagtacgggtttgaattttgaaatcttcaaaatcatttttatacttggcaggtacatactgcttatcttcaatattggcaggtggattcagggaattctggtataccgaatctattaatgttttcagctttgcagtctttatcgtatcctggcgatgaagagccaatgtttttttcagtctggggctggtattttcatacgctccaattttatcaaaattaattttaagctttctcaaagactggaaatataactgcagctctttattatcctgagtagccatatatttctgaagatgctcctgggcatccaggaaatcttttcttgaattgtctgtcaaaccacctaaggcacggctttcttccagctgatctttaataaatttcagcttttttccattgacaaattcgttataaaaaaatatggcgataatgacctgtatcagtaaaatacaaaggatcaatgagtaatgaacaagttttctcaatttaaaatttaagaatttatatttcatatttgtttatcagttaaattaatttcctgaccacataagttcatgagatattagcctataacaatataccattattttcaataatttcataatactgatatatcatccaattggcaaagttaaagtaatttttgtcttcttataataatgaatatttgataaaaccccgggaatttatttttttttactattaaaacgtcttacagacattcagttttatttacgtaaatccgtttttttagatcaattgcaaaagttggggtcttataaaatattctaaatctgtagatttattatatctgatgaataatatctaatcagcaacatatgaaaaataacagatcattacaatcaaatggaagaagtataatgcgggtttttcaggtttgaatttgatatttttacttatagaatattctttcctgtggttaaaatccatgtcagaattttaattgatgtctggccttcagaatttcttaagatttctactcattcattctaattatattcttatccatatcaccatcattagtattttctatttttctgatgaaatcctgagatgatattttcctaacttttcagtttgaaacgaagcagaatatcccggataattcatttgatgatctgagatattcaaaccaataacagcaaaacagctttatcatcttatgacagacaaaaattttaatcctcagagaggctttatattcagcaaacatgtgccggaggaattatcgcattttgaccgggtctttgatgtattcaaagatttgcttacccatacttccggagacattgaggaagccttcgagtggctggatatgcttgaccaggaatatgatattttcagcgatgaatatacgcttcaggattttgaagaagatctgaaaaaaagaggctatatcaaagaagaagatcccgaagagggaaatacaggaagcggaaaaggtaaaaatatattaacaccaaaactggaggcagcccttcgggagtatgccctggatcagattttcggaaaactgaagaaaaacggagccgggaatcaccgtaccagcaaaacaggaatcggggatgaacgcgatggtgaaaaccgttcgtatcagtatggagatgacctggcggcagtgaacatgactgaaagcttaaaaaatgcccagatcaataacggtatcgcagatctgcgccttactgaagatgacctcatcgtagaggaaaccaaacacaaggcgcagatgagtactgtcctgatgatcgatatcagccactccatgattttatacggtgaagaccgcatcacaccggccaaaaaagtagctatggcacttgtggagcttattaagcgtaaatatcccaaagattctatcgatattatagtatttggaaacgaagcatggcctattaagatcaaagaccttccctatctgaaagtaggtccttatcataccaatacagtagctggtctggagctggccatggatattttacgcagaaaaagaaataccaataaacagatttttatgatcaccgacggtaagccgagctgtattcagctgcccagcggagaattttatatgaacagttttggattggaccaaagaatcgttaaccaatgccttaacagagcggcacaggcgagaaaacttaaaattcctattaccacctttatgattgcgcaggatccttacctccgtcagtttgtagaagaatttaccgctcagaacaaaggaaaagctttcctgacaggactttcaggcttaggacaaatgatttttgaagattatgagaaaaacagaataagaagaatataaaaatcagaattctattaaaacattaccgtaaaatcttaccagataattagcattacaagacaatgaaaaacgatattacattcaaagaattaaaagactccggttacacctataaaacaattaatgaggagatccaggccaacctgattgccagaattaaagctaaagaacctgtatttgaaggtctctggggatatgaagatactgttgttccccaattgaaaaaagctattcttgcaggccaccacatcaatttgcttggactgcgcggacaggcaaaaacaagaattgcaagaagtatggtcaacctccttgatgaatatatgcctgttataaaaggatcagaaatcaacgacagcccgtttcatccgatttcaaaatatgccagagatcttattgaggagcttggcgataacactccgatttcctgggtacaccgctctcaccgtttctatgaaaaactggccactccggatgtgaatgttgctgatttaatcggagatatagaccctataaaagcagctactttaaaactcccctattctgacgaacgtgttttacattacgggatgattccgcgagccaaccgctctatctttgttttaaatgagctgccggatctacaggcgagaatccaggtttccctgtttaatattttgcaggaaggagatattcagatccgtggtttccagctgagaatgcctcttgacattcagtttgtatttacagccaacccggaagattataccaacagaggaagtattgtaactccgttgaaagacagaatcggatcccagattttcacccattatccaaaaaccattgctcttgcccgtcagattacggaacaggaggctttgatttctgctgaagataaatcacagatacaaattcctgaccttgcgaaagatcttttggaggaagttgcttttgcagcccgtatcagtgaatatgtagatgcaaaaagcggtgtaagtgcccgtctgacaatcagtgcgatggaaaatttagtagcagcagcaaaattacgactgattgaatccggtgaagagagaactactgttcgtctgcttgatttcatgtcgattatcccatctattacaggaaaaattgaactcgtgtatgaaggtgaacaggaaggtgccgattatgtagccaaaatgctgatcgacaaagctgtgatgacacagtttgaaagcatattcccacgtatttccaaactggaaaaagaaggaatcaaaacaccttacaccgatctgatcagatggttcaataaaaatcatctggaacttaattacaatgatacagatgaagaattctatgctaaacttaataaaatagaacctttggtaaccgttgttgaagaaaatgcttctgaactgagtgctgaagaccaaaacttctgcaaagaacttgtgttgtgggcattaaccatcagcaataaaattgataaatccgaaaaccagaatgccttcacatttgattctcccggaatcggtcagtttttacgcaattaaaaataaatatccttatacattagaataaaccttcagccggagtctgaaggttttatttattcacaaaatcgaaagttattcgtcaaaaaatactgtaaatttgccagtccatctcataaaagatggttttctattttaaatattatgaaaaaaacagcagtttctttattagcccttcttctgaatattgtttgtcaggcacagaatttcgatgtgattcctttaggaatatatggtggggagcaggaagataatttatcagcttatctggtaggtgccccgaaagacaatgcatttttatgccttgatgcaggtaccgtcaatgcaggaatccgaaaagccattcagttgaaaagccttgacggaactactgaaacagttctgaaggatcagataaaaggatatttcgtttcacacggccatctggaccatctttcaggccttattatcaactcccctgctgattctaaaaaggatatttttgctatagctccggtaattcagattttgcagaatcattatttcatcacagatacctggatcaattttgccgatcagggtcagaaaccaatccttggaaaataccattacaacgagcttcaggaaggaactgagatcccagctcctaagacaccgttctttataacaggatatgaacttagccatgtgaatccttacaaaagcagtgctgcactggtaagaagagacgatcactatctgctttatctgggagataccggcgctgaccgtatcgaaaaatccgaccgtcttgaaaatctttggaaaacaatagccccacttgttaaaaaaagacagttaaacaccatattaattgaagtttctttccctaacagccaaccggagcatctgttgttcgggcatctcactcctaacctgttaattgaggaactgagtaaactgaaggaaaagaccggacaaaacagtcttgagaacctcaacattgtggtgacccatagaaaaccaacaggagataatcctgaactgattaaaaaagaattattgcaaaacaatcctttaaaagtaaattatatttttcctgaacaaggtaaaaagatcaatttaccatagtgacagatcaaaagatggagcccaaacagactccatcttttttatgtttttttagtcattcaaccttctcttatagctggttcatattttcctttgggggctgcataacgataaacaaaataccaggtgatcaggatctgaaagagtataactgtaggcagaataaacggataatctacaaaaggtttcaatgtatcaccttttgccagcatcatcggcagatcaatgatattaaatataatgatgacccaaagtaatgctttgcttcccttaaaataccaccagcaaaatattccataggccagttcaatgataaaattaaggatcggataatcaagaattccaagccctaagaccggtttggcagagaatggagataactgaatatccttttcatgaaatattatatcaataataacatgggacaaaacaccaatagcaaatgctatagcaagctttctgtttttatacccccagttaataacacagaacgaaagtaccgctgccacaattcccaaaaaaacagaatgtgaataaggcagaaagtctagatgtaccttacccccggaaattgagaagtgttcccagccaaagtaattaaaaaatacccaacatacttccaaaagctgtacggagatcaatagtggaagtaatggcagcctgggtgcatttttctttatcagcaaagctgttgcggcatgatttattgcatacataatagaatgatttatggatacaaagatgccacagctattttacataggcttgtatgatctggctattcttcaataaaagagaaggagcctgcccgaacattcttttaaatgtacggttgaagtgtggggcatcggagaagccagcttcaagagcagaatctgtcatattattaccttctataagatgccgtactgccactaaaagttttgcccacagcatatacttcctgataggaatacccacctgttctgtaaacagatgaatgagtcttcccggagaaagaaaaatcaaagcggataagtcatcaatctttaacggctcattccatttttgtttaaggatttccagaagtcttataatcctttcatccatactatcatttccttctgtactggaaagttcacggagaaaccgtagtgtccggttaaaaacagactctgcagattcatcatcagaaagcagcggaattatatcttttaataattcttttacaatagcttctggcaaaactgctattctttgactagtcagaaacatgtttttaaggccattgcctattttgctttcaggatcaatattgatcaatagaaatgcattgtctcctgttctgcattcatgtggcacatcagaactaataataactgatctgttcttcataaccgatccggatgaaatcacttctatttcatcatcaatgcttatagcaatctgtatggcatgatgatcatgaacagcagtatcaacagcactgcctatataaataaagtaaccggtagaaaaaaacagcagcggatgtgtcatatcatattctatatctcaaagatatttaaattattcagacaaatcaggagagacaaattattattttgaagagtaagaagttcattacatccactttgtttcattattttaatgattgatttccaaataattaaacataaacctcaggaattaatatatttttttattgtttatacaaatttaatatcgtaatattgcaatataaaaataaaacaatgggcgttactaaaacagaaatttacacagaagaacaaaataagctggcttctttgcttaaagttttggggcatccggcaagaatcgctattttacagtatatcatcaaccaaaaagcctgcatctgtaatgatcttgttgaagaactaggattggcacaggctactatttcccagcatttaaaagaattaaagaatattggaatcatcaaaggttccattgaaggaaaatctgtatgttactgtattaatgaaagcaactggaagcagtttcagaatgaattcaacctgttttttaatcaggatgttactataaaacaatgctgttaaggcattttttttaaatcaatatatcgtaatattgcaatatatcattataaaattatcacactaaattttaatctgctatgagactatcagaaatcaaagaaattctgccggcattggaaaatgttgaatttcaattagaaaacggaaattttgtccctgaacatttccacgtaacagaagtgggtcagatcataaaaaatttcattgattgcggaggtgtaatcagaaatgaaaaagttgtcaactttcagctatggaatgctgatgattatgaacaccgtctgaaaccgggaaaactccttcatatcattcagctttctgaagaaaaattaggaatagaagactcagaaattgaagttgaataccagggagaaaccatcggcaaatatgatttggaatttaatggaaaaaactttgtgctgaaaagtaaaacaacagcctgtcttgctcaggaagcttgcggaattccatccgaaaaacaaaagaaaaacctgtctgaactatctgtaaatccaacatcggcctgcactccgggatcaggatgctgctaattaattttattaaaatcttatgtatcaggaattattaaatacggttcaatctcttaaatgggaaaagacagatactgacagaaaagaggttctggagccactgatcagctttatccagcaaaaagtggatgacagaaaggaagtcaacttgaattttatctgcacccacaattcccgccgaagccatctggcacagatctgggcacaaacagctgcttctttctttacgattccggaagttcattgctattccggaggaacggaaactacggcattattccctaagattgcagaagttttagcagaacagggcttttcaattttcagcattgctgatacaaccaaccctgtatatgctgtaaaatatgatgatagcaaccttccgataattggtttttcaaagaaatacgacagcccgttcaatcctgtatctgcatttgctgccatcatgacctgctcacaggcagatgacggatgtccttttattcccggtgcagaaaaaagaatccccattacatttgaagatccgaaaatttcagacaacactccatatcaaacagcggtctatactgaaagaagcttacagattgcagaggagatgttctatgttttttctaaaatcaaaaaataatcatgcagcccaaattaaaatttcttgatcgctatcttaccctatggatctttctggcaatgggtgcaggaattgctttagggcatttctttcctgatattcctgacatgattcaatcgcagtcaataggaacaaccaatattccattggcaattggccttatcctcatgatgtatccgccattggccaaggttgattactctctccttccgcaggcattgaaagataaaaaagtaatcggtatttctttattgctcaactgggtcatcggaccagttctcatgttctctcttgccattctttttttaagagatgaaccggattatatggcagggcttatattaatcgggctggcgagatgtattgcaatggttcttgtgtggaacgacctggccaaaggaaatagagaatatgcggctttgctggttgcattaaacagtattttccaggtgttcacctatagttttatggtatggctgttcatgaatgttcttccccgtcagttaggcttaaccgcttttaccataaatatttctataaaagatattagcgaaagtgtattgatctacctgggaataccgtttctggcaggcttcatgagccgttatattctggtaaaaacaaaaggaatcatatggttcaatagaaaatttgttcctgcaatctctcctgttacgctttatgccttgctatttacaatcatactgatgtttagtcttaaaggaaataaaatacttgaattaccgatggatgtagcaaaagtagcaatacctctgatcatctattttgtactgatgttttttgtaagcttctttatcaacaggtctttacatattccgtatgataaaaatacatccattgcctttactgcaacagggaacaattttgaactggctattgcggttgctatttccgtcttcggtatccattcaccacaggcttttgtgggagtaattggaccgttggtagaggttccggttttgatactgcttgtaaaagcctgcttattcatgaaaaagaaatggtactcataattcattacaataaaaagcttcactattatggtgaagctttatgtatcaatgatattaatttttgatcagcctgtaatttccgctggcttcatctttttgtattgagtaaccatctgccagttcaaggatccagccgtctccggatatttttttattttctgttttcactggatttgatatggaaattttatcccagttcgggctcattaaagctccgttttcaacggtcagaattccccataaatcagtcacccggatgttgggatataccgttcctttatcttctattggcataatatttcttgggtcaaaggagacattcattttttcaaatttgatttcaaaatgaggctgctgaatgaatttcaccttatattccgcaatgagtttttttgttcgttcttctcttgctgtttcctcttctacaattgatttaccattatagcgatcagacaggtttccaatcgtcttttcaagatcagacggaattattacattaaatgctttactgaaataaaccgtaaggtctgttttttcatcaatccttttattccagtctttatctttattgtacagcaagtagccataaacaggcgttgtatgataagcaaatgaacggacaaacgttggatttttcataaaatcatttattccattcaaaagagatgctcttgtctcttcattatttcttccgctcatgataagaccagtgaactcagcaataccttcattcagttccaacaggttttctgcagtttctgaatctttataaagtgtattcctgtattttctaaaagtcagtgcactggtcagatgctgcttcatttctttttgtgaggttgagcggattgcctgcttcaatgcttccagttcaagacgcagatatatcctgccttctttctggtcaaggtgattattctccacattactgagcgtaaatcccaatgaaggctggattctgtgaaatgattcatgggccagaagattaatcctgctttctttattctgagaaagaggcagcatgaccatcgcccatctttttccaccccagttgaccgctgtattcgcaatattgacagaagcaggcaaagcaccggaataaaccttaccgttctgcttcagaattccctccgaatcaggttcgttggcaaaaaattctctggtttcagggtcaattaaaataacaggaccatataaatctttgttccaaagtccgatattcttttttgaaactgtttttagctcatcaaaaaaaacggaaattgtatcaggggaaatagattgcttttgtgcttttacaccccatccaaacaagaaaaagaaggctgtaagaaaagtctgcttcatggtcagattctttgtggttttatcattaaatattaaaaagtacttattaattacttttggaattaccaatataatgaatttcaatcaagggtaaaaaccattgcattctctattatttcatatgccttttctgagtaaggaatttttctgatactacaaatattcaataaccatacaataaaaaaacctgctatctgcaggttttttgcaacatatcggaaaaaatctaaaattcaaaaacgtccggaattgtttttaataaaaacagagggttgttttcactaaaattccttctctttaaataggaatatgacgtgtgttcttagaatcgaatcagtaaaataatactttcaggaacattataatttatttacaaccccagtttctttttgatggcttccatttctgcttccagctttttaatcttagctttttgcagttctatttcagcctgctgctcctgaatagcttttgtaagcgcaggaacaagtgaagcataatcaacagcccaggcttcttttgtgtcatcttttggtttataaactgcttcaggaactactttataaagatcctgagccaggaatccgattttatgctgtgttttctggcctggatctacagccggttttccatttttgatctgattattggcagacagttcatactgtttcggctgcaatgccatgatggtactgagcccataccctatttctttaacctgggttttcagacgcatatctgaagtattgacaaaacctcctgcggcacttaccagtccgttaccgtcaatagtcactttagtactgccgttgtagctgtatttgaatccttctgcaccaagatagatctgagtaacggaaccattcaaggtattatatccgctcagatcaagatgcccttttgtagcggcaactttatttccgccaacacctcctgtttccggcctgttcatattgatatctccattgccatcgatgtcaagcatactattagtaccattagcataataatatctaaaacccgtagtgcccagtgttacctgagagaatgcggcactgctgctgtttccttttaaagtaagaagaccgttgtaagcattaatggcatttcctgccgctccaaaagcagtaatatcaccatctccgttgaaattcagctttctgtcagcgttaaaaagataatcgccaccgtttgcctggctgagcttaaattgggccacattattatttcctgctatagtaagagctcctcctatattgtttatgattcctgcattggcaccaccttctgtggttttggttgaagagttaagaaacatatccatagaacttccgacatcattagtaagccttaaaagagccgaagcattggtaccagcgttcaggttactgattgaggtaagtccagcgccatttacattacttctgaaatataaagccttatccgcataatcaattgctgtattctgcaaaagtgtgccaccaagcctcacatcattacctacagcgctaagaccattacttgctgttacagctgcagaattgtttccggaaatttcccatgtggaagccgctcctgtaaggccggtactgatcagctgcaaactctggttaggacttaccacaacaccggcattaccattaattgtttctgtgcctgcagggtttactgtaacggtaaaagctgtgttattcttaatggtgtacatacggcctttgaaattaccagtacctgctaccgcagccggcaatgtaaagacagcattggctgttccgttatatgagatatgaaaatctccggcggtcatggcataagtggcggcagttactgcgctgtactttgcggccagagagccgttaacatcaagagtggatccaggctgggctgtgttgattcccacactttgcgctgacataatgctatatgaaagcaaagctgccgctactgataatgtagtaaagtttttaaacattcttatataattatgagtttttaatgaggttaagaaatcgtatgaaaactgttatagatttggtttgtgatccggaccagtcagaataagtttcacacattgccgggatttgtcaacaaaatgaaatcggtataaccactttctgaaagattgaaatgaagaaaatcatgatcatattttttcattgtcccgtttttatttactacaaagctaaattttccgtcgtcttttccggaaaaacacctgtaagaaaattgccactctgatgtggaaaaattattacaaattaaatagagaataaatcattacgattttgtatacaagatctgaatctcaaattatatccattcctgatttattgataatattgtagaaacactgctgattgaaggctttttcccgaaaatagactacctttatgcggaatgaaatttttattataatgaagttagaattatatcagatagattctttcacagaagatatctttcatggaaatcctgcctgtgttgtcccactgaaaaactggttacccgatgaattacttttaaaaatagcccgcgaaaatgctgtagcggaaactgctttctttattgataacgggaatagtaccattcagctgagatggtttaccccggaagtagagatggatttgtgcgggcatgctacgcttgccactgcgcattgtctgatttctgttttaaattatccgaacaatactataatttttgataccaaaagcggtgacttaacagtacatgtaaaagagggaatttactatatggacttcccttccagaatgcctgagccggcttctcttccggatattataacgaggtctctgaatatacagcctaaggaagtcttcaaatcaagagattatgtgctggtatacgattctgaggaagatataaaaaatattaaaattgaaaggtctgttttcgatcttatcaacctggatccgggtggtgttgtggtaacatccaaaggaaccgactgtgattttgtgtccagatactttaccccacagtcaaccattctggaagaccctgtaaccggctctgcacactgctctctcatcccgttctgggcagcaaaactgggaaaagataaactttttgcccgacagctgtctgaaagaggtggccagctcttttgtgaaaacaacaatgaaagagtgattgtggcaggaaaggccaaaacttattcaacggggcacttttggattgaataataaaaagctgaatcattttgtctgtaaaacaacagcgcccagatacacataaagccttggacatctgatccagggctttatgctgattttaccggcaatctttttaaactgcaatttattgagttagttttacagatatccaaacagtctgtttcgggaaacattgttatatttgaacactattaataaccatccgctaattaaaaaatgaaaattttcatcactctgtttctgttgatctccggaattttgctttctcaaaatcaaaggtttgtttacgaatattcatttaagatggatacattaaacaaggataaagtagaaaaggaaatcatgaatcttgatatcaccaaagaaggttcctatttttacagtgcattgctgattacgcgtgattctcttgtgaatgctgaagttgaaaaaggaaaggcttcaaattccgttaatattgattttaggaagatcagacatccgaaagtcaatttcaggatttccaaaacatatcctgatctgacaacagtatatcacacttcacttaatgccagcaatgttgcagtaaaagaactgaacaagatgaattggacagttcttcctgaaacaaagaatattgaaggttttaaagctcagaaagccaacacgtatttcggcggaagaaactggactgcctggttcacgaatgatatccagatacaggacgggccttataaattttgtggtttgccaggtctgatcctgcagattgaagatgaagaggctacccatatttttaaattgcttggaagcatgaagcttaacaacgggttttcacttatagactcaaagactgcagaaatactcctgacaaaggaaaaattcaataagctttggaacgaatatatacaggatcctgccaaaaatatcaaactcatgcacagcacttccggaatgtctgaaacaatattatttgattcaaataccggaagtcctctgagtaaacaggaattaataaggaacaaagaaacacgtgcaaaagagtttctgaaacgatttaataattttatagaaaaggatttgtataaataattccggtattaggctgccatattaaatttttgggatttcgttttactatcaggcgtgttggaaaactataaagaaacacggcctcacaggggccgtatcttttattttttgtaatgtcagacataagctgacagaaacatctgaacatctcgttgtcatctttaaaattttaaagttatacaagccaagtctgatttacagacttttatttgcggcatgatcttcaggccaggcaaaaccaactcctccatgcttgtatctgttggtttcaagatagaatgtatttaccccctgaagtccaacaccagcataataaacaaatttgtcgacatattcctgatattcaccaaattctttatattcttgatggagaccattcaaactggccagctcttcattatgaatacgtaaagcctctgcacaagcatcctccaaagaaagattatattcctgctgtaatacaaaaaccagattaaaaacctctgtcccttttgccatctctttgggtaatgaatgaatatcattttgccacgctacaaccagggtcatatgggaaatcatcttttgtacgacgatatgctcaaagatatgttccggcagaacaagccctgattcaatttcgccaaaaatcaaataaggacgcatgagaacagaatactccctgatagttttgtaaagattcaatgaagggggacgttgggctattttatatggatattccaattctattccgtatctgaaagattgataaaaatagtaaacaaaacgatcaaaccagaggtctggcataaaagcgcgaaattcatcccggatcttttccatatgatgataaagtgcgttttcctccggcatagcctgagctcccttgagaatatctgtacagcggatccgtaacttctggatttcttcaagggatgagtgttccacctgatcatcgagagcaacatactgaagcataaacctgttgcatggaatagcttgctcatagcttaagtgtggccacatacgtgcggtacacatatgaagttccatttttttataaattttcctttgtttttctgtcagaaaagtataatcgttatcaatccagccatccatatccttcttcatttgttcagcatgcggattaataagatcgggccacggatagcatccccgtggtaaataatctgcactattaaattgttctggtgtcattttagtctatatttttaaattgttgtacttaaactcccatatgtaatcatactgaatcttcttccaagattatggcaagtgctcagtagctgatctagattttaatgaaatccagtcatcaatcagttttattgaaattggttatacctcaatgtttcttttaattcagaagcacttggaaattctgttttgttatatcggtcaagcttggttgatatatttttccatccgctcaataccatgctcatataatgcacccagttaaccacatcttcatgccacggtccaaaatcaggaagtgatgcctgcagtgttacaaattctttcagatcttcattatgaagccgcagatcttcaagacatgcttcttcaagggaaaggtgatgctcattctgaattaccttcacgatattatagtaaatacttccggtagcttcatctttctttacagactgcacttcattgaaaaaggttaccagatggcaagccagtgcctgcaggcggcgtactaccggatgttcatggatttcagagggaagaataactcctgtttccacttccgtaagctgtaaaaaaggataaagacatattgaatcctctcttaaagcaatgcactcctccactgtgggaaaaaatttatcttttttatattccagctctttttttagccctgtaaaatatctgctgatcatctggctaaaacgattcatcgattcctgaggaataaactgaagtaattcttgtcttaatgtggcaagcatagaagccaatggtattgtggattggataacagacatttcaccattcaatatcgcaatggattgggcatgcacatcatcaatgtcctctggtttactttcttcatacagatcatcattatagagtgtccagagcattaatctgcagataggccggaaacgttcagcagatgcagtaggaaaccattgggcggcgatgtgggcagttttggttttcttgtactttttacgcagatcagggttgttttgatacagccacctatattcaccatcaatccactctgtttcggtgatttgctgcaattgatctgcatgaggattttttaaagttgggaacggatacctgaacttggtatgaagaagttcaagagggttaaaattttcgttactcatgactttatgtttaaatggttgctattttttattgcagttttatttattggaatcttcataacaagaaaccatttataaaaacatactatcctaactaccagaaagatacaatcataaataatgaaataaatgtacaaattaattttgttaattaatatgcaattaatgctacattatataaatatgttataatgctgaaaaacaacatgttataaatactttccactaataactcaactttatccatcacgttatcagaaagttattacttaaaaaagatagatatttagttgaatttataattgataccataacaacctgatttactttaagttcggcgtgttatacttcagagtgacaactgaagtttacttaaataaccagtaataatagaaattcatcctaaatcaaaaacaggaaggaagaaataaataccacatttcgcgtaatggcaaaaaaattgtaatcatttgatcaaatagatatcatatgaacaatacagtaaaattagcattagccttagctgcaggaagttctttgctttatctgggcctgcgaaaaaagaacaaaaaggaaaagttatatcttgctcccgacggaaacacttataaagaggatcagatttaccgtacatatgacaacaaactttataagaacggtaaagcgtttcattataatgttccggaattacatgatgatcttaaagccacccatatgaatgatgaaaaagtagttgacagtactcatcttaactacaaagctgatcagaaaaatccggtttaccatcacaaaggtttaaggcatcaatagagtttagccatcaataccatcacacactacactaaccacaaaaaaataatattatgagaaatttattatggcttgttgcagtaatctgcatcgccgtatggcttttaggaatgctcggaataattccgggtatggatacaggaaatttaattcatacgcttttggtgattgccatcatcgtcgttgtgattaatctttttacagggagaaaacctcttaattaagatagattagtcattgttctgaataatgataaagatcttatttcaatacttaaactcaaagtccggaaatttccggacttttttctttttatctctgttaagaatttaaatacaatgattcgtttttctgatattttaagatttttttaagtaccacatctcgccagatatcgtatttaaggcacggcgcttgtaaagttaatactaccattttaaaaaatatacaatatgaacaacgaaaaaacagtgtcagtattaaacgatttactgaacattacaaatgacagaattcaaggattttctaaagttgaggataaggtatgggaacaatatcctctgttgcgtgcagattatgacaaaatggtgtcacaatcctacaccatgaaaaatcagcttacagatcttattacagaaagaggtggtacaccggatcagtctggttctgcagcaggagccatccacagagcctggattgatgtaaaaaattcctttgcaggagatactgcagatgcaacactcggaaatgtagtgtatggtgaaaatgctgctatcgatgcctatcaggatgccttagacagcggtgatctatgcccggaaagttcccgtgtagtgcttgatcagcttcaccagctgaaagcttctcatgataaatttgaaaatcttgaggatttaaaaaattaaaattatgccgcatctgaaagcggagtttcttacagtggctatcagcggtttttataggaggttgagccacttctttatcaacaaaaaaataaaattatgtcaaaaaagattgcaatactggccactcatggctttgaagagagcgagctgagctctcctaaagaatatctggagcaacaaggatggactgcacacattgtaagtcctgaaaacggaagcattaaagcctgggcagaaaaagactggggtaaagaatatcctgtagataagaatttagatcaggtgcaagcttcagattatgatgcattgatgctgccgggaggtgttattaatccggatcagttaagaaccaatgaaaaggcaatttctttcgtaaaagagttttttgcccagcataaacctgtaggagccatctgccacgggcctcaggttctcatcaatgccggcgttgttgaaggcagaaacttaacgtcagttcaatctatcagccaggatttgaaaaatgcaggagccaattgggaagatcgtgaagtggttgtagattccggacttgttacaagccgtactcccaaagatctccccgctttcaactcgaagcttgtagaagaaattaatgagggaaagcactaaatttatgtgacaatatatcataaaaatgtaaataaagaaggatgctgtaacagcatccttcttatttttcatgtcgagatttaccggattttttttaacagaccctagtctcaatgaaaggaagcccggaattccaagggtgacatctctgtttttgtcttaaacagtttgctgaaagactgtgaatgttcaaatcctaactcataagcaatttcgctgacggataaactggtggtagaaagcttttctttggctttgctgatgagtttatcatggatatggtgctgtgtactctgcccggttaatgttttgagcaatccgctcagatattttggtgaaacatgtaaggtttcagcaatatactgaaccgtaggcaatccctttatcgttaaatcatcactgtcaaaatagtccttaagcagattttccagacggcccagaatctgatggttagccttctctcttgttatgaactggcggttataaaacctttcggaataattaagcaggctttcaatctgtgaaatgataatctgcttgctgaaccggtctatattcgtatgatattcctgttcaatattctcaatgatgccgtttagtgttttttgttccttttcagaaagaaacagcgcttcattgacggagtaatcaaaataatcataccgtttaattgttttggcaagaggtgtattccatagaaagtctgggtgaataagcaacatccagcccgaaccttcttcaacagaagcggggtcagactgtatcctgaaaacctgattgggttctataaacgccatcactccttcatcaaaatcaaactcctgctgtccgtagtacattttcccgccaattccccttttctgggaaatcatgtagaaatccagcacgatgctaacttcactgatatccgaaggtcttttgatcgccgaataatcaaccacactgatcagaggatgctcgggctttggcaggccacgcagcaggtgaaattcactaatggtttttatcctttggatctgccgtttttccatcgttcaaaattaaaactgattgttagagcatttgtattaccaggctaactcgtttccgttcctgtcaaaaaacttacctgatggtacgtcttgtaaagttacaaattttacaatgatacctgcggcctgctcaggagtttgagtgccctgatattggttaagatttgatgccgtataaccgggttccacacttattattttaaaatctgtttcccggaattcttttgaaagaaggacggtaaaggcattgagcgctgttttggaggcactgtacgcatcatacatccggagattgggattcggagattcgctttgaatggaaagggaacccaaaggacttgacacattgattattcttggatcctccgatttttttaacagatcaatgaaagatcgggtcgtctgtacagctccgaaaaaattggtttcaaagacattccggagattgctcatacttccaccggacatattctgcggctgttcacctgcaattccggcattgttaatcaatatatccagctgctgttctttggattccaggatctgtctcgcagattgtatggaatgaatatccgtaacatctatttcaatacattctatattctgaaaacctgccctgttcagtttttcctgtgcttctgttccatttgagcggttacggcttccaagataaacataatggccaagcgcagccagctgtctggcagtttcaaaaccaatcccttgattggcacctgttatcagtatctttttcattttaatcttaaaatttacgtttactttaatgttttgcatcggtcttttaaaaataatgctgctgcatatcttccagaagtcctatatgcacaggtttccagcccagcatttcctgtattttgaggttactcaccgggcaatccattgtaataaagtggctcatccactcaaaatgcttctgaagttcttcaccggaaacagagattaccggcagatttagcatttcgccgataacttcagctattacttttatctcaatgctatgctcttctaccacattgtaccgcgctcctttatgtcctttttccaaagctaaacggaaggcctttgccgcatccaaacgatgtactcctatccagcggtttttgccggcatccggataagctgaaactccgttcttgcgtgcctgatgaattatgaaaggaatgaaaccttcatcacctttatcatgaaccgaaggggcgagcctgatcactgaggcattcactcctttttcagccaaagccaatgcggaagcttcagatgatctgagtgaattttccacaatgctgtcttcggttataaagccattaatgggaggcaagcccagcattcctgacgttaccacaatagctttatctgtgcccataagtgtttctcccattgcatggatggcatttttgtctgttgctgctgcctcagagaatgtagttgccccacccttcataaaatcatggttgaaaccacagtgaatgataccatccgtatcagcagcggcttgtttcaggatctcaagatcttcaagactgcctcttactacttcagcgcccagatcatgaatgatttctgccgatttttctgaccgtgccagacctacaacctgatgtccggcaccaattaattcttttacaactgcagagccgttaaagcccgatgctcctgttacaaatactttcattgtattactattttgttgaagcaaagttgcaatgatttgataagcgggatgtagtcaaaagttagtttgttgtagccaaaaaagaagacgtatgaaaaatgttttaactaaaaagcatcagactgagctttaactgtggaaagcctttagctgtataaaagaaaaaagctgtaaacattgatgtttacaacttttttgtatgttttggtttctaatcttgcggagagtgagggattcgaacccccggacctgttacagtcaacagttttcaagactgccgcaatcgaccactctgccaactctccctaaactccggctataccgttgttttcagtggtgcaaatatagaacgatttttagtttctgcaaaacttttcccgcacaaattttaacaaaacttaataatagactagaaatcaagggaattatttttcactctttcgctaaagtttcaatataaaaatctaaaacacccatgttttggggaatcctattatagaaaggcttttgtataacaaaacttacagctatatttacaaacacaccacatttttcactacatttgtaaaaacacaggtattctatgacaatggaaaaactaagaactttaagaaagcataaaggttatactcagcagcagattgctgatcttcttgctaccgatgtctccaactacagcagaaaagaaaatggagacgttaaaatatttgatgacgaatgggagaaactggctaaaattttagatgtttctgtagaagatatcagagaggagaaagcagcaactgttatacagaatcttacattcaacgatagtagttctaataccagcaaccaatctggcaactataatcagtattgtaatattccagagtatttattagacaaccaacaggaatacattaatcttctgaaagagcagattaaagctttaaaagaagaaaatgaaaaactgaaaaagggataatcacttttatataagaacaaaacggctcctattggaagccgtttttattttgtacctgtaaaagtttctattcccgatcaacaatggaaataaaactgttttttaaaaggtcagacgggtatacaaactgatctccatcttcaccttttaccacaatagcagcctgttcatcgttaaggcatttgtccagctgggttttcaggtcgttcagtgatccgttgggaacctgaataatgtaagttccggtgacatgtgtgattttgatgatttttctttccatattcttttttgattagggaggctaaatgtaaggatttaacttgacaccacaggaatgattgcttacccgcaacgtttgttattctgaagaatttaaactgctattttatcatcacttatgataggaatactttttggcctggattcctacggaatgataagcagaacgctttatctatgcgcacactttgtcattccgcaggaatctaagctttattaaaatattttagattccacgttttatctggttccgctctgagtgataagctttatggatagttaattgcaggttcccaatcacagacctttccgtcctctactctcctgccggttcaaacaattcgattttgtttccttccggatccaggatgtgtacaaattttccatattcatacgtagcaatctcatccagaaccgtaaccctttctttttttaattcttctaccagcgtttcaatattctctacatgataattgatcataaattctttggcagaaggctcaaagtactgggtagattctttaaaaggactccacagtgtatatcctttcttgccggatgcttcgtctttccagtcgaatttggctccgtacgggctggtgggcaatcccaggtgggttttataccattcatttacttgttcaggatctttacacttaaagaagattcccccgatagcggttactcttttcattttttataagtttttcattttagatataatgcaaagcagagacgtttgcagtttcacaaatatattaatgttttcattagatatttgattgtgtatttttttattggaaacgcaaaggcgcaagtgatgctaaaagactttttataaggcgcaaagattttatctccgataaaattatgtactgtatcatttttatgctggaaatcttcaatttccctgcgtcttacaataaagcataagacttaaaaatttgcgcctttgcgattatccaacaagaaaagtcatatatatggaaaatgaaaaagcgcacccttcgggtacgctttgtattgtataaactgaatagtattagtgtaattcagctaaatatttctctgcatccatagcagccatacatccgcttcccgcagctgtaatagcctgtctgtagatatgatcctgaacatctcctgcagcaaatacacccggaagatttgttcttgaagaacctttttctgttaagatatatccgttttcatcaagatctacctgtccaacgaaaatatcagtattcggtttgtgaccaatagcaatgaagattccttcaacatctacagtagatttctcctgagtctggttattgatgattaccgctctttctacaaggctgttttctccctcaatcccgattagctcatggtggaatttcacttcaatattcggagtattttctactctgtgaatcattgcttttgaagctctgaaaacgtcttttcttaccaacatagtcacctttttacaaagtttggcaaggtaagtagcctcttcagctgctgtatctcccgctcctactaccacgacgtctttccctctgtagaagaatccgtcacatgtagcacaggcagaaactccgcctcctgcatattttttttcatcttcaagacctaaatattttgctgtagctcctgtagagataataactgtttttgcaagaatttctttgtttcctgcgtatagcttgtgaacaccgcctttttccttagagaattcagctttggtgatcatttcgtaatgaactttggtatcaaatctttctgcctgtttctgcagatccatcatcatttcaggacctgtaatcccggctggataccctggaaagttatccacttcagtagtggttgttaattgtccgcccggctccaaacctgtatataattcaggttttaagtctgctcttgctgcatagatagcagctgtgaaaccagaaggtccagatccaacgatcacacaatctaaaatgttttgctccataatttgctttgttcgaaaagatttaatttgaattaagaccgctaatttcggaatttttaatttctttttaaagttattttaatgatacttgtcaatatctgatatgttgaatttcgatggttgctgttgtgggattcgggttccggggttcgggatgcaagttattttaaaacctttttacccacgaatcacgaatctcgaaactcgtaccgcgctacctcgtatcccgcttcacaccttcatcttaatcttatctacgttgatgatcttatacaccagttctctgatcagctcagcatctcccatattcaccgcaccaagtccctttcctttcatatcaaattctcttaaaatggagatgacccgggtagcatgtttcaaaggataaagccttgcactttccgcgtagtctttaataaaataaggatttacgcccatctgtgaagcaatagcctgcggagactgtccggccatagtctgataaataataacgttagaaaaataattgtaaaggcttgccagcatcatgacaaagggattattcttcgggttctttcccatgaaatgggcaattttaaaagctgcattggcatttttggttcctaaagccttctgaagttcaaagatattgtactctttactgatcccgatatgattttcaacaatggttccgtcaagaatttctccttctttaaggatcatcttcagcttgttcagctcattggcaattctggacaggtcgtttccaagatattctgccagaagatgggaaatattgggagcggtattgatcttaagctttgcacattcatccgaaatccatttgggaaggttgctttcctttacagactcgctcaggaaaagtgctttagctttatccaatgccttggctgcttttttcctgctgtccagttttttgtgtttgtgagcgaaaaccaaaaccgttgaaggtaccgggttctctacataagattccagaattctgttttcctcttcgttaaaccgtaaatcctgagcttctttcacaataatcacctgcttgtctcccatcatcggaaactgtcttgccagggaaagaacttcctggtaagtcgtatcttttccgtaggtaacggtttggttgaaggctttttcatcttcttccaaaaagttgtgttcaagggcttttacagcaacatcaataaagtaggcttcttctccgtggaaaaaataaataggtaaaacttctttatttttaatatttttgaggattaaatctaattctttcatcttattaatggaacttccaaaactgaattttcaggaaacttttgattttaaattcaagaaagacaaagataagttttttatttatgatttggtccgcaaaacttatcttctgctcactcctgaggaatgggtcagacagcattggattcattattacctgactgtaaaatcttattccacttctgccctgatcacggaaaaaaagattattctgaatggtcttaccaaacgcattgaccttcttatcactgagaaaactgaacctgtaatcctgatcgaatgcaaagctccacaaatcaaattaacggaaaaaacatttgagcaaaccgccagatacaattcaattataggagcaaaggaaattattttaacaaacggtttacagcacatcaatgcctattatgaaaatgagcaataccagttttacagacctgagtaaagcttacaatatcagataatttctgaaatgatttaaataatattctattaatattctttctgagttatttttattaatttcgataagattttctttaaacactaatatcacaaattgctacacaaattacaattgttatttgttgtatttgtgaaaaaggattagtgtagtttgtattaaaataaattacaaaatatgatacgttccatcttattaaccgcaatgattatggcttcaggaacccttttcagtcaaaaacttaaatctgtttcctaccaggacggttcacagaaacttaatggtctcatcacctccaatgccggaaaaaagcttccgggagttttgatccttccagcctggaaaggtattgatgaagaggctaaaacagccgctcttgagcttgaaaagcaaggttatattgcttttatcgctgatatttatggtgaaggaaagattcctgcagacaatgaatctgcggcaaaaacttcaggatattacaaacagaattatcaggaatatcagaaaagaatatctctggcattagaacagcttaagaaaaacggggctgtttctgacaagattgctgtaatcggatattgcttcggaggtaccggcgctctggaatctgcaagaggccatcttcctgtagcgggtgtggtatctatccacggaagcctggcaaaggatcagaccagaaaaaatgaagctttaacggctaaaattctggttgaaaacccggcagatgataaaagcgttacgcctgatgattataataacctcatcaaagaaatgaatgatggaaatgctgactggcaaatcatcacctatgcgcactccaaacatacctttacagatccgaaatcaccggattacaatgcaacaatggctaaaagagcatggaatcatactcttatgtttttgaaagagattttgaaataaacataaaaaggcaaattcataaactgatttgcctttattttttacctaaatctattatggtttagcttccagctcaacatcatatttctttggagaatacttggtcagtgatcctgttgcagcatcaattccaacacctattgctcctccaagaataatattcaataaagttacagcattaaagtttttcgtaagttttacttctttcttctcaaatccttctttttcgaatgtaacggtctgcttactcagagatcttgggatcttaactgtacaaggtgtggtacatttttcaattcctttgtgaaatacttttgccccttcaggattggaagaaaaagttatcggatcccgggttcctgtaaaaatggttgcacaagaagtggtagaaagtgcaatactgagtgaaagcacaattgataatttgtttttcatgattacttagttcatttttttaagtccgcgaacttacgaaataattcaaaaatcagaactatcaatggaggcaaatatttcaaaaaagatagtattgacggacgttttcattacctgcaaactgaaatctgatctcaaaatactcaataacatggagttacttgtattttaaaaatcagcataaaaaaagcaaatctgttattgtacaaatttgctcttttatatttattatcatgtttgctaatccacaccttcctcttccctgtgcaccagttccatagaaaatgcaggaagacagatcgcaagatactcacaaggttctgaaaacgggttactgtaacggattcttgctcctttttcaataaggatactctgacctttttccagtgtaacaatctcaccatcgatttcaaactgttttttcccggaaatgatataggtaaattcatcaaactcgggagtctgatgcggctcactccactcaggaggtgctaccatatgagcaatggaaacattggaatttcccgtagaatttccccagtgttcttcgatcagctttccatctgttgtggggacgataaatggagattgctgaattttatattttttcatatccagtcttcttttttaatttcataaacaaaattagttcttgtgggttctgcaaaataagccacttcttcctcagcaattttcttccctccaagtttttccatagccttttgagaacggaaattctcttttccgacatggaaatgaactttatctacaaactgaaagatataatccagcatcagtttcttaacctgcggattaatgcctttcccccatgactttgtcccatagaaagtatagcctatgaaaatatgattgtctttttcatcaaaatcataataacggctgcttcccaatacatctccggtcgctttttcaataattttgaaagctcctttactctccatagctcctctgaaaaagttttcaaaaacctcttttttgtaacggtccttattcggatgctgttcccaaacttcaggttcggaagctactttatataaagattcaaaatccccttgctgtaaggggattaattgaaattcttcattctctaaaacgggctgaacagaaaaattcattgttagctttttttagcagaatctgattctatctttttgatttctttcagcttgtcggaaatcttaattactgtgtctaattttgaaggcttcaaaggaacttctgcctgagccatatcccacttgatcaccagatttcctgagttttcatctgtaggattcagggtaatttcaaaccactcctgcttgtctgccagtttattaaccggtaccgtaacatctactacatcctgtttaggatcgtaagtataggcaccccactgctggaagtctttattcaggatcactttccattctttttctgtaggaacaatgaataagccgtaagttcctgcaggtactgttttccctccgaagttaacggcctgtccgaaagtaattttcgtagacgagttcgctcctgctctccaaacctggccataaggaaccagttctccaaaaatcttacgtcccttcactcctggtcttccataatcaatggtaattttagacattgaaaactgctgctcaaccttctggcgcggacttgctgccggtacagaataatcctgagcaaaactgaatgctgaaactgaaatgcaaactgctattattaactttttcacgtgtaaatttttgcttaaaattacaaaaatcaaaacgaaataactttcccaaacttcgttaatttttgttttaccgatatttttctataaagatattttgaactcaaattctttttacagatgaatctgatcttgatttttaccctgaataataagcttcaaaacagaatcgctttttccagctccagtaatttttgttttctccagattcctccgccatatcctgttaactgtccgttacttccgatgacccggtggcaaggtatcagaatggatattttattcaatccattggcatttgccacagcccttacagatttaggactgccgagaatatcagcctgttcctggtagcttctggtagctccatagggaatctcctgcaaaatgttccagacttctttctgaaacgcggttcctaccggagaaagaggaactgtgaattctgttcttcttccttcgaaatattcggaaagctgttgctcgagggtttcaaaatgaggattttcaccttgaataatattggctttacaatgagctgcaatgcttttcaattcggttgggagtgcttttctgtcggaaaattccagaaggcagattccattttcatcagcacaggcgatcatggttcccagcatggtttctattctcttcagatcaataattttctccatggtgttatttttaggagatacgccaaaaatatttttaaaactttcgttaaaaccactgagactttcatatcctgtatcaaatgcaacgcccgtaaccgattctccctgctgaagttttttaaatgctgtattaagttttgacattctctgaaaggcatgaaatgttattccgtggtgtttcagaaaccacctccggaccgttgccggttcaagtcctctttttacaagatcataatctttaagtttcaaggcaggatcgtccgcaatttctttaagcagttctttaatatattgtggtgtagcgttgagattttccaaaggtctgcacactttgcacggacggtaccctttcagcatcgcatctttggtactggagaaaaactctacattttcaaatttgggttttctggccgtacaagtcggtctgcagaatattcctgtggtttttacgcccatccagaatatgccttcaaatgaagcatctttggtataagatgcctcgtacattatttttcctgtgagttccatcattaaacaaaaagggttgaaaaacttttctcatttgtaatcttctgacccgttttttccagctctttataaatgtgtctgtacataaaagcacctgaagtaattcttttaacacctagttttttaagcgtgtcaaaatccggtaaactaggaaggctcatcacatttacaggaagatcggtagacgccgtaattgttctgatatcgttttcagaagtcagtccgggaacgaaaacgccgtcagccttaaattcttcaaagagtttaattctctccagggtttcctccagcgcattctccatattcagtaaaaaaggatctgtccgtacattgataaacatcttgcctctgttctctcctaatttgatgaaaatgtctttcaatctttcgtagaaggtatttttttctgtcaattttctttcaccttcaatcacatatgtatcttcaatattaattcctgatactcctatttctaaaagtttcaggatattggatgcgacggtatcattttcactgccatatcctgattccagatctacagagagaggaattgaaactgaagctttaattcttttgatgatataaaaatattcttcaaaggtcatctgttctccgtcctcatatcctaagctgagtgcaactgccgagcttgaggttgccaatgctttgtagcccagcttctgatatactttggcactttctacattccatacattacccagaagtaatggctcttcaccatgatgtaactgtttaaaactgatcataatttttttattcaaaagtagaaagattacagagtgttatacaaccgaaaaatgaacatctatttttttttaataactttaagatgaagttcaggtattaaaataaaatagctttttcaagctccagcaacttttgttttctccagattcctccggcatatcctaccagctctccgttggaacctatcacacgatggcatggaattaaaatggcaattttattgattccattcgctgttcctacggcacgtatcgccctgggatttcccaatagttctgattgttgtttgtaggttcgtatttctcccattggaatctcacgcaaaagctgccatactttttcctgaaacgctgttcccgtggtaaacaacggaacttcaaaatggcttctttttccttcaaaatattctttcagttcttcctcaagctgtacaaaatgaggatgttctttttctacgacttctgctttcaaagcctttgacaatgctttcagctgtttatccatattcttccggtctgtaaattcaagcaggcatattccctgatctacagcacaggcaatcatttctcccagcggggtggatatgtttttttgagatataatttccatcagcttaaaattaagctttttggaagattttttcttctttttgtttcgttaaaattctttttatctgttcaatatgccttgaattatggtaaataacaaaacggaaggtatctcccagcttcagtttgatcagctttgaaatacttatacctgtttttatcttttccagatcaacatgatgggcttcttccaacaactcaagcatcatttcctgttgttttatgaacgtattcactacacttttatccagattactgtggataggattcatcgctttaagtgttttcattgtattcagtttctctttgggaagcatgcttttggcaaaataattcccaagaatcccgggtttaaaataagatcgtgaaaattttccggctgaattaatattgcgtttgatttcaggaatataaaaatctccgtagcggttgagatgttccagacattccaatgcactccagctgtcttctgaaattctgaaattgagatcatcttccggttttacagacagcattgcagcaaactctaaatgctcttttgtcctgttttttaattcatccaataatactgaggttgagattttcattacgttttttatgcaaatatcctcatctgacaattcttaaatcttgactgaactcaagattttttgagtctggataaagtttccggtgacatcctcagataattggcaatatatttattgggaacttcctgaaacagcttcggacttcttttcagaactctttcaaagcgctctccgggagcattgatgagcagatctttctctctttccagctgttgtaatacgagatcttccagaatattcatccagaacttcatatgttctgcgtctgattgcataaactcataaaaatctttttttgaggctgtttttaccattgtctttttaatcgcctgaatataaagatccgaaggcttacccgataaaaaggaatccagactgacaataatatttccggtatatccgaaacgaataatcctttcctcattttcatccatcataaagatccgcacgcttccgctttcaataaaataaatagtggtgtctgtacttcctgagattttcaggaactcatttctcctgaattctttcttttcccaatggattccgctttgaagcaatttttcaaccatttcattttatttatttgcttttccaaagataatgggtaattttaaagttttaaaacactaatcactgataatgctcaaaagaacagtccttttcacactgctttctgcaggattctgtacaatgaaagcccagcagaccattcctttcagaattacaaaacacaataatatcattgtgaaaacgctggttaacaaaaaagattcactagatctgatgttccagattgctatgaaagatgatgcaatttctcctgatggtaagaaaaaggcgggtcatattattttcaataaagaagaactcagcgatgataatacagttgagatcggaaaaatcacacaaaagaatgtacgcttttttaataatcagttgacaggacatgaagctgatggaaaaataggaaccggaatttttgagggtaaaacttttaaaattgattatgataacaatcaatttgtgatgtatgatgccatgcctgatgtgaacggttatcagcccatcaatattatcttagatcatgatggattttatctggccgctgataatgtccttgagggtgatcaacagcaggaaacctattttgttttacaatcaggattctccggagcaatattgtacagcaacaaatttgctgaagaaaagcatctggagaaaaaactgaaagtaacgggagaaaaaacgctgaaaaattctgaaggaaaaactttaattaccaaacaggctgttctcccttattttaaattgggaaacagtgtattcaaagacgtatctgtagggttcttttcaggagagctgaaaacacaaaatgtcagttatctgggtgctgatatgctccgcagatttatctggatattcgatgccgacaggaaaacggcttacatcaaacccagcaaatatttctcagaaccttattacaaaatgaattagaaaaatgataaacactttaatgctaaaaaaaattatgaaacccaaaacggttgctgctcttttatttttaccattggctgttgtaagctgcaagaaagaagagaaaaaaacagctgccacagaaacaaaaatcaccaatgacactataaaaacgacaaaagcagaagagaaaatagattattcggatttcaatatttttaatctgtctgtcatgtcatcagctgaaaaagattctgatatagatatttttatttcggtttcggacatttacaagggggctcagcctgttcctgaaaacattattaaaaaccataagcagatgacttatgaagaactccagcattttgatctggatgctcccagcagaaaaaaactgctcaacggaattcatcttaccgaaaatgattccctttatatttatgagtattggtctaataagcttcagagaatgccggtgagccaattaaaagctgtggcctatttaagcccttattcagacagtgaagatttggatccggatgcttatatgatgggatttcaggtagcaacgcaccaaaaaacaacggagtacgaccggtacattaatgctatcgcttattttggaaagaaaaatcctttcgttgagaataaaatgaaggctgtaaaatggcaaaaagccggtgctgatatctcaaaaaaatactttagccattcaaaacttactcagggaaatacctaccaggcgaagtatgaaaacatgacctattatctgcaggattatcttgaagaaggaaatacggtggaacgcaggcttgcagtcattaatgatcatcaggaaaagattgcagaaaaaacattcagccttgcagaaagtgatggcggggaattccttcctctgtatggaatagataccgatgaagctaatatattccaatacacaggctatctttttaaaggaaaacctcctgttattttcggattcattgcacagtcttttggctgtccttccattagttttttagataaaaatgagaaagatttttggatcaactgtgataacaggcattaaggaaaaaacaaaatggtaaaatgctgttttacacttaccatacattatgaaaatacattatcaggagcaggttaacagcaaacctacacatgtattttcatagtgttcatcaattatacaaccgctgaagcaatcatcgacatataataattggcacagtgcaatgcattgatcagtaatatttctttagccgggtacatttcgaatttttctgtggtagtaatctgatattcatagttcatggaactccacttcagatgcggtttcattacaaatagttcatttccctgctgatcggcaaggacaaatgattctttgaaaattccacggtgcttgaaaagaaagccttcttttacgctatcaaaatatgtctgtattacaatttcaccattccagttcatccgaaacttaaggagtactttttcattgtccttaagttcaatggtggttccccagaaacctttgggctcaatgagataaaaacggttggcaatttcaatctcagcattaaacttaaaccagctttcataaataagcctgcctatcatctggctttctttggtgatttcaaaggataaagagttgtgtgattttgcgtaatattctgccatggctgtattttggtttggtgaattttattagtttttcaaatagtaataacggcctgaattttaacgctctaatttataaataattcggtaaacataatgtatttttaaaagtgatctgataaaaaacgattaattattaaccatggccgtttttttccagatttcaattgaaaaatgttgaaaattatttcataattagattcaaacctaacagattttagaaacctgttaggtttagcggttaaaattgcttatcatgtcatactattctttcttatgaaatagcatctcatttttacttattcaattttaaatatataatcatctttaatgctctcggattttttgattatctcgtctatactatatttttgtccgtcaatttcaacatccacgatataccatttccacataaaattatgagttttttcaatccgcactgttgaatgagggttgatttccagcgtggtaccggagctgtcaagctttttttcaagagattttaaatttttattttttctaaaaaattttggctgtacaatatcgttctcataattgaaacttagtgttccataaaaaccttcagataattctttgaccattctttttttataattaatcttcactgttttcttcgtttcagttaaattctgaatataaaagtctgttgggattgaacatccgcaaaatacgagcacaaaaacagcactcaaaatacctttaaaaattgcattcatataattttagctttacatggtttttacaaaaataaacagaatcttctgtctttagattaacagataaaaaaattccgcaagaaaacttgcggaatttaagtattatttctgttcgaaaattacatcgtctccattttgaagctcatgctttcgattacttttagaattgcttctaccgtatccattgaagttagacaaggaacaccgttttccacactcattcttctgatctggaatccgtctctttctgcctgtttaccttttgtagtggtattcacaacatactgaacttttcctttctgaatcaggtcgataagatttacattttcctctcctattttgtatccgatcttgcaagggattcctttttcttcaaagaacttcgcagtcccttccgtagcccagattctgaatcctacttcatggaatcttgctgcaagcgctgccgcttcttctttgtgcttatctgctactgtgaacaggatagaaccgtgcataggaacttttcttcctgctgctaccaatcctttgtataatgctttttcaagggttgtatctttccccataacttctcctgtagacttcatttccggccctagggagatatcaactttcgttagtttagagaatgagaatacgggcacttttacaaaaactccttctttgtttggaaccaatccgttttcgtaacctaagtctttcagcttttgtcctaagattgcctttgttgcaaggttagccatcggaacgtctgtaattttagataagaaaggaactgttcttgaagaacgagggtttacttcgattacatatacatttccttcgaaaagaacatactggatattcatcaatccgataacattcagtccttttgccagtctcttcgtatagtctaccaaggtatcgatttcactctgagagatgttctgtggcggatatactgcgatagagtctccggagtgaactcctgctctttcgatatgctccatgattccagggatcaccactgtttcaccgtcgcagatggcatctacttcgatttcttttcctaccatgtacttgtctaccaaaacagggtgttcagggcttgcatctacagcgtgctccatatagtgagccagttctgattctgcatatacaatttccatcgctctacctccaagaacgtagcttggacgtaccaataccgggtaaccgatttcgttggcaatttttatggcttcttctttcgaagttgaagttcttccttttggctgaggaattccaagctcctgaagtgctttttcaaatttatctctgttttcagctctgtcaagatcttccagggaagttcccaggatctgtactccgtgagaggctaatttatctgcaaggttgatcgcagtttgtcctccgaactgtaccactactccttttggtttttcaagctcgatgatgttcattacatcttcttcagtaagtggctcgaagtatagtttatcagagattgagaagtctgtagaaactgtttcagggttgttgttgatgatgattgcttcataccccatttctttgattgcccatactgagtgaacagttgcgtagtcaaactcaactccctgtccgattctgattggtccggaacccagtacaacaatcttttctttgtcagaaactacactttcgttttcttcttcgtatgttccgtagaaataaggggtttcactttcaaattcagcggcgcaggtatctaccattttgtaaaccggcattacaccgttttcttttctgaagttgaagacttcacgctctgttacctcccaaagaacggcaatattgatatctgcaaaacctaatctcttggcttcagttagtgtttctttatcaaatttgttggcagcgattactttttcaaaatcaaccagctttttaagcttccagataaagaacttgtcgatcttactccattctacgatctgttcccagtcgtatcctcttcttaaagcatccccgatgatgaataatctctcatcatcacacactctgattcttctttcgatttcttcagcagtaagtgcctgagcctgttttgtctttaatcctaaatgtctgattcctgtttctaatgaacggatggctttctgtaaagattcttcaaggtttcttccgatcgccattacttcaccggttgctttcatctgggtggaaagtcttctgtctgccgtttcaaatttatcgaatgggaatcttgggaattttgttaccacatagtcaagagcaggctcaaaacatgcgtaagtttttcctgttaccgggttcatgatttcatccagcgttaatcctacagcaatctttgcagcaatctttgcaataggatatcctgttgccttacttgccagtgccgatgaacgggaaactctaggatttacctcaatgatataatagttgaatgagtgcggatctaaagctaactgtacgttacatccaccttcaattcctaaggctctgatgattttcaatgaagcgtttctcagtaactgatactctctgtctgaaagcgtctgagaaggtgccactacgatagagtctcctgtgtgaactcctaccggatctatattttccatgttacaaaccacaatggcgttgtcgtttgcatcacgcattacttcatattctatttctttgaaacctgcaattgatttttcaataagacactgtgtaaccgggctgtgctttaatcccagttcagcaatttctttcaattcagcttctgtggaagcgataccacctccggttcctcccatcgtaaaggcaggacgaacaattacaggatatccgatttcatccgcgaaagcaagggctccttctaccgtgtttacgatatcagattccggtaccggctcgttcagttctctcatcagctcacggaaaaggtctctgtcttctgctctgttgatcgcagaaagctttgttcccaatacttccactttgcattcttcaagaattcctgatttttccaattctaccgccatgttaagacctgtctgtcctcccaatgttggtaataatgcatccggacgttcttttctgatgatgtggcttacaaactgtaatgaaatcggctcaatatatactttatccgcgatttccacatccgtcatgatcgttgcagggtttgagttgatcaaaattaccttgtagccttcttctttcagagacaaacaagcctgcgttcctgcgtaatcaaattcagctgcctgaccgatgatgataggtcctgaaccgattactaaaattgtttttatatctgtacgttttgccatttttcttttttaattggggttaagaatcaaattcttaaacttcgtattttttacttttataagacttacaattgtactttgtcattccgtagaatctaactcattatagttgagattcttcattacgctgctgcctcactctgaatgacaaacaagcagtcttatttcttaaagtcttccatcatttgaatgaactcatcaaacaggtagtttgcatcttcagggcccgggctcgcctcagggtggtactgaactgagaaacaagggtggattttgtgttttaacccttcgtttgttctgtcgttcagtgcgatgtgcgtttcgataaggtctgttccttttaaactttcctgatctacagcatatccgtggttctgagaagtaatagctactgtatttttctcaaggtctaacaccgggtggtttcctcctctgtgtccgaatttcagcttgaaagtttttgctccgcaggcaagaccaattaactggtgccctaaacagattccgaagatcggaacttttcctaataatcctctgatcatatctaaagcatgtggtacatcttcagggtcaccaggaccgtttgacagcataattccatctgggttcatcaacaggatttcttctgctgttgtgtcctgagaaacaacgatgatatcacagtttctttgagacagttctctgatgattcccagcttggcaccgaagtctaccaatactactttgaaacctctgtttggattagcataaggtgtttttgtagaaacttcctctacctgattggttgggaaaactgttgatttcaattctgaagctacagctgcttcgtcagcatcagcgtttacgatttttcctttcactactccgtggttacgaagaactcttgtcagtcttctggtgtcgattcctgaaattcctgaaaggtttttctttttaaataattcatctaaagtgatctgagtacggaagttggaaggaagatcgcaaagttcttttacgataagccctttgattgccggctcgatactttcataatcatcacggttaataccataattcccgataagcggataggtcatacaaactatctgaccgcaatacgacgggtcagaaatcaattcctgataccctgtcattccggtattgaaaactacttcccctgcagtttccaattctgctccgaaaccttctccatgaaacacttcaccggactccagtattaattttttcttcattttaaacttttatctcttattatttatttatatgtcattaacaggccgcctctacggggctctttaccttttaacttcttacttttaccctggctattttaccttgtcaaattatttaaaggtataccctttactttccagcgcatctttcagaatagccattcttgcgaatacgccgttttgcatctgcttgaagactcttgatctttcgcattccacaagttcagagtcaatttctacccctctgttaataggagccgggtgcatgatgattgcttcttttttcatcgcatgctctctttctttagtcaggccgtaccttttatggtattccgaagcggtgaaactcattgctgaatcatgtctttcatgttgtattcttaacagcatcagaacatccacttcaccgatcagctcatctacggacatataagttccgttaatcagtgctccttcgtcaaaccactgttccggtcctgagaaatatactttagcacctaatcttctgagtgcctctgcatttgaattagcaacacggctgtgttttacatctcctacgattcccactttcagtccttcaaactttccgaattcctgatagatggtcagcagatccagcatacattgtgaaggatggtttcctgttccgtctcctccattgattacaggaatgctgatatttttaagttcctcgaagtatctgtcttttttatcacggattaccacaaggtttactcctatactttcaatagtctttactgtatcataaagactttcgcctttgtttaccgaactgtgtgatgcatcaaaaggaactacctgaagtcccagttttctttccgcaaggtcaaaacttgttttcgttcttgtgctgtcttcgaagaaaaggtttgagcaaaaaacttctccttcaattttagcagttttaccatttgcaaaagccattgcttctgtcagtatactgttgattctctcggtgcttagttctgtaatcgtaaacataattcttattttttggcataaaaaaaagcgaagacaactatcttcgcttaataacaataaatatcgtaaagggcgctttcgcccggtaaatctaatgatataaatgcttttttattcattaggtgcaaagatacaacaattttatgaacctacaaaaattatgttcaaaataaattaaaaacttccgtctttccttattctcattaaaaattaatatttttgttatcactcaaatatattctatggatttaaaagacaaaatgattctcagtattattcaggaagactctacactctcggtaaaggaaatttccgaaaagataggtcttacctttactcctacgtatgagcgaatcaaacaattggagaaacaggggatcattcagaagtatgtgggccttttaaaccgtgaaaaactgggtttaaatattgtagtctactgtaatgtccgtctcaaggaacaatccaagaaagtattggaaacttttgagaaccatatcgggaaatatgatgaagtacaggaaatcatcagtctttccggggagtatgactatatgctgaagattattgccaaggacatcaattcttataacgaattcgctgtgaatgttatttcaaacattcctaatatcgggcagtaccacagttctatcgtgcttcacgaggtaaaaaaatctaccaaattcaaaattgatctggaataatcccttaattttaaactcattattcattcctatttcaattactgaaaatctttgattttcttgcgtcttaaaagtaatatctattatacaattccttgcgcctttgcgtataccaacgctttttatttctaatatcttgttagaaaacgcaaagacgcaaaagaaatttattaactttatgctttaaggcgcaaagattttatctccgataaaattttatgcagcagatttactctcaatttccaaccatagtcagttaaagatcaatcatcaaattcaaagagcggagtaaaatccaaccattaagatcacttaagcagataagatttattaagattaaggtttctacaacgaaaagacagcaggctaaaataatttagaaattccactgatttttgcttaagttctgatgaccttaatggcttagattctaacccaataatttatttttcagtttattgaactgatattctattttatccagacaaaggttgccgatacttccctggtgggtatgttcaaggttgccgggttcaaattcaaattcattgttttcaatctcctgccccacttttacatacgcatcacggaatgaacttccgtttttaacctcttcattgatcttttccacactgaaaaggtatttgtacttctcatcttccagaattccatcttttacctgaatattcggtaaagtatagcttaagatttccagacattccttcaaagaatctatcgcagggaaaagaatttccttcgtcaactgtacatctctgtgatatcctgaaggcagattgcttgttaaaagaatcagttcattgggaagagactgaattctgttgcaacgtgcacgaatcagctcaaagatatccggattctttttatgaggcataatactgcttcctgtagtaaattcttttggaaagctgataaaatcgaaattctggctcagatacagacatacatcgtaagcaaacttccccagcgttcctgccagagtcgccatagccatagccagcattttctctgacttcccacgggtcatctgagcgtacaccgagttataattcattgactggaaccccaggttataagtggtactttcacgattgatagggaatgaagaaccgtaaccagcagctgatcccaatggatttttattaatgatattctttaccgaaaacagcatttccacatcatccaaaagtgcttccgcataagctccgaaccacaatccgaatgatgaaggcattgcaatctgcaaatgggtatatcccggaagcagtacatttttatgttgatctgccagttgaattaaaatctggaaaaactcatctgtaagcgatgttatttcacggatttcatccagcaaatacaatttgatatccagtaaaacctgatcatttcttgatcttgcggtatggattttttttcctgtatctcctaattcttcaataagaatagcttctacctgagaatggatatcctcagcatctttatcaatttcaaaactaccttcttcaattttgtataaaatactgtttaaaacagatagcatctgttctgattctttctgagtgataattccggtttctgccagcattttgcaatgcgccatagaacctttgacatcatatttagctaaacgctcgtcaaagtcaagatctttaccgactgtaaagttattgactaatatattggtggcaaggtcatccttctgccatatttttttcatgataatatttgatttaaatattcgttggttttgacatgcccggcaaggcaatccttattactattaactataaaaaaacatttccttatgtaaagccttcatttctaattttcttcttgcataaatcttattaaaaactaaacttttagcgcctgccggacagagtcaaaacatatattgagctggaagcctgaggctggagctggaagctaataacatgcttcaataacttccctcttcctacacccatcttccatttttataacactttttctaaaattctgatgtagatttctataccttcttctatttcatggatatagataaattcatctgcagtatgggagcgcctactgtctccaggtcctattttcactgatgtacatggaataatagcctgatctgaagaggtaggtgatccgtaagtggtccttccgatttcaattccagcttttacaaacgggtgatccatttcgatctttgaagaattgagtctgaaagatctggccgtcagtgtagatttcatctgagactgaatgatttcaaatgcttcttgattggaatattcatccgttacccttacatccagtgtaaaattgcatgattccggaacaacattatgttgtactcctgcatgaattcctgataaagtcactttaacttctcccagatattccgaaacctttggaaatttaaaggcaagaatattctgcagatcctgcatacattttataattgagttatcatcattaggatgagcggcgtgagaaggagtccctttcatttctccatcaatcacaagaagtcctttttctgcaatcgccaggttcatctgcgtgggttctcctacaatggcgagttctacgttgggtagctgcggaaataaggcttcgattccatcaaatcctgaaatctcctcctctgccgtcaaagcaataactaaattatattttaaatcttctttatcataaaaatgtaaaaaaacctgtgccatagcaaccagagacgccccggcatcattgcttcccaatccgaacagtttcccttctttttcgataggcaagaacggatcaagcgtgtacgctttattaggcttcaccgtatcatgatgggtattcagcaaaacagatggcttaaatacatcaaagtgcttgttcaccgcccagatgttgtttttaaaacgcttggtaggaatctgatgttttttgaaaaaattctcgatttctacggacgtattaaattcatctttactgaatgaaggaatttcaatcaaattcttaagcaatccgactgcattattcaacagttcttctttattataaacagatttcagttcctgcatgatgattttctatatggtttttcagttctgtttctttgatcagaaacactttatttacattattctttatcgctccgagagcattttcaagtttgggtaaaatccctttgtgaagttttccttcttcttttaataccgtgaattcttcctcatttacacttttgatcacagattccggatcgtttacgtcctccagaacgccttctttatcaaaacagtataacaattcaacctcatatttctcagagagtgactgtgcgatcacagaagcaatggtatctgcattggtattgaaaagatttccttttctgtcgtgggtaatggcagaaaacacaggaacaagatccatctttattaattttgaaaccagcttcctgttgacacttttcttggtaatatctcccacaaatccaaaatctatttcaggatgttctcttttcttagctttgatcagatttccgtctgctccggaaaatcctatggcattgcattttttctgctgcagcttttcaacaatgttcttattgattcctcctgcatataccatcgtgacaatatccaatgtttctttatccgtaatcctccttccgttgatcattttctgttctatccccagtttatcagccaacgttgtagccagctttccaccaccatgaacaagaattttcttttcattaattccggaaaattgttctaaaaactgatccagcaattgttcatcatcaatgagtgctccgcctatttttatgatgtatattttctgtttcattagaaaggattaaagattaagattatagggtgtattattacttaatatcatccaaaatttcactgaacacagcctgtacagagaaaatacggttttttgcctgctgataaatgattgaatggtctccatccattacctcatcactcagctccacattacggcgaaccggaaggcagtgcatcacttttgcattattggtattggctaatttttcattcgtaagcatccattcgccttttacttcaggcattgctgcataatcatcaaaagaagaccaattcttcacatagataaagtctgcatctttcaatgcttcatcctgatcatggattacttttacatctttggtaaaggttttatctaaatcatacccttcgggattggcaatcaccaactcaacatccatttcctgcatccactcggcgaaagagtttccaacagcgtgcgcgataggtttgatgtgcggcgcccatgttaataccactttcggcttgtgatcttttttccagttctctgtaattgtgatacaatctgccagactttgcagcggatgacgagttgcagattccaatgaaaccacaggtacctttgcatgcttttcaaactggcttaagatgctttcattcacatcatcttccttgtttttcattcctgcaaagcaacgtaccgcaatgatatcacagtattggtttaacacttcaatagcatctttaatatgttctactgtatcaccgttcataacggctccgtcagcaaattcaagattccaggcttcctgggctgcatttaatgtcaatacattcaacccaagattctgagcggcaatctgactgctcagacgggttcttaaacttgaatttaaaaatacaagccctatcgtttttccctttccttttgctgtttcagtaaggggatctgcttttatctgtaaagctttttttatgatttcctgtaagttttctacatcacttacagaggtaaattttttcatttggtattttctattttttttcaatggacaaatggaatatccatttcattttgaattgattttaaagattttgcttacacatttttgagagttttaacgcaagggcgcaacgcttttcactgatgcttttttcgttcgcaagggcgtttcactcagcaattgacgtttgtttttatcattctgagattcttcatttcacttcgtttcattcagaatgacaaacgcagcgttaaagcttttaacctttttgctatttcgtcatttgccttttaaatatttccaagcactgctttcaaagcattgatgaaaagatccgtttcctcttttttgatattgagcgccggaagaatcctcagcaccgttttatcattcgagtttccggtgaaaatatgatgatcaaaaaggagctctttccttatttctgaacagtctctgtcgagttctattccgatcatcaatcctttccttcggatggatttaatatgtggtaaatctttaatttcattttcaatatactcacccatttcctgagcatttttgataagattttcatctttcatcacatccagcacagcaatggaagcagcgcaggcaaggtgattcccgccaaatgtagttcccagcaaaccgttacttgcctggaattttggatggatcaaaactccgcctacaggaaatccgtttcccattccttttgccgtagtaatgatatctgcttcaactccaaattcctgatgggcaaagaaatatccgcttcttccatatccggactgcacttcatccaaaataagaacggcgtcatacttttcgcacagttctttgattttagataaaaattccggtgttggaatcataatacctcctactccctgaattccttcgatgatcacagaagaaatttcatttccagacttctcaaaagtctcttcaagctgctgtacatcattccattctgatttgataaatctttcggaaaagttaaccggagctacaatttttggattatcagtcactgaaaccgccgcagaagttctcccatggaatgaacctgagaaatacaacactttgcttttcccattatgaaatgaagccagttttaaagcattttcattcgcttcagccccggaattacataagaaaagattataatcttcatacccggaaagctttcctagtttttctgccagctcagtctgtaattcattctgaacagagttggaatagaaagatattttttccagctgatctttaagcttattctgataatatggatggttgtggccgatagaaattacagcatgacctccgtaaaaatcgagatatttctctcctttatcatcccaaagaaatgatccctgagcttttaccggattgatattgaataatggatatacgttgaataaattcatgtcttttttataaatgataattgataaataatgaatggtatgggattaggatttcaagttcctacacatccatctactttccatattaaaatgctaccggtttcaggttcagtcctgcattttcttcccagttcatggccagattcatattctgtacggcctgccccgatgcaccttttaacaaattgtcaatcgctgagtgaataacgacaacatttccactcttttcgatctgaatcacacagcgatttgtattgacaacctgctttaaatcaactgccttcctgcttaccgtaacgaaaggctcctccgcataaaaatcctgatacaattgttctatttcctccagctctaaatccgtcttcatcgtggaacttgtaaaaattcctcttgcaaaatctcctctccatggaacaaaattcaggtttacttctttattattgaatgaaatcagctgctgcaaaatctcatctacatgctgatgagttaatgttttgtatgctgaaacattatcatttctccaggtaaaatgagttgtagcctgcaaggactgtccggctcctgtagaacctgtaatccctgtggtaaaaacctcatttaacagtcctttttctgccaatggcaataaggccaattgaattgctgttgcaaagcatcccgggttggcaatgcttttggcagttgccagttgttttttattgatttccggtaatccgtagataaaatctctgtttccgaaatttccttctaaacggaaatcgtttccaagatcaataaccagcgtttcctctttaacaggattctgcgttaaccagttttgactttctttatgaggcagacacagaaaaagaatatctacatcttcaggtttatctgttaaaatcatttcacagaccgtcgttaaatccgggtacagatccgaaatgcttgttcccgaattcgaacgactatataaaaaactcaatgtcacatggggatgaaaagccagtaagcgtatcagctcacttcctgtataaccgttggcaccaataattcctactgttttcttcattttgattctgacagaattttgttctgcctttcattaaatcgtcccttcggaactagttgatattctggttaatctggtggtatatatttaaagaattgcttacaatcttagtatacccttttacatcatcgcctgtccatgctctgttggcttctccataacttccgaatttatcggacatcaggtcatgatcagattcaattccattcaaaataaatctgtatggatgaagggttacaaatactttcccgcttaccgttttctgagaatctgtaaggaaagactctatatttctcatcacaggatctaagaaaagtgcttcgtgaagccagtttccataccaatcagataactgcgacttcatcatttgctgatattttgaaagcgtatgcttttccaataaatgatgcgctttaatgatcaccgatgctgctgcagcttcaaaacctacccgtcctttaattccgacaatagtatctcctacgtggatatcacggccgattccatatgctgatgccagttcttctattttttgaatagcatatacagaatgttcaaaactttctccattcacagcaactacctcaccttttttaaactcaatctccagttctgaaggctgagtttctttgatctgagaaggaaaagcttcttctggaaggcaatttcttgaagtcaatgtttcttttcctcccacagaagttccccaaagtcctttattgacagaatattgcgctttctggaattccatttcataaccatgttccttcaaaaactcaatctcttcctcacgggataatgccatatcacggataggcgtaatgatttcgatattcggacacattacctggaagatcaggtcaaaacgaacctggtcatttccggctcctgtactgccgtgagcaatagcatctgcctgtacttcaatggcatattttgcaatctcctgcgcctgaatggtacgctcagcacttacagaaagtggataggtattatttttcagtacattcccgaaaatcaaatatttcacacatgaattataatagtcttcctgagcgtctacacacctgtattcttttactccaaggtttaaagcttttctttccaactctttttcttcttcttttgaaaaacctccggtatttacagtgactgcatacacatcatatcccagtgtctcactaagatatttagcacagtaggaagtatctaaacctccgctaaacgctaagatgactttctttttcatctggattttttttatttttattaattgccgcattgaattccccaacagtatcctgtacagaatatttaaaatctgcagggttcatttcattatatttattttcagggcggtcatttaccgcctcattcttttttatattgtcaggaacaaacaacatcgctgtacataaacagtttttacgttccttcatcatcaggatttcatagttcacacagttcttgcagccgttccagaattcctcatcctgagtcagttccgaatagatcactggtttatatcccagatcactattaattttcattactgccaaacctgttgttaatccaaatactttcgcatcaggatatttatctctagataactggaaaactttctgcttgatctgagtcgctactcccccgttcctgaatttcggcgacacaatcagtcccgaattggccacaaacttcccatgtgaccaggtctctatataacagaaacctacccactcaccgttttcagtagcaaccacagcattgccttctgaaatcttcttgctcaaatattctatggaacgttttgcgattcccgttcctctacgctgtgcagaatcatacatttcctgctgtatttcactcacatacattagatgttcgcatgaggaaatttctatttccatttatttatctaaattttttggcaaatttaaaatataatttcttttatatccaaataaaaaagatattttttttgttttaaaattttagacaggtaaaattatctttaaacaaaattatacatttgctaatttattatatatttgctaaaataatatagttatggaaaatacctgtccaagatgcaagagtaccaaagtggtaaaaagcggcattgtcaatgacaaacaacgcttttactgcaaagactgcaattattattttaccgttaaaaaactggggaaacaaattgatgactactatgtcaccaaagctcttcagctttatcttgaaggcttaagctaccgtgaaattgaaagaatcatcggagtttctcatgttaccataagctcatggattaaaaaatacaacattacccgacctccacactctgaattccatcctgtctataaaatattaaagcagaatgaactgatcgactatattgctcaggaagaaaacattaaaaattccgggattatcatcacccaatttgctgataagtatatgctgatcaagtgggaaaggtttaagaagtagagagggatgcgagattcggattacgggttacgggtgagagacaccagacccaaagcacaatacaatattaaatatcaaccacttacaaacaatttaaattaaaaccccggatcacaaaacccgaaacttataacataacatcaattataactataccattaccaataatatatattaaattttcataaacaaattattaattacaatttggcattcataaaaaacaacgccaaaaattgataatttatgaagaaattacttacatttattggagtagccttaatcagcagttctctatactcacaaggttctcctgattatggcagtggcttaaaaatcaaccttaatcctgatggtgataaatttgtcagatttattttatgggaccagctttggttaagaaacacttccatgaacccgggaagtatggtaggcggtgaacctacagacaattcctggagcataggaaacagacgattacgtgctcttacctacgcacagatttctaaaagatacatgattcttcttcactttggaatcaataaccagacctttatcaatggcggagctacaggcacttccgggacaggaggttacggaaacggaaagaaaacccagctgttttttcatgatgcctggaacgaatatgcagttattttacctggagaagcgggaaaattcagtttatctttaggagcagggcttcattactacatgggactttcccgcatgaccatggcttctacccttaatttcctcacattggattcccccgttttttcatggccgttaattgataattccgatcagtttgcaaggcagcttggaatgttcgccaaagggaaatacggaaaactcgaataccgctttagcttaaataaaccatttgctacggatctcgttcctgtgaacgtgacagatccttcaaaagcagtagccgtagacaataacggaaatccaagtttttcaaaagcaggatatgttgagtatcaatttcttgacgaagaatccaacactcttccttttaaagtaggatcttaccttggaacaaagaaagtctttaatgtaggcgccggtttttatcaccaggctgacggcacaaggacttccgtcaattcaaatattgaaaagcatgacattactctttttgctgtagatgcgtttgcagatattcctttgggtgaggcaaaaaacaaaatggctgtttctgcctatgccggatattataattacaatttcggacccaattatgtaagaaatctgggaacaatgaatattgcagcatctgatcctaattttatcgggaataaagccatcgcaggacctggaaatctgcaaccgaccatcgggacaggtaatattatctacgcacaggcaggtttactcttaccaagtcaggcagaaaagccaaagatcagaatacagccttttgcggcatatactcacaaaaactttgaggcttttgataaatcatcctcccagtttgatgtcggtgccaattggtttatagacggacatcatgcgaaaataacaacacaatattcaacaagaccggtttacacaagtcctacggaaagcccatcttcaaaaggagaattcattgtacagtttcaaatctacctttaaaatttgaaccattaagaatagtaaaaaatttaagataagttaagctctatcaaagatggatagcaagaataccgctgaataaaatagctttagctatcatctcaaattattcttatcaacttaaaatcccttaatagtttaaaacaaattaaattcctattccactaacatcaaaaactaatcaatatgagcgaaaatcatcacgaaagctacgaaaatatgaccgacaggcagaaaaaccgcaccatctggagcgttatcacagcctcatccctcggtacactgatagaatggtatgacttttacatcttcggaagtcttgccgttgtcttagcgaccaaatttttccctgcagacaatcctacagccgcattcttatctactcttgcaacttttgctgccggatttgtagtaagacctttcggggctttatttttcgggagactgggagatcttatcggaagaaaatatactttccttgtgacactgctgatcatgggtttttccactttcctgatcggttgtattccgagttatgaaaccattgggtttctggcacctgtcttagttttaattttaagattgcttcaggggcttgctcttggaggtgaatatggaggtgctgctacttacgttgcagaatacgcgcaacctcatcgaagaggttactggacgtcatggatccagactactgcaacagcaggactttttatatcattaattgttattctcattaccaaaacaacactttccgcagaagaatttgacacctggggatggagagttcctttctggatttccattctgatggttgccgtgtcttacatcatcagaaagaacatgaaagagtctccgctttttgcgaaagctaaaagcgagggaaaaacgtctaaaaatcctttaaaggaaagtttcggaaataaatataacttcaagtttgtattattggctttattcggagctgcgatgggacaaggggtaatctggtatacaggacagttctacgccatgagtttccttcagaaagtaatgaatgtagaatctgctcaggtagattcattaatggctaccgctttattcttaggaacgcctttctttgtctttttcggatggttgtctgataaaatcggaaggaaagcagtaatgatgaccggcatgctggttgccattttagcgtacaggcctatttatgacagcatgttcaaaagcgtgagccttgaaaataaaacggttgcttccaatggaattactgaaaaaagaacagcaaaaatccataacgatattgcaacagacagcctggttactttccacaaggaaaccctttatacagacggaaccctgatcaaaaaagacagtgtagttcactggtcaccttcaggagttgtgatgaaagacggaaaagctgaagagcctaaagtttcccaaagcttacaattaagtgacaataccaaatggtacctggtctttcttgtattcatccaggtaatatttgtaaccatggtatacggacctatcgcagctttccttgttgaaatgttccctgtgagaatccgatacacctcaatgtcgctaccttaccatatcggaaatggagttttcggaggccttcttccggcagtggcaacttatcttgtaaccaccggaaaagaagcagggcatgcaacatggtatcttgaaggattatggtatcctatcggagtggctacagtatgtctcatcatcggattgttttatcttaaaaataagaacaataatcttcacgattaagtactgaataactcaaatttttattaattttaaaactactaaaatgaacggactaaaaaaaatattaggcattctctggatcgccattgctgtaattgtaggatatttcggaattaccgtattgggaattccgaaaataacctccggaaagcaggaagatctggtttttggcatcattattctttttgtgctgatgccgattatctctggcggaatggcagtttttggatattatgccttaaaaggagaatattctgacgacaaaatttaaagcaatataaaaaaacagataattgatggatgccacattcatcaattatcttttatcaaagaatcatttatgaaaaaaagacacgaacaaaaacttatcatactgagcatagggcttatgattgctttcagtattcctgtttcactgcttttcaatagtgacagggaggttttgggctatcctatgattcttatttatatgttcgtggtatggatgatttccattatcatttcttttgtaattgtaaaaaggtatgatgagtagttttgccttattttttgtggttttgttttatctggctcttctgttcttagttgcttatttagcagagaagaaaagaagtaagatctggatcaacaacccttatatttatgctttgtctcttgccgtttattgtactgcctggacgtattatggaagcataggcgttgcagcaacaagcggattaaattaccttccgatctacattggccctatcatgattattccggcatggatctatatcaacacccggattgtaagaatttcaagggtcaacaaaataagcagccttgccgattttatttcgttgagatacgggaacagcagaagcctgagtgctattatcacggtggtttgtctgctggccattgttccttatatcggactgcagatcaaagctatttctgaaaccttccatctggtaacggaaactccgatgtctaatgatatcctgaccgataatgcaacttttgtggtagttttaattgctttgttttcatcttattacggaacaagatatgtggatgcttcagaaaaaagacttggcattatctcagcaattgcattggaaagctttttaaaattattttttatcatcattctcggtttttttgtcatttattatgtctttgacggattctcagacatttatgagaaagcaagtaagtttgcagattttaaagaaaaaaatacctttaacggaattgaaggtgccatgaactggatggttctttgtatgatttccgctacagccatatgcattttaccaagacagtttcacactgcgattgttgaaaacagacaggaaaagcacatcagaacagccatttggtttttcccgctttatcttttgatcttcaccgtatttatttttcccattgcctggggtggcagattgatttttgacggacaaaaagtaaatcctgagttctactctattttgattccacagcattttgacaacaccttaatcacggtatttgtatttctgggaggactgagttcatgtatttccatgattattatttctgctattactttatccattatgctttccaacaacctcatcattccatacggattgctgggaaaactaaagtctgaaaatgaggaacaaaataccagaagcattaccaatatcaggaaattcagcattttcgctttgatcatcatggcttttgctttctataaatatttcattctgaaaacttcactggattctgtaggattgatctcctttgtggtcattgcacagctggctccggcatttttcggggctctattctggagaagaggaagttataaaggcgctgttacaggtcttatagcgggattaataatctgttatttcggattgattattcctcagtattatttttcttacaaccaggaattcaaaggagtgctgagagatatgtataatgctttcggttttttcacaattccttatctgggaagaatcccgcagatctttttctggtcgatgctcgtaaataccggcttgtttactattatttccgtaagctcaaaaggaaattaccgagaaaggaactttgctgaactctacgttgatattgacaaatatattcagaatcatgaaaatgctttcatctggcgcggaacagcctatatttcagatatccggaatattcttgagcgttttttaggcaaaaataaaacagaacaggcactaagaatttttaatttaaaatataacatcgactctaatacggagactgctgattcaaggtttatcaaattctcagaaaaccttttagcgggaagaatcggaactgcttccgcaaaaatattgattgaaggtgtgaccaaagaagataaaatatccttaaaagaagtactgaatatccttgaagaatccaaagaaaatatcaccttaaataaaaaacttacagaacagtctgaagaactgcagaaactttctgatgacttaagaaatgccaacgaaagtcttatcatcaaagaccgccagaaagatgatttcctggattccgttgcccatgagctgaggaccccgattacagccatccgctctgcaggagaaattttagcggacgacgatgatattccttttgacattaaacaggaatttttaaacaacatcattacagaatctgacagattaagcgaaatcatcaacgatattctttaccttgacaaactgcaacatggtgaaatctctttacatattcaggaaaacaatattcttgaaacgtataaaaaagcattaaatccgcttcttcacctgatacagcagaaaaacattcatttaagcgaagtaaatctcctgaatcagtttatatttgaatatgatgaagcgagaatgattcaattgtttcagaatatctggggaaatgctttaaaatttacagatgaacaaggcaccatccagaccaagttatttgaaaaagatgaacagctcgtgattaccattttcaataccgggaagcatattccggaagaggatctggaaatgatttttgacaagttttatcagtcaaagaatcagaatattttaaaacctacgggaagcggactgggactggccatttccaaaaagatagtacaggcacttggaggaagtataaaagccgaaaacagcggactgggcgtaactttcaccataagcattcccaaaaaaactaaaaaagagattataaatgaagttgaacaccattaaaacctttttatgagaaagatcattattgcggatgacgaacacaaaatattaatgtcgctggaatacagctttaagaaaaacggatatgacgtttatattgccagagacggcacagaagttctcgactttttgaaaacaatgattccggacgtcattcttcttgatattatgatgccgaaccttgacggatacagcactttggatattatcagacaggatgaaaaactgaaagacaccaaagtgatctttctgagcgccaaaaataatcccagagacattgaaaaaggactggaaatgggcgcagatgcttacgtcacaaaaccgtactccatcaaaaaactgatgcagcagattgaggagatgttttagattgcttcccctccagccggcaatgacacagcttaaccaaacacaagattattgacatgaaaacagataccttatttaaacaaagcatagaaaataaagaagacttctggagagaacaggcaggaaaaatacaatggtttgaatttccccaacagatcctttcaaaagacgaaaatgattacccacagtggttttctgatggaaaacttaacatgtgctacttatgtatcgataaacatattgaagacggatttggagatcagattgccatcgtttatgattcccctgttaccagccaaaagaaaacctacactttcaatcaggcaaaagaggaaattgcaaagctggctggcggattgatttctttaggattaaaaaaaggagatacagccgttatttatatgcccatgattccgcagacgctttttgccatgctggcgtgtgcaagaatcggagtcattcataatgtggttttcggaggcttcgctccccacgagcttgtggtaagaattgatgactgcaaacctaaagttttaatcactgctacagccggtgtggaaattgccaaaagaattccttacctgccactggtagaaaaagcgattgagctggctcaggataaagtagacaatatcgttgtatacaatagaagattagtggataatcaggatgaaatgtttgacgggcttatagattatgaagaactggtagaaaaatcagcttcggcagaatgtgtttctgtagaatctgcccatccgctttacctgctttacacgtcaggtactaccggaaagcccaaaggtattgttcgtgataccggaggatatgccactgcattgcaattctcaatgacctatgtgtatggtgttgagccgggagaaacctattgggctgcttcagacttcggctgggctgtaggacatagcttttcggtgtacggaccattaatcaacagaaacacaagcatcattttcgaaggaaagcctgtcatgactcctgatgccggaactttctggagaattatctcagaatataaagtttcggtgatgtttacggcacctactgcgatcagagctataaaaaaagaagacccgaacggggaactggtaaaaaaatacgatttaacccacttcagaaaacagtttcttgcaggcgaaagatgtgatgtagccactttggactggtttgcagagcatattggtgttccggcaatagatcattggtggcagacagaatccggatggcctatgcttggattgctgactcatgatgaaaattatcagatcaaaagggcatctgccggaaaacctgttcccggatatgatattaaaatctttgatgaaaatggctttgaactggatgctcaccatgaaggttatcttgtgatcaagcttcctctcccacccggcgccatgcttggaatctggaaagactatgaccgttttgaaagcagctacctttctcagtataaaggctattatttctcaggagacggcgccatacaggatgaggacggctatattttcattacaggacgagtggatgacgtaatcaacgtggcaggacacagactttccacttctgaaatggaagaaatcgtttcttcacatccggacgttgccgaatgcgctgtagtaggtattgatgatgatttaaaagggcaggttccttttgcgacaatagttctaaaaaacggctcagctatttccgaagaagacatagagagagacattattcagatggtccgaaacaaaatcggagcggtagcttttcttaaaaatgccatggttgtcaaacgattaccaaaaaccaggtcaggaaagattttgagaaagctgatcaggacgttactggatggcaaagattttcagattccatcaacgattgatgatgaaaaaatcattgatgaaattcaggaaaaaatcaaagaatatagggcttaaacgggaaattaaacataaatttaaaatataataaattcaaatttcaaaaaacgaaagggatatgagaaattacttgatagaagatttaccacaatattttgaagactataaaaaatctatcaaaaacccaaaaaaattctgggataaggtagcggatcagaatttcgtgtggtaccagcgatggagcaaggttgttaagtacgatatgaatgaagccaaaatcacatggtttaaaaatgcaaagctcaatattaccaaaaactgtatcgacaggcatctggctataagaggcgataaaacggctatcatctgggaacccaatgatcccaaagaagaagcacaacacatttcttacaacgaactctatacacgtgtcaataaaacagccaatgtgcttcgtgacatgggtattgaaaaaggagacagagtctgcatttaccttcccatgatccctgaacttgccattacgatgcttgcctgcgccaaactgggtgctgtccattctgttatttttgcaggattctcagcttcagcagtagcttccagagtgaatgactgtgaagcgaaaatggtcattacttctgatggaagctatagaggaaataaagttcttgatcttaaaagcatagtagatgatgcattagaaaagacaccaactgttgaaagtgttcttgtagtaaaaagaacccacaatgaaattaagatgaaggaaggaagagatcactggatggctgatttgtatgaaaaagcgtctcctgatttcgtcactgtaatcatggattccgaagatccactcttcattctatatacttccggatctacaggaaaaccaaaaggaatgcttcatacctgcgccggctatatggtgtacaccgcttatacctttaaaaatgtattcaattataaggaaaatgatatttattggtgtactgcggatatcggatggattaccggacattcttatatcctttacggacctttattaaatggagcaacaaccgtaattttcgaaggggttcccacttatcctgaaccggatcgtttctgggaagtaattgaaaagcataagatcactcagttttataccgctcctaccgccatccgttctttagcaaaagagagtgcagaatgggtagataagcatgaccttagttcccttaaagtaataggttctgtgggtgaacctatcaatgacgaagcatggcattggttcaatgatcacgtcggaagaaaaaaatgcccgattgtagacacctggtggcaaacagaaacaggaggtattatgatttcaccgcttccttttgtgacccccaccaaacctacctatgctacccttccattaccaggtgtgcagcctgtcctgatggatgataaacgaaatgaaattacaggtaaccaggtaaccggaaatctttgcatccgttttccatggccgggcatcgcaagaactatctggggagaccatcaaagatataaagaaacgtacttcacagcctttcctggaaaatattttaccggagacggtgcattaagggatgaagttggttattacagaattaccggacgtgtagatgatgtgatcatcgtttcaggacacaaccttgggactgctcctattgaagacagcatcaaccagcaccctgccgttgcagaatccgctatcgtaggctatcctcacgatatcaaaggaaatgcactgtatggatatgtaatgcttaaagaaacaggggaaagccgtgataaggaaaacctgaagaaagaaattaaccagctgatttcagatcagatcggcccgattgccaagctggacaagatacagtttgtttccggccttccgaaaacgcgttccggaaagattatgcgtaggattctgagaaaaattgcagaaggtgacttcagtaatttcggagatatcaccactcttttgaatcctgaaattgtagaggaaattaaaaacgaaagaatttaattaatcattatttaaccaatagtgggccctgggagctatttccggggcttttgtttatggataaaataaagtaagcctaactacctcgctcttccccctacctcacgtaaatcttgtaacttaataacgtagatttcattatttttatatcatgaacacaactaaatttaattcaatcaaaaacgtttaaacaattaaattcaattagagaacaataatgaaaagaattaatataagagcaattacatatttattgatattttgtggaattatcttagtgattgattttatatatagtcttacagtttctcaccatttaacatcagctagtttaatatttgatactatttttggttttttattttggatattatttattttttctggtaaattaaaaaaataatgctttagaatttccctttactacactgggaattaaatatgataataaggctactttgaatcttcaaataatttaatgatagatactctaaagacacatagataactccataacagagaactaatgctataaaattagtaaaagcacaatagccaaaaccagataatgaaaacatttaataaaataataatttcttgcttctttctttttataggttgttcgactgtaaagatatctgaaatatatggtacagagatggagattgttgaaaatgtacgctcacaagtcctgatcaaaaaatttaatgcacaggataaaaataaatcatttttaatttttgctgatgaatttgacaatcttataaccgttaaaaatggagatagcttagttcttgataaaaaaagtaagactatgccaatgttaggatttacaactgcttgtgtaatttttaataatagaaatgttacaattatggttgacaataaacagactgtaaaactaaataaagaccaattatcaaaatataagtttgtatacgttgaaaaagataagaatcattatcaaattgaatacaccaacaaagcaaagtcttttcaataaaatatcacttttatagcattaccacgtgaatcatttcgcatgaaagataatagaaaatcctgatcaagcagggcagtctttgcttatcttctagagtaactacgttttttagcaaaaaaatctttcaacaatttttacaatcaacttatcattttgtattcttctcaaatagaataagttaaaaaataaataatttttacaacacaatattatccaatcactaaaattaaacacccgttcaataattattttcaaacattatcaatatctattaaaaaccaaatattaattaacaaattttattggatcaaatacaatgataatcggaaaattattagtaactttaatggtaacttaaaaccaattaactatgtcaaatatattagctggactatttgagcatcacagcgactacaaaaaattagagggtgatctggaaaattcaggatttggaaatgaagattacattatataccttaatagtgattctaataattcacaatacctggcaagtgttacggtaaaagataatacacagattgaccttgcacggaatgtatttattcagaatgcggccctgaaatcatacttatttgaaaatatgagcatcagtgaaacaaattatgatacgatcaaaaaatatattgacgcaagaaacagagcagaaattcataacagtcctgacattaagattaaaacatcaagcgacgggatgaattctgaagtaaaattctaatcatataaaaacttgataaccggagatccgcagtgtatgctgcggatcttttatgtttgaaaaaagtaaaaaaattcgtattttcgtctaattataggcatgtgcacaaatgagttacgatttagaacaagagaataaggaaatccttgcaagatataaggatctgatttctaacacatacagaacgttggatgaggaaaataataagctcatccgaaaggcattcgatatcgctctggacgctcacaaggatcaaaggagaaaatccggggaaccttacatctaccaccctattgctgttgctaaaattgtagcgacagaaattggtctgggtgcaacttctattgcctgtgcgcttttgcatgatgtgattgaagactctgattatacctacgaagatctgaagaaaatctttggagaaaagattgccaatatcgtgaatggactgaccaagatttccatcatgaatcatcagaatatttctgtgcagtctgaaaactacagaaaactgttattgaccttatccgaagacttcagggtgattctgattaaaattgcagaccgcctccacaatatgcggactctggagagtatggccccggacaaacagaaaaaaatcgcttctgaaacggtttatatctatgctccgatggctcaccgtcttggtttgtataacatcaaatctgagctggaagatctttctttaaaatataacaatcctgaagtatataacgaaatcacggaaaaattggaattagccaaagaaagccgtgaaagatatatcgaagagttcaagaaagaagtatccgaaagattacatgaagaaggtttaaactttaaaatcaaaggccgcgcaaaagccatttcctctatttacaggaaaatgctgaagcagggagtttcctttgaagaagtttttgacaattatgccatcagaattatttataaatcggatgctaaaaatgaaaaattccttgcctggaagatctactccatcgttacagatgtataccacagtaacccttccagaatgcgtgactggattacccagccccgctccactggatatgaaagtttacatttaacggtcttaggccctgacaaaaagtggattgaagtacagatccgttctgaaagaatggatgaaatcgctgaaaaaggagttgccgcacactataaatacaaagagggttacaaacagagttccgatgacagaaactttgaaaaatgggtaaccgagatccgtgaagtactggaacaacagcaaaatctttccacttccgaacttttggataatattaagcttaacttatattccaaagaggtatttgtctttacaccaaaaggagagattaaaattcttcctaccaatgctacagctctggatttcgccttctctgttcactccgatctgggaatgaaatgtttaggagctaaaatcaatggtaagctggtgcctatttcctatatccttcaaaacggagatcaggtagatatcctttcctctcagaatcagaaaccaaaatctgactggctggaatttgtggtgacctcaaaagcaaaatccaaaatcaagagttacctgaattctcagaaaaatcagcttgtagaagaaggaaaagaaatcctgcagcgaaagctccgtcatgcgaaaatcaatttcaatgatgaagaaattaataagctgcaaaagttcttcaatttaaaatcatctcaggaactgttccttaaattccaaagcaatgagctggatgtcagcagcctgagaagatatatagaaagtaaaaacgtattcaataatttactttcaagattcagaaaatcacctaataaaagccaccatttcgaggaacccaaagaggaaaaccttgatatgattgtctttgggaaggatgaagagaaacttaattacagctacgcaaaatgctgtaccgtaattccgggagataaaattttcggatttatcaccatttcagatggaattaaggtacacagtgacaactgcccgaatgccattaatctgagagcccagtatgactaccgtgttattcctgctaaatgggtgaatgcggaaagcttcaaaaacagggtaaaaattgagattgaaggtctggacagaatggggatgattaatgatatcacaacggtcatcagcggaagcatgggaatggatatgaaaagtatgtccattgaatccaataacggtgttttcacaggaaatatcaatctggaagtcaaaaataaaggtcagctcgaagagacctttagaaaacttaaaagtattaatggtgtttccagagtgagacgactacaatcataacatgaatttatctctttactttaaaaaatttttcaacaacagtcagtcatcaggaattattctaattttctgtgtacttatttcattgattattgccaactcctctgcagcagaaaattttcagcaatttttagacaaagaatttggcacccatcttttcgggcttgaatatcctgtcagcatctggatcaatgacgggttgatggctatattctttcttctggtaggccttgaaataaaacgggaacttatagaaggagaactttcatcctttaaaaatgcctccctgcccatttttgcagcagtaggcggaatgcttgtcccggcggtaatttacagcattttcaataccggaacagaatacagcaacggctggggaattcctatggcaacagatattgctttctctttggcgatcatttcaatgctgggtaaaaagattccgaattctatcaaaatatttttagcggcactggctattgtagatgatctgggagctattctcgtgattgccattttctatactgagcagattcactggagttatcttctgttatcttttggagtaacggccttactttttatcttaaactttttaaaagtaaccagaatcatattttatattattccgggactgtttttatggtacttcctccatcattccggaattcacgccactatagcaggtgttttacttgcattttcaattcctaccaatgcttccaacgtagaaatatcacctttggaaaaactggagcatcagctccatattccggtaagttttcttattatgccggtatttgcactaacaaataccaatatcactttttccagcgaaatggtgacgggagttacaagtacattaggattgggaattatctgcggactggtattgggcaaacttcttggcatcaatttattctcattgattgccatcagattaaagcttagttccctaccccagaacagcaattggctgcagatgattggtgtaggtctgctggctggtattggatttacaatgtccatttttattgcattgctctccttcaaagaagagattccgattcaggacgaagctaagtttgccattctgattgcttcctttattgctgcaattgccggatttaccatcctgagcataagttcaaaagaaaatcctgaactggaggaaaattaatctttcttccggttctccagctttcttttatgttcctcatcaccatcaaaatccggctcagtaacctgtgcatgatattctgaggcttctttgcggatttcatctgacagcagcttttctattctgagttttctgattgccatattcagctcattcccgaataaaagaagatacacatttacattcacccataccatcagcaggatcatacttcctatggacccgtaaagaacgttataccgtgcaatatcctttacataaatggcaaaaatataagttgtcaccacaaacagtacagtagtcaggattgcccccggaaccgcctgacggaatcttgtgattttcactgttcccagccagtaaaacaatgtcagaagtataaagtaaaaaagcgggaaagaaacgaaaccgataatcttggaaaggttatctacaagccaggtaatttcataagccggcataaaaggcctcataacaacctccgcatagtaaacgccaaagagggcgagaaacacgatggtaataaagccaattgtaataaaaaaggaaagaatgaattcttttacatcgctcagcttttcatccgaattctcattgaaaccattgatcagggaaaaagttccgtttgttgcaaaaagtaaagccagcaaaatggtcagattactgatccctttcatattgggaacaatattggcctcaatatatcctcgtatatccccttccatattagaaggaaaaacattgtgcatcaatacttcaaaaatataaaactgcagcttggcataatgcggcatataaggcaaaaccgaaagcaggaagagaataaacggaaacagacttatcgtaaagctccacgaaatagcagcggcttttcttcctattttccctttaaaaattccggagatataaatctgaaacatctgccaaagcgatattcccaaaacaggaatatggatgctgtcgaaaaactcttgaatctttaaaataaatttaggaacctttacactcatcgatctgtttgtctttgatacaaaggtaggggaattaaattaaatgggaaaagatagaaggtaataggtagcaggaatcagggaatttagagttcaaagtttaatgttcaaggctagcgtttaaagctatgagttaatcagtaacaaaaacaaaaccgaatcacgcaacccggaactccacaacaaaacaatcaacaactttgatcttccccttttaaagccctatctttgcagcctgaaacatcttacaatgcgaatcagcttactttgtatcggtaaaacagatgataaggaaattacctctttgatcagttattaccttaaccgcctgcccaaacactggaattttgaaatcattgaaattccagatgtaaaaaatgctaagaacctgtctcccgaccttcttaaaaaagaagaagctaaattatttttaaatcatattgataaaaacgatctggttgtcattcttgatgagaaagggaaacagtttaccagccgggaattttcagcaaagattgatgtatggatgaattcttcagtcaaaaaaatacatattctgattggaggtgcttacggcttttctgaggaaatctacaacagagccaatgaaaaaatgtctttatccaaaatgacttttacccatcagatgatccgtctgtttattgtggagcagctttaccgtgcagatcagattttgcagggaaaaccttatcataacgattaaaagaaaataggctctcaagaatgtcattctgacgaaggaagaatctcaccaatacaatttctgagattcttcacaacattttattcgtttagaatgacaaagccaaataatttgacttttctctatttcaggctgagctgcctctttgcttcacctatgacaaaagcaacggaattggcaatattaaaactcctgataagttttgacataggaatggtcagatgattatcaaaacggtccagaacatctttactcagccctgcactctcctttccgaaaaccagccagtccccatcctggaaatcagtttccagataggatttttcagcatgtgagctcattaaaaaaacacgtgacctatcaggaacagtttcaatccattcttctacatctgcatattctgaaacatcaaggtgtacccaataatcaagtccggaacgcttcaggtttttatcattaattacaaatccaaatggatgtaccaggtgcaatctgctttccgtccccacacacaatcttccgatattccctgtattattaggtatttcgggttctacaagaacaatattcaacatctttctattcttaattctttttttaacagttacaccagtttggttttagtatggattaattaaatgattgggaaggatcagttttctgttatttttttgcacatttagcgtaaaaatcagtcagcaccgctttttcatatcccaaagcaactgctttgtcaagattttcgcaggcttcttttggcttggaagtatcaaacaaaatcatagccttgcttacataagactgcgaaaatttcgggtctatagaaatagctttattggcatcggccagcgcctccttgtattttttcattttaaaataaacatctgcccgcccgttatatagcaatgattccggtttttcagcaagaagctgattataatcttttaaagctccatccagatcaccattattttttttcagattggcaagccctgtttttgcaaaaatattgtccggagcaaaagtcagaatctggttaagatctttaatcgcaagatcttcttttccctggctgtcgtagattttggaacgggtaagatataaatctgctgtttcaggatttactttgagtcctttctctatatattccagggctttcactttgtttcctttctggctgtaaagtgatgacagattgacgtatacagaaactgccaaagggtttgctttcagagcagaatcataagatttaaaagcctgagtggttttcccaagccttctctgtgctgttcccagataatcgtaatattctgattgaaatttctggatctgttctttctctgccagttttaagtattgctcttcggcacacttataatcagcttttttaaaacattcttcagccagttttttatcctgggcatagaaattaagagaaaaacagagggaagttactaataataaagtttttttcatgaagttatagtttgtttgttgatcacttttttggcgagtgcaccaaatatcactcccaataaagatccaacaaacgcccccaccaaaatatctatcgggaaatgcacacctaaatatatacggctgtaggaaactaccacagcccatacaaatatagcatatggaaaccatttaagcttattttttaataaaatacttaaaaaggaagctaaaaagaatgtatttgaagcatgggcagaataaaagccatactgtccgccgcatttcacgattctcatgtgatgttccagagtggggtcatgacaaggtctgagtcttgccacaccatatttgaagacaccggccagctggtcagaaaccgttgcgccaattgccagaaatataaggataaaaactaacgatcttagtttatagtttttgtataaaaaataaagaaatataatataaaggggcacccagatccaggtacttgaaatcagcatccaaaactggtcaaaagatgaattgcccaaattattaaggtagagaaatacctttttatcttcctgaatgatttcctccatcgttatctgcttacaggtccttcgtaagtctcatcatctgcaggttttggttttggaggctcattagaagcaacagaagagggctccgtaagaatatcttttttgatatcattcacaggattgaaatctttggcagcatctttcaccttctcaatttcacgcttgatttcagaaacaggattatctgtttccttcatgatttcagttttgatatcttctaccgctccacgcatttttctaacgcctgcacctaagtcacgcgcaatctgaggcagtttatccggaccgaataatacaacgattgcaatggcaatgagtgccatttctccaatgcttaattccatgcggtaaaattacgaaagattattccatttacagactgtaaactaaaaatttaaacaaattttaagattttatatcagggttcaatgtttaaggtttaaagttgctgactgtattttacgggttacggtttgcgtgatccgggtttgttttgttgctggctgactgataaccttaaacgctagccttgaactttaaactttaaaccttaaaccttaaaccttgaactttaagctccctaccctctaattcctgctatctgccacctataaattaacaaatatttaattcaaaacaatgagaattaaataataattctgtatatttataacacacaaaccaataaatattaattatgaaaaaactagtgactacttttaaagttttcgccgtcttatcggtattaactctcaacagctgccggaatgaaagcagtgaaatgaaccagcaggaaacagttcagtcaaaggtaactgttgctgatctgaagaaggagattacttctcttccatctcaaattgtcccagaagcagttcagcaccaactggatgaatccggaaaaaaccttgaagcctatctgaaaaatgatttacagattacaggagtacatgtattgggtaaaatttcatcacagcaaggtgttgagctttccaaaaaactgatcacagataaagaccagtttattgcatcaggaaacatcatggatccttcttctgtaaaaatcgggaaaatcggagatctgtacgagggagaaaatctgacaacagcacaacagggattaaatgaagcaatcacagaagagctaaaagccggaatcaatgttatggaaataacatggaacagtaaaagcgggaaatttaccacattatgcttttatggtgattcaggtattgtctgggataatattttcggaggtcttgttatgatggatacgcgtggacattcagaagcatctgatgaagtttctaaagtagcttccaaatggtataaacagtggtggaccgctaactggttatggggatctaagagaggtgaagccggataccagattaccatttattattccggttctacagtgtccaatgcagatgtaagtgattggggttatatcagcttaggaaaagcgaaaagcgagagtaaaattacaaaaaggacaggtgcttacgggcaatgccgttatgcattgggactttgtactcctacaggttctttaagctttaattccactaatttttctgtatcattctccggattgggcagcaatatagtaagtaacgggacaaaatccctttatccataattctcataaaaatctgattaataaaaccgggaagcctttacaagcttcccggttttttataggttatattttctgatactaccatattctaacttttgatttcagggcttctattgcattttcctttaatccgaaagtattaaacagtatttcatacaactgaatatcattttctatcgttacagactctttcgcaccatcatcagacctgatgttcaggatgtgatccgtataagtataacgggcattctcatctacttttgagaggatcagcttattcttaaaatgcgaatccggatgtgtagacaggtaccaatttgaaatctcaagatcaataagctctacatgctcagggatgaagcgatataccggaagccattgctctttccacatccaaaggatatatgtattttctctgtgcgaaactttaaatattccgttgggtgtctgctgctgatcttcttcatttaaaagtattggagaagtaagtgtagcagttccaaatccacagtctacaacatactttttattttcaaaatcaacaataagcagtaaatgagtctgtgcagcaacgctgtcttcctgccttccccatactacccttcccagctgaagttttactttaaatcctaaatattttaaaacttcacttaaaagcaggttttgttcataacaatatcctcctcttgattcaacaaccagtttcttaaagacatcatctgcattcaaagaaggtactttccctgtataagggtctatattttcaaacgggatatgtttgggatgaagctgatgaattttcttcaatgtttccatattcatttccggaataccggagaaatgaatccgttcgagatactttttaaagtctgatgcattcataattttgtttttcctgtttcaaaattgagtaaaactacttcagtaaagttatcgaatagattgaacccaaagctataaatatattcagaatagaacagatctattatttctgaaagtctttttcggaggttacatcaaccagatcttttctttttttctgaaaagcagaataagtaatcacaacgctgagagccattaaaataaatgcaaggaaaaacggcgctcccgaaaacttgaatggtgcttcatcatgggtaaaaaagtaaaataaattcgtcatcatcggaggtcctataatggaggtggcactcattaaactcgttaatgctccctgaagttcgccctgttcgttggaaggaacacttttcgtgattacagactgtaaagccggtccgcagattcctcccaggcaatacggaatcagaaatacaaacatcatccagccttctgatgcaaaggcaaataacagcattcctactgcataaaaagccaatccgtaatagatacttttctgctctccaagcctaggagttgtccatctgataagaccaccctgtacaagccctaccaataaacctactactcctaacgaaatccctaccattctttctgtccagctgaatttatacatggtaaagaaactccagttactctgtaccgcatgtccagcaatataaattaagatcagtgaaacaatcaacccggaaatttcaggatgtttccctaaaaacttaaatgagccaataggattcgcacgcttccagtcgaactctcttcttttatctttatccagactttcaggaagaataaagtatccgtaaaggaaattaagcagacacaaacctgctgcagcatagaaaggaactctggcaccgtaatgcccgagaactccacccagaacaggtcctatgataaaacctaagccaaacgcagctcctatcagtccgaaatttttagctctgtcttcatccgtagaaatatctgcaatgtaagcactggcggtggttacacttgcaccggtaattccggcaataattcttcccataaacagccaccagatcgtaggcgctaatgcaaggaaaatataatctacggcaaatccgaaaagggaaatcaggataatgggtcttcgtccgtatttatcactcaaattaccgactaacggcgaaaatataaattgtgtaaatgcataggcaaatccaagccagccgccatattttgcggcttcactgatatctgcatgaataagttcttcaattaatttaggaacaacaggaatgatgattccccatcccgtaatatcaatcagtaaagtaataaatatgaagcctatagctgcttttttctttgaattttccatgatggtgcaaaattaatcaaatctgaaaaataatgattctaaattatgagcagcatatataaatactaaaaaatcaaatacataaaataatgacaaataatgcattacatttaaaaaagctttgtttttttcatatttcctgtttaacataaagaaaaaggccgttcctttcgaaacggcctttactaatttattgtagtttgtattactttgaaaccaattcttcttttgcagaagtggattttccatgtacctcttcttcttttcctgttttaaggaagtcgtaagcaattgcagatgcaacaaagatggatgaataagtaccgaaaccaataccgattaacatcgcaaacatgaatcctctcaggttatcaccaccgaaaatgaagatcgcaaggataaccagaatcgtagtgaatgaggtgttgaatgttctacccaatgtacttgaaatagagtcatcaaacagacctgccaatgttaaagattttttctctctcaggtattctctgattctgtcgaagataattaccgtatcgttaatagagtaacccaatactgtaaggattgcagcaatgaaatcctggttgatctccatgttgaaaggcatatacttgtgaagcaatgaatatgctcctaagataattaccgcatcgtggaacagagcagcaactgctccaagagagaactgccattttctgaatcttacaaggatatagatgaagatcatagctaatgcagccaataccgcataaataccgtgagtctggatatcatcagccactgaaggtcctactttctcagaagaaataattcctgcgtggtctttatcagcagatttgaaatctttcaatgttgttcctgccggtaactgtgattttaatccttcaaataatttttgctcgataatctggtcagcttttaaagattcatcctggataaggtaatccgtagagatctttaattgtttgttgtttccaaaagtcttagcttctactgaagagtttttaccatcttcagttttgaataatgccactaatttttcttcaacatcttcagctttcacatctttatcaaatcttaccacatagtttctacctcctgtaaagtcgataccgtatttgaaaccgtgcgttgcaattgaaatgatacaaacgatcgtaagtactgcagaaatgatgtaggcatattttctctttccaatgaaatcgatccatgtatttctgaataggttcttcgtagccggagtccatacagaaagaccttttcctttattcaatcttgagaagatcattactcttgaaagcaatacagatgtaaataaggtcattgcgataccaatcatcagcgtcaatgcgaaacctttgataggtcctgttccgaagaagaacaatacaactgccgtaaggaaagtcgtagtgtgaccgtcaataatcgcgttcaatgcatgtttgaaaccatctttgtaagcttcaagaatacttttcccggcgaataattcttcttttgttctttcataaatgataacgttcgtatccactgcaactgccatggtaagaacgatacctgcgatacctggaagcgtaagcgtaaagtctcccgaatccataataccgaaaatatagaataagttgatcaccattgcaattaccgcatatacaccagctccaccgtagtagaaaatgatataaacaatgataatagcaaatgcgatgatgaacgacattaaacctgaatcaatagcctcctgtcctaaagacggacctacaactgtagcctgaactacttttgcacctgcaggcaatttaccggcacccaacacgtctacaagctccttagcttcttcctgagagaagttaccggaaatctgtgttctaccgttaggaatagcgccaacaacgttcggagcggtatatactctgttatcaagagttactgcaaccggttttccaacgtttttctctgttaatgttttccactcttttgctcctttggaatccatctgcatgtctactactattctgcttagttcatcataaccgatgcttgcagtttcaacagcaccatctaccggagctttttgattgatattacctctgatcgcatacaataccaggctttcagtatcagtagcttcaggtttgtacccccacatgaactgtgtatatttaatgttagccggacgtaaagactgagctactttgctgttcaggattttgtttacaactgcagtatcagataattttacattagcaacaccattagttcttaatttgtcaagctgtaaaaggttcatgaagttcacattctttgcaactcccatagaatctccttttgcagcaaccatagttgtcaaagtctggaaataaggcgcaatttcaggaacctgctgtacttcccagaactgaagttttgcagaagtctgaagcatttttttcactttatcaatgtccttcataccaggcatttccacagaaattctagcggtaccaggtactctctgaacgtttggctggatggctccaagcttgtcaattctcgttctgattacctcaaaagctgttcctacagatgcatcgatctttcttttaacaatgctttttacctgctcgtcaggagtgttatacttcacctcagtaagggttgtatttccgaaaatttccggatctgccagcttaaggtttgcccctttagctttgtttactacatcgaactgctcaaaaaagttgtcgatgtaaggttttgtagaattcttctgtgcttcatccgtcttgtttaaagcctcgataagaacaggatttgtagaataatttgttaaatcattcacaagatctctttggttgatctccaaaagaacattgatccctcctttcaggtcaagaccaagtttcatttccttgtctttggctttagtgtaataaagttttgtgaatcctaagttcaaagtatccttagaaagtcttgcgatttctttctgatacttctccggattgtctcctgcaatagcagtcgcctgcttttcaattttgctggcgtaccatgttggtaatagctcgtttaagcaaatcaaccctagtacaatagcgacaattgtaataagtccttttccttgcattttgttataactacgttaaattaagtcggcaaatataatgattttcttgtattttatgaatttttaacaacagaaatggtttatttccagatatattggtattgtgatttctatttaagatttaacaattttttcgtgctatcatagcgaagttttcaaaatatattggtataaaattttcattccatttatcaacacactaactatcaaaatattatgaaaaaattacttttttgcatcagtattttttcttccttaattgttaattctcaaagcattaatttggaagaatttgtcacggggcttaccagtcctgtagagattacgaatgccaatgacagccgtctttttgttgtacagcaaaacgggatcattaaaattattcaacctaacggtacaatcaactccaccaattttctggatattagttcaaaaattatttttggaggcgaaagaggtcttcttagtctcgcatttcatccacaatactctgccaacgggtatttttttgtgtattataacaatacagccggaaatgttaccgtcgcaagatacagcgtaagttccacagatccgaatgtagctgatcccgcttctgaaaaaatccttctgagcattccgaaacctttcgacaatcataatggaggaagtattcatttcgctcccgacggaaaattatggatcattaccggagatggaggaagcggcggtgacccgaataataatgctcaaaacaaaaattcactgctcggaaaaatgctgagaatagatgtagatgctgccggcccatacaatattccgcccgacaatccttttgctggagccggagtggatggtgcagacgaaatatgggcttatggattaagaaatgcatggaaattttcttttgatcttacaacaggaaatgccatgattgcagatgttgggcagggagcaatagaagaaatcaacaaaatgcctgttattcaaggtggcttaaactacggctggcgctgttacgaagggaataatgcttacaacacagcaggatgtgccgcacagtctaccatgaccttccctgttgccgtatacgatcattccggagggaaatgttctatcacaggaggatatgtctacagaggcacccaatatccgtcattacagggtaaatatttctttgcagactactgctctacccagatcggtattctggatagtaataattctattacatggacgacaccttattccggaaataatttttctactttcggggaagattatcagaaagggctttatgtagcagctgtgaacaatggaaagatttttaaaataaccacaggtactttgggaactcaggaaaataatgccattggaaatataaaagtttatcctaatccggcttccaaagaagttttcattgatggagttaaagataaaaaagcaaccctagaaatcatcagtgcagacggaagaaaagtgatggaaacggataaagtctctaatggcaaaggaattaatatttcaggaattcctgccggagtgtattatattaatctgaaatccggggaactgaaatcatatagtcagaaattgattatcaaatagtaatagccggttttaagcgcaaacgaaacgctaaggttttttacattctatgaaaaaggatcgcaaaggcgcttcactaagcaaaaatattgctagacagagtggctttgcgaacaaaaaaataaatcggcattataaaatctttgcgaaccttccgtttaattatttttaaataaaggagttgtttaaactatcaaaaaatattgaatatttcttaaaccattaagaaggatttaagcagtaaagcatagttaagataaatcattctaatctttaaacttaaaacgaagcttatcttaatactctaaacaccttaatgccatcttaatggttcaaaaaagtttaaacaagttcaaaataagccataagtaaataaaaaaagcggttcagatctgaaccgcttttgcttatattgtcatagagaaaattctcgtttccggtttatttctcatcattctcaggtcaaaaaccatggctacattcctcgtgaatgctcttccggcttcagtaattttaacttcggttccgttgatttcaaccagaccgtcgttttccatctctttcagcatttccaaagcattttcaagctcagggaaagagttgtttatatcaaaagtggtctcaagctggcacatcagattcagaatatgtcttcttaccgtaagatcttcatcactcagtacgtgtccttttaccacaggaatttcaccttcttcaaccattttctgatattcctcaactgtttttacattctgggcaaacgcataccaggaatctgaaatagcagacataccaagtccaaccatcagctgggttttgctggaagtatagcccatgaaatttctgtgaagtttcttatgaattaaagactgataaagatcatcatgctcaagagagaagtgatccattccaacctcaatatatcctaaatcctgaagcagctttttcccgtcttcatacagacggcgtttttcttcaccacttggaaggtcattttcatcaaaacctctctgtccgactccttttacccatggaacgtgtgcataagaataaaatgcaagtctgtccggtttcagctccattgtttttctgatggtatattccatcgcttcccagttctgatgtggcaatccgaaaaccagatcatggctgattcctctgtacccgatttccttcgcccattcagtaacattttttacattttcaaaaggctggattctattgatcgctttctgaactttaggatcataatcctgaactccgaagctcactcttctgaaaccaaggtcatataaagtctgaagatgttctttcgtcgtattgtttggatgcccctcaaaagaaaactcaggatgctctgcaatatctactgtagaaaaaattccctccagtaatgttctcaaattttcaggagagaaaaatgtaggagtacctcctccaaggtgcaattctttcagttttggtctttcgctgaaaagatcaagatacaatttccactcttttaaaacactttcaaggtaaggaacttcaacactgtgctgtttggtaatacgtttatgacatgcacagaacgtacataacgcttcacagaaaggcaaatggatataaatagaaattccctcccctgcattgctttcatcaaaagacctgattacggtttccttccatctttccggcgaaaatgttgattcatcccagtaaggaacagtaggataagaagtgtaacgcggtccaggaatattatacttatctattaaagagttcattttgaaaattaaattttataaggcatgaaatttaacataattaaattcatcgtacaaaattaaccattagttatgaattttaacctatgaattatattaggttctattttataatgagtctaaatacgtatgatcaggcttttggctgatagtgatatattctattcctgatatttaaaattttaatttcatcaccgcaattttattatttcctgcaagaacaacattattgccatcaacccattgacagacaaagaatcctttttcgtcagaaattttcttccatgttcttccaaaatctgaagaataactgacgtgcttatctcctaccgcaagaatctcttttccttttgatcccggtttaattttcacacaagtcgtatatcctgcattctgccctgaggactgaatctgccaggtttcaccaccatcggtagtcgttgcgatattattgacattagcatcctgtttggtataatctcctccaacagcaattccaaacttatcttcataaaaatctatagaatacattccttgtgaagattctccctgaacaaatggagtattgaaaatttcaaacttttcatttttcagattcatttttataattcttgaagcttttcctccggttgcaatccaaagatattttttagaggatgaaatattggtattgctggcggcaaaagcagcctcaccctcatttaattttacattattcttaaacatgctccattttccgtctttgtacacagccagcttcagcagttgatctttatctgcatcactgaaggtataggcaagcttatcatttacgaaatgtaaggcatcataaaaagccgtttttgctgtatctttaaaaacaacctgtgaggtcagagtttttttatcaatggcaaaaaatcttcccggactttcaatattgatcgtatagaaagaagttttattctgccctaatgttctgaactgaagcttttcttcagacagtttcatctgcttctggtttttgtaatttttaagatctacaaacccgaatttggaatccgtaccgctataccatactttattatcgtataactcaagggctctgatacttattttatcattaagaatggtttcgaggctttccacctgctgggaaaacgctgcaagtcctgcggacagaaataaaatggtgaaaatctttttcatagtatagtattgtgacaaaaaaaaccgccgaagcggtttatataattattaatcctggttctgatatttttcaggattgttaagtttaccatgtgattttccataaaggaaatataccaaacctcccagtaccagccatacagctgaaagctctaatgcatgggcactcaggttaaaaatcagatataaattgataattactcccaatgctactacaattttataagcaggaaccttgaaaggtctgatcagatttggttctttttttctcattacccaaacggcgatacaaaccaaagtaaatgcaaacagggtcccgaagcttgtcatatctgccagtgttgaaatcggagtgaatgcagcaataaatgccactaccagtcctaacagaatgattcctttatatggagtctttgtttttggatgaagctgaccgaagaattgaggaatcaacccgtcttttgccataccgataaagattctggattgtcccatcatcattaccattacaacggaaattaatcctaccgtagcagcaatcgttacgatattacttgcccagtgttttcctgcaatttcaaaagcataggctacaggagctttgatagcatcaggatatttaccttcagggttgaagtctgtataatgcatcattcctgttaatacaagagatacacagatatataaagcggtacagattaacagtgacgcaatgatagcgaaagggacatcttttttaggattaatagcttcacccgcctgtgtagaaacagcatcaaaaccaatataggcaaagaaaatagctgcagctccggaaataatccctttaataccatatgcggagaccagatccccttcagagtttttgatttttacaggatccgggatgaaaggtttccagtttttaaccccatctacagcattgtaaagatttgtattagaaaaaataatatatactcctgcgataattacaaaaataacagctgatgtcttcattaaaacaatcaggttattagctcctgcagcttctttagttccttttaccaataatgcagtaattaaaagaaccagaataaatgcaggcaggttcatagaaaatccatctccggtataacttgcaggatctgaagtcagataggcagggagatgaatattaaatattttcaaaaatttgttaaaatatccggaccagcttacggaaactgccatactcgccatagcatattcgaggatgagacaccaacccatggcccaggcaaaaatttctcctactgttccgtatgcatacgcataagcagacccttctacaggaatgatggatgcaaactctgcataacataatgcagcaaaaacgcaggcgatccctgctatgataaaggaaatggcaagtgctggtcctgcatgataataggctcctgttccggtaagaacaaagattccaccaccaatgatagcacctactccaattgctgttaaactccactttccaaggactttcttcagctcacttttcttcatatctgcctcataggcacttagtggctttttaacccaaattttcgacatgtttttttatttatttaaggatttacgaaaatataaaaaatttagaaactctcacgttaatcgttaaaatttcatcatttattttacattaaaaactttaaaaacctgaccaacaccttattcatactattttatcaagtgttaaatttttctttatttttgataacatgaatttatatgatcttttcataaagccttatgagagctatgataccttacagattatgctagaagcttcaggagctgtattaggaaccttaagcgtctatttttcgattaaaaaaaacatatgggtataccccaccggtattgtttctacaatgatctatgtgtatattctcttcaactttggtttattgggagactgcctgatcaatgtgtattataccatcatgagtatctacgggtggattttatgggctaaaaattccgaagatcatattcatgtggacgttacctgggctgccagaaaggaatggatctatgccagcattctttttatattgagcctcgcgcttgttactcttatttattattataaaccttatattgataatcaattttctatggaaggaaccagtcttggattatatcatctggattgggcaaactggatggatgttttcaccacttcaatatttttagtaggaatgtggtttatggccaaacagcgcattgagagctggattttctggattatcggagaccttatttgcatccctatgatgatttttaagggacttggaatcacttcggttcaatatttggtatttactataatggcgatctcaggatacgtcaattggaaaaaaagttttaaagaaaaaagtacaataaagtcatgaaaaatttatttaaaatagcagtcagtatttttgctattgccagtttaacatcttgtttagcatataccgacggatacggtagcaataatggaggttattatggagatccctattataacaacggatattactatgctcctgcaggatactacggaagcggtggatattggggcaacgacggctattattacagaaacaacgttaattattactatgataatggcatcccttattattatgacaattataataattccagaagaaaagtctatgtagaaagaagatctgcttcttcaagacctcagaacggattccagaatacccgtacaacaaataataacggttcatacaataataacagcggaggattcaataataacagaaactccaacagcaacagcggattcagaaaccagaacagcggttatcagaacaatcagggaaaccagaacaatagtgggttcagaaaccaaaacaatgggaatcagaacaaccagaacaacaacggtttcagaaattccaatagtaatggcggattcagaaattctgaaagcagcagatctgaatcttccggtggtggattcagaaacagctcaggcagccaaagcaccagctccagcagacagcagagcggcggaggcggttttagataaaacgattataaataagaaaacgaacagctaacactgttcgtttttcattttaaatatgttaattttgcttcttcatttaacaaaaaaatatggaattttataaatatcagggaacagggaatgattttgtaatggtagacaaccgtgatctgcaatttactaaggataaaggtattattgaaaaactatgtgacagacgcttcggaataggtgctgacggtcttattctcttggaaaacgatcccaattatgattttaaaatggtatactataattctgacggaggtgagagtaccatgtgcgggaacggaggaagatgtcttgtagcttttgcttttttcctggatatctttgaagataaatgcagattcattgcgacggacggcgaacatgaagctgaaattcataatggaattatcaaattaaagatgattaatgtagacgcggtatcccatgacggaaatgacttcgttctgaataccggttctccccattatgtaaaatatgttgaaaatctgaaggattatcctgtgtatgatgaaggatatggaatcagaaattctgaaacttataaagaaaaaggaatcaatgtgaactttgtagaaaaaatttcagataatgaaatttttgtaagaacctatgaacgaggcgttgaggacgaaacttacagttgcgggacaggagttacagcttctgctttaacttttctgcaaaaacataatctaacctctgtaaaagttaaaaccttaggtggaaatcttaaggtatatgctgaaaaaagcggtgactcattccagaatatatggcttgaaggtcctgcaaagcaggtttttagaggtaaaacagatcttctttaaaaacagaaacttttaatcaacattaacaggaatgaaaaaagctattctcattatcattctgctggtttttatagtggcaggattttttggtttgagattttataataaatatttaggaaataacgtagaaaaagaaggttatgtgctgattcctcacagggcaggttttaagcagatcctcgactctattactccttatattaaagacagggaatcttttgaagcagtggctaaagaaaaaggtcttgatacgaattttaaagcaggacgttatcacatccaaagcggaacaggaaacaaaaaccttgtcaatatgattaaagcaggaaaccagacagcaaattcttacaggattggtgattttggggatatgtatcagatgattggtaaggttaccaaaaaaacagaaatagattcattacattttgtaactgacctggatgctgttgcacaggagaaaggatacaaaaatgctgaggatttaaaaaaatattttttcattgatacgtataattttttctggacggtaagtccgagagaattttttgccaagtttgaagatcagtataatgatttctggacggctgaaagaaaaaataaagaacagcagtccggtctcacaagagatcagatatatgctctggcctctattgtctataaggaatcgggaggaaaaaaagatgagatgaaaacgattgccggattgtatttaaaccgttacagaaaaggaatgaaacttcagtctgatcctacggtaatttatgcgatcaataaacagactaattttaaagaacctataaaaagggtattatataagcatttgtctacaccatcaccttataacacttatgccaatgcagggattcctccggggccaatctgtgtagtggataaaaactcaatagatgctgttttaaatgctgaaaacaacaattatatatttatgtgtgccgatccttcaagacccggataccataagtttacggcaagcgctgaagagcatgctgtaaatgcaaaggcttatcaggactggctcaactcaaaaaatataaaataggcttaaaaagcaccaagaaacttatacagttagaaaacaataaacgcgaccataatattttgatgatcaaacagatgtgaaattcaaaatattaagggttattctttcacgatcttatacaaaaaaataacctatgaagaataagacagaaattgtcactattttcaccagaaaaactttaggacttacgttagtactttcagcggcagcattagcttttgcacaggagaaagctggagtttcagggactattgtcaacaaaaaaaaccaaccggtaccttatgcctctgtaactttcagtaataagaccaacaaaacattaagcgatgctgtactgacagatgaaaaaggacagtataagattcagcttatgcccggcgattatgaaattacagtagaagctattgattacaagaaaagtgtagtcagcaaaaatattgcagcagcaggtaatatcggggctttgtctattgaggctgaacctacctctactgttgacggtaaaacaaaagaaatacaaggcgttgtgattactgcttcagcagcaaaaccttataaagtagagcttgacaaaaaaacatatgatccttcacaggatattgtgagtaaaggaggaaatcttcaggatgttttaaccaatgttccttcagtttccgtagatacggacggaacagtatctatgagaggaagcaccaatgtaaagtttctgatcaatggaaagccttctgccctgcttgggatagatgacggagccaatgcgttacagagtattcctgccgaccagatcgaaagaattgaggttattaccaatccttcttctaaattcgaagcaagcggaacatccggtattttgaatatcatccttaaaaagaacaaaaaggttggatttaatggtagtgtggtaggatctctgggctattttccaagaacctctcttaacacgaacctgagctggagaaaaaataactggacctggtttctaaacggcggtggcggctacacagaaaataaaaccaagaacaattcggaaacaacctatcataaccttactttccctgaggtagttgctaatcagcagcctaatgatgttctggcacatcagctgcaaaactccaccaataaaacatataacaaaaattataatgtaagcgctggggttgtatatgatttatcggataagacctcaatcaattttacgggattggtgagaacatttgaaggagatggaaatgaacttcttgatacttatgacagtttttacaggtttttcagagattcacccgatccaagtacaacagcaggaaaatggaatttattaaatccgtctggaataagagattccaagagtgtattcaataatcttgctttccagggagatctgggattggatcacaaatttgacgataacggacaaaatttatccatatcattaagtctgcaacggaacagaagtaacaataatgcggatattcttgaaacttatgatcttcgtcctgatatacaggatattaccaaaagacattctgtaagtaaaacgattattggtaaagctgattatgagctgccaataggagaacaatccaagcttgaagctggatatagattggatgttaatgataatacttatgataattttgtaagcagtacttccaacaacccttttattccgagctacaataataatacagattataaggaaatcttcaacgctttctatcttcagtttaagagcaaaatcggagaaaaatttgcttaccagcttggcttaagagatgagctgtctaatgtcagcatcaattatattaataaaaatcctaatgataagccattagacaaaagcaaaaactataataatttatttccgagtgtattcttaagctatgatatatccaaaaacaatcagattttgcttaattattcccgcagaatagacagaccaagatcattcttcatggtccctttcccgaattatagcaacagtcagaatatttttgaaggaaacatagacctgaatccatcgtatgtagattcatttgaagtaggatataatatcaccagaaaaaagtttacggttaaccctaccctatactacagacatacaactgatgataccaaaatgctggtctacagacctgatgaaagccttggagtattctacacaaagcctatcaacttaggaactgatgaccgttatggtttggatctgaactttacttatgatccttttgcatggttgaagataatgggaagtctggacatgttcggatataaaaccagcggaatcgcttattatgatgccattgataaaaatgagctgcaccaaacccgtgacatgaactttacaggaaatggcttttctaccagagcccgtcttaatacgacatttaaacttgacaaaacgctaagtgtacaattacagggattctatagaggagcacagaaaactgccagccaaaatacacaagatatgtatgcgctgaatcttggtgcctctaaaacgatctggaaaggagacggaacaatttccttcaatattcaggatatattcaatacaagaagcagagaagtattcagtttcaatgatgactatacacgaagaaactatatgcagtggcagccaagacagtttgctatttccttaacttatagatttaagcagggagaaaaaattgaccagcctaaaaagaaaaaggatatcaattccaacgcaacgggcgacgaccaacaaggcggtccaatgtaacagaatataatacaactaaaaaatcccgaaaatattttcgggattttattttttattaataactgttattttacaggctctgctttcgagtatttctctttttcagcttcatagattcttcttctcagatcgctggtggaaaacctatggtctcttttattgtaaaagatttcaattcctttttcttcacagtattttttacctgtaaaatctttgtccatataatcatctccgatgattcttacatcaatcacaaatgattttaaaatatccaacagatcttcttccgtgtaataaggaatgatctcatctacagcatttactgctttcagctgaatatacctttcaactatagtctggcttggcttatttttgtttggacgatcgtgggatggatcgatctgaagtcctacgattaaatagtcacatactgttttagcttcttcaagcattttgatgtgtcctgcatgcaataagtcaaatgacgaaaatgtaatacctattctctgtgtcttcatattaatttaaaattaaaactccgctgaaataagtggtccttttaaggagaaacacaagtgattcagggaaggtgttttgtaatttgttttatatttaattattctttccaaacgtaaatatagcaatacttaagtttatgaatttctgctgttcagatatttctgccactcccatactgtttttaaagcttcctcaagggatgtttcagatttccagttgagttctctttctgctttttcaggattcgcatatgctattgtaatatctccttctcttctgtcacagatctgatagggcacttccacattattagccttttcaaatgcttttaccacttccagcacagatgatccttttcctgttcccagattataaatatcaattactgtttctgctgaagagtcttctatcagttttttcaatgctgcaacatgcgctttcgccaggtcaacaacataaatataatcacggataggagttccgtcttctgtgggataatcatctccccagatgttcagtttctctcttactcctgacgcagtctgcatcacgtaaggcaccaggttattgggaattccgatcggcaattcgccaagtttggcagatgggtgtgcgccaataggattgaaatatcttaacaacgatattttactgccataggccttcgcaaaatcaatcaggatctcttctcccatttgttttgtttttccatatacactttccggtgtttttaatggagtattttcatctatcggcattacatctgcctgtccgtataccgtacatgatgaactgaaaataaaattagagatttttctttccttaaattcctgaagaatattaattaaagagaacagattattttcataataatctataggttttacctgactctctcctactgctttagaagctgcaaaattgatacatccatcaatctgatgcgcatcaaaaacctgagtaagcagttcttttcttctcaggtcaaaaggataaaaagcaggcttcacccctgtaatttcctcaatattatttaaaataaacctctccgtattggataaatcatcaacaataaccacttcaaagccgttattgataagttctactacagtatgagaaccaatatatccaagtcccccggtaacaagtattgccattcttattttttaatcttcgctttttcctatatcatctaattctagaaactgtactcttttatttttgaaaacattcgttattaaaagaaaaactgacaaggtagaaaaaatggaaaaaaatttcaatgtatcaccttcctcaaacgatttttcaataaaaattttaatacagcccaaaacgagaaataataaaatcaaaatataattaatatttaaataaagaatagttcttttgcttttcaataaaagtaaaattaagcttaaaaatgcacttataaatattgatcctgcaaagagaaaaataaaactctctactgaaaatatctgctctatactgaattcaataaatgaatcataagtaccatagccaaataaaaaaagtaaaaacaactcgaatagaaatactactattccaactattctatatttgaatattctgtttttcattaattatcccataaactcaagcactgcatccgtaatatactttagctgctcttcgtctaattctgtatgcattggtaaagaaattacctgatccaaaagtttatcggtatttacaaaatctgcaggattactttcctggaagtatgctttttgttttctcaatgctacaggataataaatcattgcaggaatttctttttccgccaaaaacttctgaagttcattacgttttccgttcaggattcttaaagtatactgatggaatacatgggtagaattttcagctctttttggagtcaggatatccgggtgaccagaaaatgcttcatcataaaaatcggctgctcttcttcttgcttcgttataagaatcaaggtgaggaagtttctttcttaaaactgcagcctgaatgctatccagacgtgagtttactccaacctcatcatggtaatatctttcatacatcccatggtttacaattcctcttaaacggtgagccagttcatcattattggtaaaaatagccccgccgtctccgtagcagccaaggttttttgatggaaaaaaagaagttgttcctacagtagacattgttccggcctgttttaccgttccgtccgagaatgtatattctgaaccaattgcctgagcgttgtcttcaataacatataagttgtgctcttcagcaatttttaaaatttcttccatattggcacactgtccgaaaatatgtaccgggataatcgcttttgttcttggtgtaattgcttttttaatctgctctgtggagattgtaaatgtatcataatctacatctaccaatacagattttaacttaagcaggtgaataacttctaccgttgcagcaaaagtaaaatcagctgtaataatttcatctccttctttcagatccaaagccatcagggcaatctgtaatgcatctgtaccattggcacacggaatcacatgttttacgtctaaataagactccaattcattctggaaagactttacttcaggaccgttgataaatgccgcagaatccattacatttaaaactgcattgtctacatcattctttattttgtaatactgactttgcaagtcaaccatctgaatttttttcatataataaatatttctgtaaaaataaggattttaatatctgatcaaaaattttattgattttgtttttatctttatacaaataaattttatgaaaaaacttttactcttttgtttcctaacaagttaccttactgtttccgcacaaaccgagctcgtcttcgtttactttacggataagccgaataaggctgcattttatgcaaatccactctcggaactcagtcaaaaatccctcaacagacgtaccacgctgggaataccgctgaatgatcaggacgctcctattgaacagtcttacattcagaatcttcagaatttaggatttaccgttactgattattcaaaatggcttaatggtgcagccgtaaatgccactcctgcccaaaaaatcttattgcagtcacagtctttcgtttcctctgttgaaagctttgccagaaataattccggtacattaaagacagcaccttcaaaatggaaagacgatgcaagcatcaataaaacactgaccaactttaattacggttcaggcgctgcacaaattgaccaggttaatatacgccctcttcatctggccggctttaccggaaccggaatttctatagcagtcattgatgccggatttcccacagtgaatacaggtgcagcatttgcgaggttatggaccaataaccacatcaaagcatcttatgattttgttaccaaaaccgcagatatctataatgcttctctcagcactcatggttctgttgttttaggaactatcggcggatatctgcaaaacacttttgtaggggcagctcctgatgcagatttttacctttatcgcagtgaaaatgctgtggtagagattcctgaagaagagctatattggattgaagcggctgaggaagcagacagaaaaggtgtagacattattacttcatcactgggatataatattttcgatgacagccgttacaattattcatatgcaaacatggacggaaatacctctttcattgcccgtggggcaggtattgccgcagaaaaaggaatttttgttcttgccgcggccggtaattcgggacagcagccatggcattatcttctgacaccatctgataatgctaaagtcttctctatcggttctgtggattctgccggaaatacgtctggattttcttctttcggaccaaacgctttaggcgtggtaaaaccagacggaagcactcagggaaccggtacaacaacagtttatgataatgctacgctggtggtgaacggaacctccattgccactcctattgccgcaggaggtgtggcatgtcttatccaggcttttccaaccatgaacagggaacagatgagaacaaaattgagacaaaccgcttccctatatcccgcccattcggatcagatcggatatgggatccttaatttcgggagcttatacaatctcgttctcaatacttctgaaatcgtaaaaaaggaaaagttttccatatttccgaatccagcgaaaagcatcctgaatattgcgtcagaacaggaaattctttcattagaaatttatgataacctgggaagactcatcaggaaaagcaaccatcagaaatctataaaagtagaggattttgcaaaaggaacctattatctgaagattcagttgaaggataaggtcttctatgaaaaattcttgaaggaataattatttgtttcccgcagattgtgcagatggattacaacataaacatctgtacaatctgtgggagatacattactatttctggtcgtattacaacataaaaataagtttgagctaaagcttattgaatggtttataataaaaaaacgggctttaacccgtttctattgataatgattatcatctttatgatcattcttattttaaaaaatagcttatgcagagtttctactggcattaatatttccgaacagcgagcgtgttaccagcttttcataagcttccttgttgccttctcctttctgaatcttcattaaagcatactgctgaatgcttaacaacggaagcacaatcttttcacggatcttcacagattttcttgatagaggatcctcttcctgaagcattttgaatccggtcagttcgagcataatatctctggaaagctcatattcatcgaaaagaacattccagaatgctccgaatttaggattatttttaatgtagtaggttaacgggaaataagacttgttcatactcatcatcgagttcagaactaaagttttaaagaaatcggaacctttgtacagttctattacttcttcaaaccttccctgttctttcatcttctgcatggcatatccaaaaccaaagaaaccaggaacattctgcttcagctgtgaccatgaacctacaaacgggatcgctctcagatcctcgaatttcagctcgctgccatttcctctttttgaaggacggcttccgatattcgtttttccataatattcaagtgtactcatttcctgtaggtaaggaacaaacattggatgagctttcaggtctgaatattttttatagctgatatccgccaattcgatgattaaagctctttccttttctgtgagttctttttttgcatttttaaatacatcattttcaattccggcagtgagaagctgttcaaaattgtattttgcctgctctttgtttccgaaaatactcgttatggtttgaccctgaatggttaattcaatcttattattggcaatcgtttttccctgagaagcatagaagtcgtgtgtttttccacctcctcttgccggtggtccgcctctgccatcaaagaaaacaactttgatattattctgttccgaaagttttgtcagtacttctttagctttataaatttcccagttggcttttaaataaccaccatctttggttccatccgagaatcccagcataatcgtctgctggtttcctcttttttccagatgttttttatagacaggattctgatacagctcactcattacatgttcagcattggcaagcccttccattgtttcgaagagcggaacgatatccatattgatatcttcgtctttatacccacatactttgaagaatgcatagacattcattacgtcttttactgcatcagaattggaaattatataacggttcattcctctcaggccgttcagatgctgaatatctgtaacctgtgagacggttaataaagtatcttttacaatatcttcaaaatcttcaggatttatcttttcagaaatctgaataagcttattgaatttctgttcataatctgcttcttcattcccgtatacttttgcatacacctcatcaatgactttctgatgaatcctgctgtcctgacggatatccaaagttgcaaagtgggttccgaaaatcattacacggtctctgaaattcaccaaaagatctaaaaacaaagaattatgctcattgatcagtattttttccgcttctgcagccctttttaaaatatcttctgccttaatgtcttttccatcaaaaatagcagcataaagctcttcacttaattgggtcagaacttcagaaactcccctgaaacttaatcttcttcggataaatttcagatggctgtaataagatttcagaatggctgaacgcagttcttccgctactcttttcgttacatccgctgttacaaaaggatttccgtctctgtctccgccaggccagaaaccaagctggataatatcttcatgaaggtggaaatggccgtttccgaaagtcttcttgattttggtaaacagttccccaatggtatcataatatacatatctcaggtaagaaataatactcagcgcttcatctatcggagtcggtttttctttgttgacaaaaggagtctttcccagctgctgcaaaagcatatcaatctgagtcacggaatcactggtgatggcccctctcagatcctgaataatcctttgtactgagcttggataaaactgggtggggtgcgccgtaaatacaacctttacactgaaatcttttaatttctcccttactttttcaatcttatggtcctgcaaagagcgttcaaaaagattggtgaccgtaccattatcgctttcagaatgaagatttggaaatgctgcatcttcaatactgtcgaacaaaactacctgtctttctatatattgtatgatcttgaaaagcagttcaagtttctgctcttccgtctggagatcggtatgattcttaaaaaattcttcgacgatattttcaggtgtttttcctgcttcataaccggttctgctttcctcataaagaaacggaagcagcattccgatattcgtcattttatcataaggcaggctcataaataatgaattatagatctggaacttattttccacaatctgcctgaatttttctgcgcgttggtcgtgtatcatagtaacaaatgtaagcgattttcaaattagttggattgacaaatgacaaaaattaatggtgaaaatcaaaaaattatttaaattttttaaataatttttcaggtcaaaagcatgatttaaccatgaaatattttgtgcagcttttgacaatacagagattctttttaaaaactcaggtttaatataattttgattaattttactctcaataccatccataatctatgaaaaaaacttttattttcttacttatgacgtttctgttgatatcctgtgaaaaggattgttacaatgcgccattacccatcatctttgaatttgtgaattctgacaatgaaaacctcattgccaacgggacactgaccagctattcggttcaggatgaaaataatatgaatgtgcagctaagcaaaacatcggacaacaaggttattctggaaaatgtaggagcctataacggaacaaaaaactataagttttattctaatatcaaaaaccttgatttttcaatccagtcatctgaatttaaaggaggctgtgatggctatcaaatcaataagctgacttttaccggaataaattttgatgtaactgacgaaaaaggatattataaaattgtattggaataattctctttctaaatttgtacctggaaacacattctttatgaaagccatcatcacctttttcctgatcttctccaatcttctttacagccagatcaaggttcctgatgattataaaaaaattcccgacattcttgatactacagaatatctctacccgttcattgtgccggataaagagtatgcttactggcgtgtcctcagcaacgatatggactatgaaaaagctgtgatctatgaaagccaggctcccgattttatgacgattaatgaacctgttcccgaaaaaggtttttttcagaaatgtattggtaacaattgtttttcataccttcttgcatgtaagaatgaaagatcggtttatttttccagtgaacagcagttaagagactttatcggaactgtggataatcttcctgaagctattttactggcaaaaacctatggctattcggttgataccaacaaccgatttaccggggcttataaaattgaagaccgccatatttccatgtacctgatgcagtctaaaggctgtccggttgtaaaggagtcttttttagttaaaatcaacagaaaaaccggaaaactggaggcgaagagcaatggggtttatgcaaaagatgaaaactgttctattttgtaaatgatgattgtgaaaatacttaaaattgaaaatcttattttaaaccattaaggttttaagctggtaagagtacttaagggtaacagcgaaagctattttttagcgatgtgctttatttttccatcagagatggatcttaactatccttcttatcttcattaaccttaatggtttaatttttatatattgacagctccctgtccggaagctatcagataagcttccttcaacgtttcagaataggttggatgggcataggaaatacggaacatgtcttctgcggtcacttcatattcctgggcaataacaccttgtgcgatcagatcggcagctctggcaccaatgatatgaacacccaaaacttctccatacttcggatctaccaaaactttagcaaagccttccatgtccattgaggcccgggcccttgcgctggcagaaaacgggaattttccgacattgtaagctatattgttttttttgaggtattcttctgtataccctaccgaagctacttcaggccacgtatagaccactgaaggaatacggttataatgaatatgacgcttttgcccgttgatcgtttctgccaccaaaacaccttcttcctcagctttgtgagccagcatcgcaccgccgataacatcacctattgcatagatattgaagacggaagtctgattgttttcattcactttaatgaaccctctctcatcaagctgtacatctgtattttcaagaccaagacctttgacatacggacttcttcccacagctaccaatacataatctgcttccagcgttgcttctgttccgttttgatctttaaaaaacaccttagcggcagaacctgtattttcagttttataaaccgcctgattgagacggatatcaactccttcttttttcaggattttctgcaggctctttccaagctcatgatccattgctgcaatcagatgatctgcatattccaggatagtaacttttgttccgatacggttaaaaatagaagccatttccactcctattacccctcctccgataatcaccatagattccggcttttccatcagggataaagcttccgtagaggtaatgattctttgtttgtcaatttcaactccgggaatgcttgatggttttgaacccgtcgcaatgatataatattgtgccgtaatttctttaatttcagaatcgtttgcaacttttatcgtggaattattaataaaacttgccgttccttttaaccgggtaattttattcttattcattaaaaagtcgagacctccggtattttttgaaacgacatctgctttcctcctgtacatctgagagaaatcaagctctattgtatccagcctgataccatgttcattgaatttatggtgtgcttctgcataatgatgggtgctgtccagtaaagctttagtaggaatacatcctacattggtacatgttcctcccaatgtatcatacttttctacaattactgttttataccccaactgggcacttcttatagcagctacatatcctccaggtcctgagccaattacggcaatgtcatatcgatccatttgatttattactttttttgattaaatttacttgcaaaacaaaagcaaaattaaaacaaacactttcattttgcaagtattatttttaaaattaacaaaatgagtaaaaaaagatcagactgccccattagctgttcattggaaatgtggggcgataagtggtcactgcttatcataagagatcttatgctgaaaaaggaatgtacctatggtgactttctgaaagcagacgaaaaaatagcgacaaatatcctggcatccaagcttcagaatctgctggataatggcattattaataagaaagaccatccggacagtaagttgaaggttctgtattttctgactcagaaaggaataaatcttattcctgtaattgtagaaattaatctttggggagatcagtatttgactattcctgatgaccgtaaaaagcttattgaggatattaaaaaggataaggaaggttttataaagagagcaaaagcttatctttcatcagaagtttaatgtaatcttcaaaagttaaaaaaaataatagctttcataaaaatgagtgatagcaattttaaaatttcattaactctcttttcctttttcattccgtacatttgacttaaaataaatttagaacaatgcttaatttcgagtttaaaaacccaacaaaaatacttttcggaaaaggcgaaatcgcgaaaatttccaaagaaattcctaaagacgcaagaatcttaatgatttacggtggtggaagcatcaaaaacaatggtgtatacgaccaggtaaaagaagctttgacagaccatgaagtgtacgaattcggcggagtgccggccaatccggagtatgaagtactgatgaatgcgttaagctttattaaagaaaaaaacatcacttaccttcttgcagtaggtggaggatctgtgattgacggaacgaaattcctttctgcagctgccaattatgatggcgaaccatgggatatcctgagaaaatctgtacggacttttgaaggcgaaggaatgccattcggaagtatcttaactcttccggcaaccggttccgagatgaattccggatatgtgatctcaagaagagaaaccaatgagaaactgtcttcaggaggaccgggacttttcccgcagttttctgtactggacccggaagtgatcagatctatcccaaaaaatcagattgtgaacggaattacagatgcctacactcacgttcttgaacaatatatgacggctccttcttcggctgaccttcaggaaagaattgcagaaagtattctgatcagcctgcaggaaacggctcctaaagtattggctgatgatttcaactacgatgctgccggaaactttatgtggtgctgtacaatggccttgaacggactgatccagaaaggagtgattaccgactgggcggtgcatgcaatgggtcatgaactgacagcttattttggtattgaccacgccagaacactggctattattgctccgtcgcattaccgttataactttgaagataaaaaaggaaaactggctcagtatgcagaaagggtttggggaatcaaagatggaagtgtagaagaaaaagcagaattgggtatcaaaaaactggaagaattcttccacagccttcatatcaaaaccagactttctgaatacacggatgactttaaaggaacagccgaaaaggttgaaaaagcttttacagacagaaactggctgggtcttggtgagtataaaaaactgactccacaggacgcttataagattgtggagatgagctattaaaaggattcggggtgcgggattcggaattggaggataatatttattttaattcatattcactttcaaagcgaaaatagataacccgaaacccacatcccgtatttcaacctctataaaattatttaatttacaaacatttgtttaaaaaatcattatttcattacagatatttcaaatttatttatattttagcatattcttaaatttgtgaaaatgaaaaaacaactacttttatttaccttttctgcccttgcacttacttcttgtaaagatgacaacctggaagcttacgatatggagattatgaagggagactggaaggaagtaaaaaaggaaataatttcaggaaaagataataaaacagtacttttttcctatccgaataccggatgcgcagccaaaaacacacttttcctgagaacagattattacgtaagctatacggcatatacgggaacaggagcagattgtcagatggatcagaaaagtgaaggaaggtacacttatgatgcagacacaaaaattctgggtattaagcttggtgatgaaggaacagctgactacagagtggatgttctgacaagcaaagaactaaggcttgcccagcaattcggaaactttgatatggatggagacaaaattcctgaagttgcttacgttacttacaaaagataaatcatagactcccgctaatcgggagttttttattatttttatatcttaatttaaaactgaatataatgaagaagattctatcagcattcttattgctgtattttgctattgctttttctcaggagaaaaaaccgatgtactggcaggacatccaggagtttaaaaagcaggaccagcaaaacccgcctccaaaagatgccattcttttcatcggaagctcctcttttaccaaatggactgatgtagcagattattttcccggcaaaacaattattaatagaggatttggaggttccagacttactgacctcaattattttgctgatgatcttttagcaccttatcagcctaagcagattgttatttattgtggggaaaatgattttgcagacaatcatcagctgaaagcaaaagtggttgtagaccgatttaaagctttctacaaaaaaatacgtgaaagatttcctgatattgaagtagattatatctcaatcaagtattcgccgagcagagaagtgatctggcctcaaatgaaagttgccaacaaaaagatcgctgctttcatgaaaaagcaacctaatgctgaattcattgacattacaaaagccatggaagatgctaacggaaatgtgagaaaggatatttttgtggaagatatgcttcactttaagccggaaggatacaaaatctgggcaaaggtgatcaagccctacctgaaataaacgacgacccatgataaaaaaaacaataaccattttatgctctgttttactgtattctgtttcattttctcaggagaaaccgaatgaaaaaacagttcttcaggaactctcggaaaatgcctgtaaatgcgctgatactatttctctgtctaacagaaagaaagaagagatcatcaaagatattcatcagtgtattgatcaatacgcaggagcacttcagatctctacacttttgaaaggggcagaaaaacaatctgaaaatacaccagaagtaaacggtaaaaagcagattaatctgactttcaacaccaataaggattccaagcaatacagagacagctataatgagcttgaacgttatctgatgcagaactgtgaaagtgtaaagagggctaccacaaattcagaaaccagccacgataagttctcaaaaaatgcaaaggctcttgatttctaccagaaagccattgatgcatccaaaaaggaaagctggaatgaggcgattcagaattatgaacaagctgtaaagagtgatccgaaatttatttacgcatgggataatctgggaatttgctataggagagttggagaatacgataaggcccttaatgcttatcaacagtcattagctgtagattcaaagggcaaaatgcctttacagaatatacccatcgcctatatttataaaaaagaatatcagaaagctattgatgcttatcataatttagataaggtataccccaatgatccggaggtttattatggaataggacaaatctacttcactcaactgaaagataatgaaaaagggcttgattatatctgcaaagcatacagaatttacaatgaccagaagtctccttaccgttctgatgcggaatccgtaataagccgtatttataaggggatgaaagaggaaggaaagatagataagttcaaagaaattttaaaaagcaataacattcaaattgactaaaataaaaactcccgggtgaatccgggagtttttattttatttctttctttttgatttagattttgctttctgctgagctctgttcgctccaaactttttaggcgcctttcttttggaaggtccaccccagttctctttagtgtttttagctttcttctcatggaatgctcctcccccttcattcagttttacctgtgcaggattcttcatcaccacttcatctttttcagaagctattttgttaggattgatcttaacgccttccgggaattcattaaatttcaattctttatccattaacagctcaatatcaagaattaaaggttcttcttttttagtcacaaaaaccaaagcctttccttctttatccgctctaccggttctaccaatcctgtggatatactgctcaggaatatcaggtgtttcaaaattgataacatgggtaatattggaaatatcaagacctcttgccattacgtctgtagtaattagacctctgatctcttcattttcgaaccttttcatcgctttcaacctgtagttctgcgatttgttagaatggatcacgtcaaactgttcagggaaaagctcatcaattttagtaaagagcaaatcggcatgctttttattgttgttaaaaatcaataccttggacatatctgcatcgttcttcaacaaatattcaagcaaattgattttggtattaaagttttcaaccttgtacccgatctgttcaattttttcaagcggcgttcctgatttagccaatgaaatctctaccggattggcaaaatagacatccagcatttcatctaccgcttctgtcattgttgcagagaaaagaatattctgtctcttctctttcatcatttcaaaaatgtgggtcagctgtggtctgaaacctaagttaagcatttcatcaaactcgtcaatgatcagcttctgaacttctttcagagaaatagcattatctatggaaaggtccatcactctacctggtgttcctaccagaatatcacaaccgtcattgaacagtaatttttgggtattgatattctttccaccgtaaactccaattactcttgccgtaatattttctgtaagcttctcaagaatttcagttacctgcaccaccaattctcttgtaggaaccagcaccaaaacagttggatttcctgttttgctgtatttccatgttttcagaacgggtaaaagataggctaatgtttttccggttccggtctgtgcaattcccattacatctcttcctgagagaataggttttaagctcttctcctgaatcggggtaggttcaaataattcgagatccgctaaaacatcaagaattttaaccggcaggtcaaaatctgcaaaagtgagtttttccattttgcaaagataggtatttaattttgtagtatggaagcacgaagcctgaagctggaagattatcaaacgttctttaattttttgaatgtacaatgaaaccgattaatatattaacacaggtcatttccttccctcttccagcctccagctattttaatcaattcaccttaacactttcactgataattttaatatcatcatctatccacttgcttgaggtaacaatgacataaccattctttttcggatcttttctgataggaaaccgatcttcttcccactgattacaatgggtagaaatagacggtaataatggcttccagcccgctttacttaaagtatatacgtagaacggatgccagcagctggtacaccaatacggataaaagccaatttcatcttttccgtcaccgttaaggtcaccaagattatagagacttccctgattcgctggtgtaattgttatcgattgtatatttttatcactgaaataaatggttgtttcacattttccttcacattcctcaccacagtcggtgacttttgtgtaagcgtattctttggttccgtttccgtcaaaatctccaagaagtttttcttcatttccttgttgagccatacaaagtgagctgaataaggtgatggatgttataataagtgttttcattgtttttagtttaaatacgggtttgggattcgagttacgggttgcgaggtgcgcgggattagggtttatacattcttcggattcaaattcaacttcctttttattttctggttactctcagcagtaaaattataaccaaaaggattgagaagataaagcccaaaaccgctaccagagagagctctcctattcttggtccggattctgatgaaaaaacgattgccgtggcaatgatattggcacccaggaccatcgccagaatcagatttaccacactggatttgatcagttggttggttttttcaatattttttatctcgctggaaacagtaaacttgttttcgtcaagtttttgcagtacagaacggagttctttcgggatttcatctacattatcggtgaaattcatcatccggtccattcctgtttttaaaaggttcttcggactgatttttttggtgaatatctttttggtgtaaggatgaaggcttttaacaatatcgagatcaggattaatacttctgccaactccttctatcaagctgattcctttgaataaaagatagaaataatccggcatataaagcctgttgtctttcagaatatccttcattttgttgatgattacctgaacattgatatcctgtaatgacgaactgtgaacaaaattcagaatatcttccacatcattttcaaaccgtctttcatcagggatttcatagcttatggccattttcttgagtgaacggactattttatgggaatttttggccacaaaacttacgataagattttcaagaatttctttgtcattaggctgaattttccctactgcaccaaaatcaatgaaaacaattttaccatctttttttaccagaatattcccggcgtgaggatcagcatgaaagaatccatagtctaagatctgagaaacaaagagccttaatcctgtttcagaaatttttacaggatcaatatcattggccagaagaactgatttatcggtaacttttatcccatcaataaattccatacaaagaatattgttattggaaaattcttcgtacactttaggaacataggtttctttattatttttaaaattaagccggaactgctggatattgtttttttcattgatgagagaaacttcttccaataaagacttttcaaaagtagaaatggcttgcttcagattcagcttttctccgatttccgaataggctgatatcagcttttcaatgtctttaatcaaaagcaaatcatcttcaataacagactgcacatcaggctttcttaattttaatatcaccgggctgccgtcaagtaaaatacctttatagacttgtgcaatggaagctgtagccaaaggttccttctggatttcgcggaaataatccttaacagaaatattaaactcactttccagtgcttcctctacattcatatctactgtttccactttatcctgcagtttctgcagctcctgaatcatttctggtggcaataaatcttccctgttactgaatgtctgaccgagcttcacaaaagtaggtcccagctcctcaagagccaatcttattctttcataaacggttccttttgaaataatttcatccgaactgcctgaaatgtcttcctgcttatttcctccgttcattcttgccagcatatctttaaatccatatttactcaatacagaaatcagtctcgcggatcttttcagttttctttgtggcttgtcaaacatagtgtattaatagtaggttcaatgtactccaaaaattgttcctttatgaaaagaattattataaccatattgcaggataaaaattaaaaaataataacacacaatcagtattttaaagaataaaatacaccaataccaataaaaacatatcatatattataaaaattaatatatttacaacgtacaaattaacaaactaaagtattaaaacatgaaaaatttacgtaacaacaaactttcaagagagcaattaaaaggaatcgcaggaagcggccttagtggtatcattattccaaactgctctaacgagtgctgtcctactgatggaagaccaagatgcccaagactgatttgtcctgcggtagtttgccctcagtacgtttaatgtattttaaaaattttaggtaaaaaataaaaacagaatgcaattgcattctgttttattatttaagataggtctcatagagatctttacgacggtctttcattacctgcacagaaccgttgtgatgaagatcttttaataaatttaaatctacatctacaattaaagtcatttctgtattgggtgtagcttctccttttactgcattggatgggaaggcaaaatcggaaggagtaaatacggcagcctggccgaactgaatatccatattgtttactttaggaagatttcctacacatccggcaatcgcaacataacattcattttctatggctcttgcagcggcacagtgacgcactctcatataagcattctgagtatcggtcagataaggaacaaacaggattttcattccctgatcggctaaaattcttggtaattccgggaattctacgtcatagcagattacgagacctattttaccacaatcggtatcaaaaaccttgatttcatttcctcctttcatcccataatatctcttttcattcggagtaatatggatttttctgtattcgtccatacgtccgtcacgatgaagaaggtagcttacattatacagttcattgttttcaaagacaggcatgcttccggaaataatattcacattgtagctgattgccagttcagaaattttattcttgatctgctctgtaagtttcgccagctctatcatactgtctctttccgaaaggttgttgaaaggggccagcaaaggagtgttgaacagttccgggaacagcacaaaatctgatttgtaatctcccatcacattcacgaaaaattctacctgctcataaaaggcatctatatccttgaagtgcctcatctgccactgtaccaatccaagacggataatgctgtcctgcatggtattcggtcttttgctgtaatagatattgttccattgcaaaagcactgcattttctctggaggcttcatcttccggaaggtattttttcagtaccctgatcggcaaaaaattgttggaaagctggaaagacagtaccggatcatagatttccttatctctcactttccgtatgtattccctgggagaaagctcgtgactgtatttgtgatagctcgggattcttccaccaagaatgatagattttaagtttaactgttcgcaaagttcttttcgtgcgtcatacagccttcttcccaaccgcagctcacggaattcagggtctacgaaaacttctattccatacagaacatttcctgtggatgaatgggtgttgaaggtatagtttcccgtaatatcgctgtaggtatgatcatccccgaattcttcataattaacaataatggaaagtgctacagcggccagcttcccgtcaaccgtgatacaaatttgtccgttggggaatatttttgtgagtttatcaatactttttttggaccatatagattccgacatttgcggataggcccttttcatcgtttccgccagttcatcataatcctgaagggtcaggtttcttgtttctatttgcatttgatgtaattttacttaaatttaatgaaatttgctttaataggatattacctatcaaaacattaaccaaacattaattcggaatggcaataatttttctgaatcaaagcgaatgtcccgtttgtaaaaaaactttagataaaggacaggatatagttttatttcctcctttcacctcggacaagaatcatcaattttacttatttaatgatgaaggagctcatcgttcttgtttgcagaaaacaaaacttggaacagaagctttaaaatttttagaaataattctccgatataaataaaaaatcccacccaaaagggcaggatttatatagtaaattcaagtcaaaattattcccactcaatagttgcaggcggtttgcttgaaatatcgtaagctactctgttgattcctctcacttcgttgatgattctgctggaaacagtatcaaggaattcataaggaagtctgctccatgttgccgtcataaagtcgatcgtattggcagaacgaactacagctgtgtattcgtaagttctttcgtcacccattacccctacagattttacaggaagaagtacaacaaatgcctgagatactttctcgtaaagatcatttttgtatagttcttcgatgaagatatcgtcagcttcctgaaggattctcactttttcagcatctaccgctcccaatactctgattcctaatccaggaccagggaaagggtgtctgtataccaggtgatgaggaatacccaattcttctcctacttttcttacctcgtctttgaaaagttctcttagtggctctaataattcgaattccatatcttcaggaagtccgccaacgttgtggtgagacttgatcactgcagatggtccgttgacagactggctttcgataacgtcaggataaatggttccctgagctaagaatttagcgccttcaattttgtgagattcttcgtcaaatacgtggataaattcgtttccgatgatttttctcttcgcttcaggatcgtctactccggctaattttgaaaggaatctttctttagcatccaccattttaatgttcatatggaaatgttctccatactgatccattacttttttgccttcatcttttctcaataatcccgtatctacgaagatacaagtcaactgatcgccgatcgctttgtggatcaaaacagccgctacagaagagtctactcctcctgaaagaccaaggattactttattgtctcctactttctcacggatttcctcaactgttttttcaatataattggtcagtttccagtttttctctgcattacagattccaaatacaaagttttcaagcattttccctccttcttcagtatgggaaacttccggatggaactgaacgcagaaaattttcttatcttcattagagatcgaagcaattacacctgatttcgcatttaattcaaaacctgcaggcaattctcctacttcgtcaaagtggctcatccaaacaacagagttctgagtcactccttttaataaagagctttctttaacgatctctaagttggctttaccgtattctcctttctctcctttgtttacttttcctcctaaaaggtgagccgtcatctgcattccgtagcagattcccaataccggaactccctgctcgtataattctttttcaaccaggtgggcattttctgcatttacagaacttggtccaccggaaagaatgattccttttggctgttttgctaaaatatcttgtaatggtgtattgtaaggtaagatctcagagtatacgcccatctcacggattcttcttccgataagctggttgtactgggatccgaaatctaaaataataataccgttgttcatttttgataattgataaatgatgattgataaatgatagagcttatggcggctcgcttatgactgatggcttggagatcactccaaattaacctttacccaactcacatctaacctctagcttctaacttctaattattaactgttttacaaaaaaagacttggaatgactccaaatcttttttcgtgatttttattgaaactttccgatgtcttctctgtagaagccgtaatcgaaatgtacgtgagctgcgtcttcgtatacttttttgcgggcatcttcataggtagctcctgtagccacaatgttcagtactctaccgccattggaaaccactttgtcacctttactgatggctcctgcatataatagtttactatgcttcaacttatcttctcctgtgatttcgaagcctgtttcgatgtttctaggatatcctcctgagcacattaccagacaaacagctttttcgtctttgaatttaagctcgatatctttaccatccatacagtcctggatcacatccaaaagattgttttccaaaagagccatcaatacctgtgtttcaggatctccgaatctcatgttgtactcaagaaggtaagctccgtttttcgttaccatcaatccgaagaagatgatccctttaaatccgaaaccttcagcttttagtccttttacagtaggctctaaaatatttttttcaaaatctgcataatgttcctgagtaaattccggacttggtgctactgatcccatacctcctgtattaggtcctgtatcaccatttccagcttttttatagtcttttgctgctacacatgggaatagtttttcaccattagagaacgcaataatagacgcttcaaaaccttgtaaatattcttcgataactaaacggatacctgcatctccatagattcttctgatcataaaatcatgaatcgtagcttcagcttcttcaagggtatcacaaataacaacaccttttcctccagctaaaccacttgctttaacgactaaaggatactgctgtgtctttacatattcgatcgcttcgttatatgaatcaaataccacagctttagctgttttgatatcataggtctgcataaatttcttagagaaagctttacttccttcaaggcttgccactttctgagtaggaccgaaaactttaagatcgtgctttttaaactcgtccttgatacctgctacaagcggtgcctcaggacctacgatcgtaagatcaatcttttctttaatggcgaaatctctaagttctttgatttctgataaatgaacatttttccctattacatcggtagtagcattcccgttggcaaaaaacattttagaaattctcgggtcattctgaagctttgccgctaaagcagattctctaccgccttcacctatgattaatattctcatactttatttattatctagtcttaatttacaaatatataattttgaatgctaaaaatacaatccctgattattttttaattctattttaattagtggaaaaagtgtctgacacctgtaaacatcatcgggattttgtgctcattggctgcctctatactatcctgatcttttacacttccacctggctgaataattgccttgataccttcctgagcgcagaagtctaccacatcacggaaagggaaaaatgcatctgaagccagcaccagatctccggagaatttttctttagctctttcaatagcctgttgcgttgcccagattctgtttacctgtccgccaccgataccgaatgcctgaattccgttggaaactacaatggcatttgacttcacatattttactactctttgcgagaaaagtaatgcttttttctgttcttctgttggctgcacttcagtaactactttaatatcgtcagagaagtgggtatcattatcctgaacaagaataccaccgtctaccttcacccatgtctgtttgtctgaaacagggtttacgattctgatgattctcaggtttttcttttttcttaaaatttcaagagcttcttcatcaaattcaggagccattacaatctcaaggaatgttttgttcagctcttcagctgttgctgcatcaattttatagttcattgcaacaattccgccaaagatggaaaccggatcacattcgaatgttttcttgtatgtttccaatgctgaagtcccgatcgcaacaccacaaggagtagagtgttttacggcacagcaagccatttcttctttgaactcatttactactttccagcaaaggtccatatcacgaagattattgaaagaaagttctttacctccaagctgttcgaagtctttcatggctccgttctcgaaagtagaaacatagtaagctgccgtctgatgagggttttccccgtatcttaagtctgcaacttttttataagaagcattaagataagcaggatagtcttcatctaaaagcattcttgaaatagctgcgtcataagcagaagtaaggttgaatacctttcctgcaagctttttacgggtttcaatgtaagtatctccgttttgctccatttcaattttcactgctgcataatcctcaacatcagtaattactgttacggaatcaaagtttttagcggcagaacgaagcattgacggacctccgatgtcaataaactcaactttctcatgtaaagaaatgtctttgtttacattctcaaagaaagggtaaaggtttacgattaccatgtcaatcagaccaattccgtgctcctgaacggttttcatatgctcttcgttgttacgaacagccaataatccgccgtgaactttaggatgcagagtcttcactcttccgtcaagcatttcagggaaattggttacctcatcaatctgaataggatttaaaccagcgtctttcaaatgtttgaacgttcctcctgtggagatcaactcataattctgagcttccaaaaactgcgcgaattctattaatccacttttgtcagaaacactgattaaaactctctttttactcattttactttcaattttttactttttacagctatttcaaactgtgtccgggtctttcacctccggacttacttttattttttacttagatttctttttattattaaaactgatctttaattaaaactttaaaatcagattattattttggtcataggaaaatttccactttccaccattttctccccacttgatattattttcgtcatataattcagtttttatctctcgataattattttctgaaaggctacgataaaaaaaagtgtctagcaaacccaatcttttaaaaggattcttggcattatcataatcaaaaaaggtaatttctgctctagtgcttttattttcattataatcattcaaattctgacgcactattttctttaaatttgccccttcatatatgagtatatcaactttctctaaaaagccaagtgaagaatagtttggagtcccaggagtaatattgggatacttcaatgtaattttagtcaatttaccatcggaactatactcgtaataatattttcttacatcatagatattaccaccatctggaacaggaatatatttttcaataactttcccattactatttaaaacatatctaatagttttaggagtaactgaactcccatcatcacttttattttctacaacaacagtattttctatatatgacagatttgtatatattggatatatgtacccataatctttcctagcttttataagccttccctgactatcataagtaaacaattgataataatcgtgtagtggattaggctcatcttcatcaaagccgacaattgacttcagtagtttatcaggacttaaatcattagcactaatctccatgtttacttcttgagaatcctcattagaagtacaggaagacaatgttattgatattaatattactattaaaactgttttattcatatatgattttacaatcattatttagtttttaaaactttattgatcgctaccggaaaaatttcatattcaatctggtgaactttctgagccagcgtttcaggagtgtcatctgctgtcacttcaaaagatttctgaagaatagcttctccctcatcaatgcccggcgttacaaaatgtacagtcgccccactctctacttctttggcttcaatgactgcattgtgaacgttcattccccacattccttttcctccgaatttcggaagcaaagcagggtgaatattgattattttaccattccagttttcacagaattcagattttaaaatggataagaatcctgccaatacaataaggtctgtattttcagggattactttggccaactcgctgctgaagttctttcctctcggaatgagtatgttttctatattatgattctttgctctttccagtccgaaacattctctgtcagctaccaccaaagttacttttgcattctggatttctcctgagtcaatagtatcaatgatcctttgcagattggttcctgaaccagatacgagtacaacgatgttcttcatattttttgtaaaatgtaaaaggtattcatgtattaatgacttccaacatcatgaatacattttacgttaatacatttatacagttaagtttattttctctgctccttcagtgatttctccgatttcgtaagcatcatctaaaaggtgtaatactttttcagcatgctcagcatctactacaacaatcatccctacccccatattgaatgttccgtacatttcctcacgtgttactccacctcttttttcaagctcaagcattacactaggaattctgattctggatccgtcgatagatgcgcaaagaccttcaggaataattcttggaacgttttcgtaaagaccacctcctgtaatgtgagcaattccgcttacttttacttcttccaatactttatggatatctttataatatagtcttgtaggaactaaaagggtttcatataatggttttccttcaaactcttcttcaaagttcgggaatacttttcttactaaagagaatccgtttgagtgaaatcctgagcttggtaatgcaataattttattaccagccttaatggtagaaccatcaataatctgatctttttctacgattcctacacagaatcctgcaacatcataatctccaggctggtacattcccggcatttcagcagtttctccaccaatgagtgcacagttattatccttacaagcttccaccattcccagaacaatttctgcagcaatttctgaatcaagttttccacaagccagataatctaagaagaataatggtttagcaccatggcaaagaatatcattggcacacattgcgaaacaatctacaccgatagaatcatattttttggtatctaaagctactttcagcttggtccctactccatctgttcctgatacgagaaccggatttttgtatccgccgatttcatagaaagcaccaaaacttcccaagtggttcaatacattggaattgtgggtttcaccgaccgcttttttgatcttgtcaaccgttttgtatccttcttctttgtctactcctgctgatttgtaagtgttgctcatgtctgcttagatttttagatttcagatttcagatcttatactatttgatctagtaatggtttccggaatcttattatcttttaatatttcaattaacttttatactcaattttagaaaacaaaaaagccgaaaatcttttcagattatcggccgttattttatctcagaatttcagagcccacaactttccctttatgagaaaaacattgtttataggaggtctgaattttcatctcttttctttttgcaaaaatagtaattttaaatgaatattcaaattctatttttcaaggatcgtttcaatagccgaaatcttcttaattttctcttttaattcactgactttctcttcgttagagattttttgagtttctttatcaaagttatcattgaagaaaggaagtgaaaaagtatccaccacatttcctccatggaaaggaaaacgttttgatgcagcttccaaaactccagctccacctctgcctcccggagatgtagacatcaatagcattggtacttcattccaaacggttctgtctttgattctggatacccagtcgaacacatttttgaatgctgtagaatacgttccgttgtgctctcccaaagaaaccagtaatacatcagctccgtcaatttttgctgcgaaatcatgagcttcctgaggaaccccattagccagttctctttcatgtttgtagataggcatttcgaaaggatttaaatcgatcacttctacttctgcattttcaaataatgttgatgcataggctaccaactgcttgttcattgaaacttctgagttacttcctgctattgctaaaattttcatataggtgaggtttattttttaagattacaaatttagttttttatttaagataagacggcagttccatcggtacttccattaataatacttcagtgtcttccacggcttctatattaaagctctgagtgtcccagattcccaatccgtctctttcgttcagaacacggtccccgatttttgcacttcctttcagaacaaatgcatacactccgtttcctttcttgttgagcatataatttttaccatttccttttttaaagttggccagattgaaccaggcatcctgatgaatccagactccgtcatcatttttattaggtgataaaatctgttggaatccattgattttttctccttctttaatgcttttctggtcgtatcttggttcaacattaagctctttcgggaaaatccatatctgaaggaattttacttcctcatctttatttttattatactcactgtgcataacaccggtaccggcgctcattacctggatttctccttttctgatcaccgcagtagttcccatagaatctttatgttcaagatctccttccaaaggaattgaaataatttccatgtccttgtgcgggtgtgtcccgaaacccattccctgagaaacggtgtcatcatttaatactcttaaaactccgaaatgtgttctgtctctgttttgatagttggcaaaactgaatgtatgataagaatttaaccacccatggttggcgtggcctcttgaatctgctttatgatatactgttttcattttctgtgattatttatgatacaaatgtacggcatgcagatgtttaaatagttgatgtaggttaagaaaggaaatttggaagtaaaacagcaaaaatgcaaaacagtaaaaatgctgtgggagcaagtaaaatggttcttttatagttggactgctcaaaaacacgattttatattctatgatgtttttaaggtgcaaggattttatctgtgataaaattttataaagattgatggcttgaaccaattgtataaatgcaaatacctgtgttatctgtgaaaatctgcgggagattattatattctgaggatcaaaaaaaataaatatatgaagaataaagtttatttcggctaaagccattgatgagtgcttaaaggaaaagcgggctaaagcccgcttctattgaattatttatgacttcttatttttaaaaaagaattgtagtatagtctgtattataagttcttgtttctatattgagtttatttaaaagcatttcggcttcaagtcttatatttttccatgtttcatgctcgtctaggaaatcccaatcccatatttctacaggaatatcctctacattatttttaaattgtagtaaatcatctttgagtgattcattaatccgtttatttctaaaaatagtttcaaataaaacaggaatgaatgcataatgaagttcttcgtacaattctgctaatgggtctattaaaatgggtgccatttcatccaattgatctacattataggtataaagaatcaatgagttgacgatatttgtataatagaaatctacatgtttatcgcattcaaataactcttcttcagtaaagccgatatcttctaaattttcagtaacgtttatattttcaagcttattcttttgttttgtagtcgaaaaataattcttaaaaaaattaagcttcatgataataattttaattttccctcattaacaaaaataataaattttggctcctatgtttgcaaaagaataaatttacatacaaagcaaaaggggtgagagaacagttttggctaaataactcaggaagtatattgtattgtgctttagaaatgtcctcacttctttattgacagattttgaagaaagtagggtaaaaatcaaagaccttcaccctacgcaagctaactcaaggtcgcttttataaatataaatgtataaaaaatatttggaagttaacacagaatctaaagccaattgatgaatatttaaaggaaaagcgggctaaagcccgctcctattgaattttattatattattagatttaaattaaagttttcaacgcaacttctaatttctaacttctaatttctagttaaaaatgaacctgcttgatttcttcttcaatttctttaggtgtttcatcctcagatttaataaaaatcatggtcactacagccccaatgagcatacaaacaccccctaccacaacataatccatggcctgttttccaaaaatcccgcttacgacaggacctccgaataaaccattgatgatctgcggaattactataaagaaattgaatattcccatataaacgcccatttttctctgtggaattacctcaatgagcattgcataaggcattgccagaatacttgcccatgcaaaacctaatccgatcatagagatccataaattgttgacatctttaatgaaatacattgatatgagtcctaaccctccacacaataaggctaaagcgtgagtctgttttttaccgatcagtttagcgataggtgttaatagaaacgcaaacggaatcgcccagagattgtacattccgaaaagttttccggtaaggtctccagcatcgttaaatgctttggaatgggtgtcttccggcgaaagtccgaaatgatgagtggccagagcactggtggtgaacacccacattgtaaataaggcgaaccatgaaaagaactgaacaattcccagctttttcatctgcgaaggtattgctgcaaagtctttaaaaatatctgaaaatctggattgatgcttttctacttcttttccatcttcaaaatcagcaaattcctgtggggaatactctctggttgtcatgatggtatacagaatagatataataagcaatgctgcaccgatataaaaagaataaataacattatccgctacaaatcctgccggtgcttcattggaaatccccatctttgttaaccaatctggtaaatatgaacccagtaccgccccaattccaattaaaatggtttgtaccgagaatcctattgttccctgatgcttaggaagcatatctccaaccaaagctctgaaaggttccatggcaatattcactgaagcatccatcatggcgaggaatattacagctaacaaaagcgcattggcagcaaacatctgagtaacagaagctgcattcggaagtaaaaccaatcctattgcgcacaagacggctccaatcaggaaataaggttttcttcttcccaacggactccatgtattgtcacccatatgtcctatgataggctgaatgatcaaacctgtaatgggagccaccagccagaaccaggatagctcgtgaacatccgctcctaaatttccaagaatacggcttgcatttccattctgtaatccgaatgccatctgaattcccaggaatcccatgctcatattgataatctggagcatggataggtctggttttttcctttttcctaccttcccagtatcatatttccccatcattattgccattacgatttcagtttttgaattaatgcatcttcgataggtgctttttcagtaaccactttatcaacaacctcattaggaacagtcatagaaagaacatactgttttaccttccagcttccattgattttctcaaccactccggaacctctgcaaattttcatctgggtatccagtaattcatcaaaccatgccagctttccgtctttgctgaagtaaatatttcttttaacggctttaaagttccaggttttctttttgtcgaaataaggttttgcccacaccataaatgcttttttatcccagatttcggtagcatctgttccgatgaaggtagattcatccgcaaacagattaaaataggcattataatctgcttttgccgcagctgcattgaaggtatcaagcatagaactgatttccgatttttctttttcaaatccggttttcgactgtgctgcaagtaaggaaaatcccagtaaaaaaaggattagtgaataagcagtcgttagttttttcatatataataattatttttcaagttcaataatcaatggagtttttgcaggaatgttcatactgttttgcaatggaatttctttgtctgaaataatttcttttccttttgtaaatccattcagtgattctgcaaaccgtttcagatctaacgtctggtctttttcattattgttgatgatgaccattacactttctttttcattgtaccggaaatacacaaaaacaccatcctgaggcacgaaatttttagtttttccattatgaatcacatctttgtcttttctccagttcagtagtttttgagtaaactggaaaaattctttctgttccggagtttgagaggatagattgaaagcattttgtgtatcagatttccatcctcccggaaagtctctgcggatatcagcatcgccgccagtctttttatctcctctcattcctatttctgatccgtaataaatctgaggaattcctcttaccgttgaaatcatagtaagtgccattttataagcatcaggattggcgttaaagatttcattccatctttcggtatcatggttttcaaagaatacgagaagattgttgatatccggatacagaaaatcacttgtaaaagagtcataaaccctgatcattcctttatcccagctttccttttcactcagagccttaggcatattttcaaagagcataaaatccatcaccgatggtaaatttgaattgtaattttctatcgccccgatcttcgaatttttctgccacgctgcaatttgtgctgctgtatacagccatgtttcccctacaatattgaattttggatattcatctgtaattgctttagcccattttgccatggcttctttatcattgtaaggataagtatctacacggaatcctcccagttcagcatattcaatccaccagatcgcattttgaatcaggtatttcaggaccaaaggatttttttggttgatatcaggcatggtcgtatcaaaccatccgtccaatgcatattttttatcaatatcagaggcattggtatcaaattgcgttgtcgttttatagttggaacgtttaaatcctttttctccttcatcaaaccagtggatccagtcttttgaaggaagatctttaatcatccagtgtgatcctccccagtggttggttacataatccattaccagcttcatatttcgtttgttcagttcctgggataactttttatagtcttcattggttccgtagcggccatctattttatagagatcagtttgggcatagccgtgataggaatatactttttcgttatcctcatttacaggcgtaagccacaccgctgtggcacctagattctgaatataatcaaggttgttgataattccctgaagatcccctccatgtctgccattgggtaggcttcggtttgccttttcggtaagttccggttttgaatcattcttttcatcaccattggcaaagcggtccggcatgatcaggtacataaagtcttttgaagtaaaagactcacggttggcagatccgggatttctttgttttaattcataggtgtacgaagcaagattcttcttaccttttttaatattgatgataaacttcggaatgtttatttcattggtatcaaccgtaataaaaacataattgggattatctactttccggatgtctttaatctgtattccatctgaaagccaaatctcgtggttggcgacttcttttccataaacaagaatctgaagttcaggatttttcatccctttccaccagaatgccggctctactctttccagatttttctgggaaaaagctaaagaagcaatcgaaagggcaaatgctgcatatattgtcttcatattagtgttcaatttagcattaaattttcatatacacattcaaaaatatgaaggaaaccttgttttttagtctataatcttataaaatatgaagatgaaataccttcatttcgaatttaataaagaatatttaacttttttacaaaaaattcatatttaaaatcagttttaactgctttttatttttagttttatagaaaaaatgttggatttcagtaatatgttcaaaacggaaggaccggatgttgtctacacatggaccattcctgtgtttgctgctattattttcatagagatggcttacagtcacttcaataaagagaaaatctatgaaactaaagatgtggcaacaaatgtcctttttgccttgcttaattatggattggatatcatcatgaaaggtttttccttatttgttatgatgtttttttaccagcatcgtctttttgactggcaggaaggaatatggtactggatagcagttttcctggctcaggactttgcgtattatgttcatcattatgtagatcatcattccagagttttctgggcggtacatatcacacatcacaattctgactatttcaatatcagcacgggattcagaagtcctgtatttcagccattgtacagatatctgtttttctctccgttagcatttatgggctttcatccgtggcatattctggtagcttattcttccatacagatttatggtacttttgttcatacccaatccattaaaagtatgggatttctggaatatatactcgttactccttctcatcacagggtacatcatgcatgtaatattaaatatctcgaccgcaatatgggaatgggcctgattatctgggataaaatttttgggacatttgaaaaagaagaccctgaagttcctgtaaaatacggcatctatcctaaaatgcagtcaaaagatccggcaactacgctattctatgagtggcgaagaattggaaaagatctcagacagccggggatttcttttaaagatcgtatcaaataccttttttattcaccgggatggagacatgacggaaccggaaaaacggtaaaacagtaccagaaggaatataaagaaaagaaaaaaattcagactccggttcaggtaaaagaactggtatcagaatctgagaagcaatatccccaactcattcaacagacagaggataaataacaaaaataccccggaacattaaaaaatcaatgaaccggggcaccttagtgtatcttaaaaaattattttactggcttaattgaaattgcgaaaccgccgcttcttgccattttaaaattaatttttgatttacctgtaatctcttttttatagatattatagctttgaggattattaatataatcagcatcttttccatcttcatagatcgttgcttcatatttctttcctttatccaggaatgagaagtctacagtgtattcacgtttgttttcatcggtaatacctcccacaaaccagttttcagtacctttcgcttttcttgctgttaccacataatcaccaggttcagcagccaggatttttgtatcatcccaatctgctgccacatccttgataaactggaatgcatccatatgttttttatagttttcaggaaggtctgcagccatctgaagcggcatgtacatggtcacataaagcgccagctgttttaccaatgtagtttttacgaaacggttatctccagggaaataatagtctagttttgtctggaaaattcccggcgtgtaatccatagaacctcccatccatcttgtaaatggaagaactgtctggtgatcaggtttatttcctccgaatgcttcatattccgttccacgggctgcttctgcagagatgtagttcggataggtacggctttcccctgtaggacgtacagattcgtgagaattaaccattattttatattcatttgctttttctgcaattctgtagtaatgattaatggtccattgagaataatgatgttcccctctaggaatgatatctcctacatatcctgtctttacggcatcatatccatattttttcatggtctggaacgctttgtctgcccatctttcatagtttgttgcagaacctgaagtttcgtggtgcataatcagcttaattccttttgaatgcgcatattcattcaacattttgatgtcaaaatccgggtaaggtgtaatgaaatcgaaaacaaattcttttgaatgtccgaaccagtcttcccaaccaatattccaaccttcgatcaacaatccctggaaaccattttctgcagcaaagtcaatatattctttaacttttgtattgttggctgcatgttttccgtttggagtaagctttgtaaaatctgttttacctaaatgtacattttcagcagtagaatatgcccactgagattttccgataatcatttcccaccagacacccatgtattttgtaggatgaatgtaagaggtatcggtatattttgtaggctcattcaggttaaagatcattttggaatccattacctgctctgctttcggcgctacaataattgttctccacggagttactgaaggagtttgaatatatcctttcgctccttgtctgtcggctgttaagtgcgttttgaatttataattctgtgcatctacttcaagatgtgaagccggataatccaatacagcagcttcagcaacgttgatatacaaaggctcttttccttcttttttaagcattaaaggagactgaactgcgtttttcaccaatgactgggaagcatttgcatcgtatgccttgtcccattttgaaggaatctcagatacttttgtttcctgatactgatattcctgagaatcatagtctgccacgatccaccatgctttcatatcggtagggaaatcgatttcagagtcttcttctctgatcacaaaataattaagatttttctgctgcggaaattcataccggaatccaagcccgtcattaaacaatctgaactttaccacaatgcttctgtctgtagaagcctggttcaaggtaacagccagctcgttgtagttattgatataatttttcttttctcctaaaaccggctgccaggtttcatttttggagtctcttttttcatctgtctttgcaaaaccgttattcagatcgtattttgcatcttctggtttggcaatctcagaagcgaactttatagctgtgtctttaaataatctcaatcccaatttagaatcttcaaccactaccgcaccattgtatttcaagttgtagtaaggtactccttctttcagctgaaagttcatttcaaacttcccgtccggagattttaaagattgggcttttacacctgtaaacatcattgagagcaaaagcgctccaactgtaattttcttcataatgactatttattaacttaaaaaatagataaagtactgcggtaaagcagcacattacctatttttattatttcttaattattataatgcttctattttatatgtacctaatttcaggtctaccgaaattttgtaacttcctcctgttccatcaaatttaatgtttccattacttcctttaggagctataaggcctgagtttccgtctccggagatatttccccagtcaagatctccccaactctgttgacccaaaaatttaaattgagaacccgcaggaagcgtaatagtatgttcaaacttacctccgcctaaattggtcatagggatagctccggctgcattccagccgttaattgtacccaccatataaagattagcaggattccagttgttgattgcagaaggaactacatctatagttttcttagcaagatcagaatcgatagtaattttgtacattcctgaagctccggtgaacaaaatattttcaggcgcagcagctgccagattggatgaccatgttttaaaatatttattagcagtctgcattcctgatgtatctaaactataatttaaagggctccaatctttctgtcctaaaaatctgaatgcttttccactttccagatatgtataaattgtagaaatattttcatttttatataacatctgggccgctcctgcattccagcccactgcagatgcttctcctacaatataaaaagaaggatattccgtcaggtaaggagtaatcgtcatcggaattacattagaataagatactacagcatttcctacagagaccttcattcttacttcaatatttgcggcaactccaggaaggaaccctgcatcaagaataattttatttaaatcttttacagtaaaagttctggacagatcacctgcagtcagatctgcacttttggcacccgcaaaacctgttcctgctttagcgaattcgagagcattgctgttaacaacagccagattaaatacaggatttgtccaagtaaattttactgatttatcattttcattagctttaagcaaaaccaatgtagtggcatctcctgctaaagtaggcttttttgtcacctcaagcaccgccttgtcttcatctttttcgcaggaaactaccaaaaatcctaaaacaaaaagcgtaaatattttgaataaatttttcattgtaatcaagttttaaattagtacccaggattctgaatcagattaggattggctacaatatctttggctgggatcgggaaaagatttctatagctttctacggctttcccttctattacatttcctttccacggccataaataatctcctgttgtaaacttgttgaaacggataagatcacttcttctggtcatttcccaggataattctctggctctctcatctaaaatgaaattcagattgatagaagaaacgtttccgcttgtatctccataagcacgttgtctcagctgattaatataaccgattgctgttgcctgattaccaccagcacctcctctcaacacagcttcagcatacatcagataaatatcggctaaacggtataacgggatatcagcttcgacccagttaggatgagccccagcagatccgttacttttaacattcttaaatttgataaaggcataaccatctgtaaatgatcctaaatcattaatttctaaattctgtcctgaggtaaagaatcttcctcttttatcacttccattagctggaaacaacccaacaaatgcttttgtagttcttaaaccactccatccgccattcactccaaagtcagcagctttcatatcacctcctattgcagcgtgaacaagataagttgttcccccattggtttgtgtattaattccgtcaaaatttacgcttaaaatctgctccgggttattgatattattatcagcaaggaacaaatcgtcgtatttaggttttaaagaataccctgctgcaattactttgttacaatatgtaatacagtctgtattcctttgggttcctgtataaacttcagcatttaaatataattttgccaacaatgcccagacagcagctttatctgctctgccatactcatttgttttaggatcttttaattctcctgctacagcaagcaattcagattctatataattaaataatgcttttctttctatcctttgtggcggattgacagatcccggcaagtatgattcatcaacaaaaggaacatttccgaacatatcaatcgcatggtagtatgattgtgctctcaggaaacgcgcttctgctctcatcaattttgcctgagtaagattgtctcctgtaatattattggaagctaatttttcatcggtaacatttcttaagaattcattacaaaaagcaatttctgtatatattctataatacatagccgcaataaactcattggaagcatcccatgtcattttgtgaagcgtatgaaggtttccgtcattccatcctatgactgcttcatccgttgttacgacattcaaagtgtacattaatcttgtatattgagaaaaaccaccgttgatcccattaatatcactatccggctgatcaccgtctccacttacctggccacccatagcaagacctccgtaaagttttgccagaacatttttgtaattggcaaaatctttataaatactggctgaagtaacgtctgtgataggttctctttcaagatctttcacacaagaagttgctgtcaataaaaatactgcagaaagaggcaatactatattttttagtttaattctatttagtttcattgaattcttatttaaaattggaagttaaaacctaaagaataaatcctaggcatttgataataaccgttatctattccaccaaaaacttcaggatctactccagaatatttagtgatcacaaaaacattttgtgccatcgcatatattttcagattacttcctttagaaaaaacttctccgaaattgtatccgacattaatattatccagtctcaggaatgaagcattctcaacgtaaatatctgatttatattgaggaacagaaaattgatattgtggtgctgttgcaaatacgttttgaagatattcatttgtggacgccgactgcagtgaactgttggatgcagcattattatatacatagtttcctaagacagctcttgcacttaatgcaaaatcccagtttttatgagatacttttgtagagaaacctaaaatggcatcaggtgttgtggatttgtaataatacatatcttttgtattaattaccccatctccgtttctgtctacataagctccgtcaactggctttccattggtatcatatacttgttgataaacccagaatgaatttggtgcatatcctacggcatgagcctggatcctgtttcctgaacctccttcaattccacccacttccatattgaatgattcatcagctctgtctttaagcttagtaatcaccggcttgtaatgagtagcattaaaacttacttcccaggttgtattttgatttttaaccggaattacagtaatacttccttcaatcccttcatttttcatatctccaacattttgccagcttgcattacttaaacctcctgcaggttcatcagcatatacaagaaggtctttagtatcttttctgaaaatatctattgatcctgtaattctgtttttattaaatccaaaatctaatcctagatttttagttgttgttgtttcccaagtcaggtttgggttataattagcaggtctgaacataaaatagaattcatttccaaactgataccctgctccctgatagctggggttataagctgcaaacgccggatagttattaggtttattaccgttcaaagctggcaattcctgctgacctgtttttccccatcctgctcttaattttaaagtactgatagcagatatgtttttaatgaaactttcttcattaagtttccatgctaatgaaaccccagggaaaactccccatacattatctctggttccattaaagaatcttgaagaaccatctttacgaactgatcctgaaataacatatttattagctattgtaaaaatagctcttccatagaaagagatcaatgtattttgagttttgaagtctaaatcctgcgagttaattcctgttcctctataagtgatagctcctggaagataaatattgaaatcctgataagaatatcctgcagtaatatctacaccagtattaatggcactgatatttttcacataattaaagtaggtctccaaaagcttgtttttcttttccatagaatagaaatttgagcttcctttatcttcaaaacctggtctcagacgggcatctttaaatttatgtccatcactttttgtataatcatatccggcatttacattgaaatgaaggtccggaaggaagtgaaacttataatctaattgaatatttcccaatcctctcaatacagaagagacatctcttaccccattgatcatcccaagagggtttgaattggcatttacattataacctgttgcagatcctgagtccagccattcataataccctccataattagagtttcctgaatatacaggttgtgtaggatcaaaataagtagccgccttaatcactccaccatctacaaatctattatctgtaaatgttccttttgcgtttacatttactgataaatgattatcaaagaatttagggtttaagttcaaccctaccgaggttctgcggaaagaatttgattttacaataccgttctgctcattatatcctaatgataaacgatatggcagacctttaatacctcccgaaagcgcaacgttattatctgtaccccatgctgcctgataaatctgatcctgccagtcggtatcagcatttcctaacttagttttataaccagcaggagcatatgtattaacaaaatctctaaactcctgagcatttaatacatcaacctttcccattttagtagaaaccgaagtcaccgttgaaaaattcactttgaactttcctgccgttcctttcttggttgtaatgagaataaccccattggaagctctgttaccatagatagcagtagcagatgcatctttaaggatatcaaatgtttcaatatcgttcgggttaattaatgatagagggtctgacaccccattcattcccacaaagtcctgaggaactccatcaattactatcaaaggtgaattctctccacttaaagaagaagttcccctgattctgatttttgtacccgatccaggtgccccactgttattggtaatctgtacacctggtgttttaccctggatcagctgacccgctgacgtagctcccccgttgaagtctttagccgttacagaggttatagagccggtaaggtcagattttttctgctttccgtacccaatcagtacaacctcatcgatctttttctcctgaggaacagagtcctttttctgcgcatgcattactgtactggccagtaaaaaagcgggcgcgatttttaatactgttgtaaaattcttcacaatcttatttttttatagtttcgttttttaagtcttattttagcctaaagccagactcgcaatttaaaaaaaaattagaattattataaatttaatataattttagttaaaattatgtatattacgaaacccattttagttagttttttaagatacaatattttacaacgtcttatgctttacataatatttatttcaatttaagaaaatgttaaacaattgtttaactttattttgagtttgagccttaaaattcgcattctgcatcataataacaccaccaatagcggtattcaacagatattccttatctttgcagtcaaaactttactataaatgtcaaacagaaagatgattacggcagctttgccttatgcaaacgggccggttcatataggacatttggcaggtgtttatattcctgcggatgtttacgcaagatttcagagaagattaggaaaagatgtagcgtttatctgtggttcagatgagcacgggattcctattaccataagagccaaaaaagaaggggtaacccctcaggatatcgttgacaaatatcacgggatcattaaaaaatctttttctgacctgggaatttcatttgatgaatattcaagaacaacttctaaaaagcattatgaaaccagtcaggatttcttcaaggttttatatgaaaaaggaaaattcactgaagaagtttctgaacagtattttgatgagcaggcaggagaatttcttgctgaccgttatattgtaggaacttgtcctaattgcggtaatgaaaacgcttacggagaccagtgtgagaaatgcggtactaccctttctccttctgagctgatcaatccgaaatcaatgcttagtggaaatgttcctatccttaaagaaacgaaaaactggtatctgccattaaatgaatatgaagatttcttaaacgaatggatcattgaaggccataaagatgactggaaacctaacgtatacggacaggttaaatcatggctgaatgatggtcttaagcctcgtgccatgaccagagacctgaactggggtgttccggttcctcttccgaatgctgaaggaaaagtattatatgtatggtttgatgctcctatcgggtatatttccttcaccaaagaatgggcagagaaaaacggaaaagactggaaagattactggcagagtgaagacagcgatctggtacactttatcggaaaggataatattgtattccactgtattattttcccttcaatgatgaaggcacacggtgattacatcatgccggctaatgttcctgcttttgaattcctgaaccttgagaatgataaaatctcaacgtcaagaaactgggcagtatgggctcatgaatatgtggaagatttcccagggcaacaggatgttttaagatatgcacttctttcatctgctccggaaacaaaggataataactttacctggaaagatttccagactaagaataattctgaattggtagggatcttcggaaacttcatcaacagagtagctgttcttattcataaatattatgatggtgttgttccgcaaggtaatgtaaacagccctgaattgcaggaaataagtaaatcggcaaaagaaattgcaggattccttgaaaattatgagtttagaaattcattaactgcattaatgaaccttgcccgttttggaaaccagtatcttcagactgaagaaccttggaaaacgatcaaagataatccggaaaaagcggctcaatctttattcgttggagctcaaatagctgttgcattagctcagttatgtgaaccttttatgcctttcagttccgaaaagctattgaatatgttcaatgttgagaagaaagactggaatattattgaaaaccaatcagtattaattgaaacaggtcacaaaatcaacgaatcatcgcttcttttctcaaaaattgaagacgacgtaatcgaagctcagatccaaaagctggaagacacaaaacaaaacaataaaaaaacaaaccctaacgcaaacccaatgaaagaggagatcacgtttgatgactttactaaaatagatcttagaacagcaaccattattgaagctgaaaaagtagaaaaagcagataaattactgaaacttactgtagatacaggagtagatgtaagaactgttgtttccgggattgcggaaagcttcacacctgaagaggtgatcgggaagcaggtaatgatccttctgaatcttgctccaagaaaaatcagaggaattgagtctcagggaatgttattattgacaacaaaaccagacggaaaattatctttcgtaacaccggatgacagcaatgttgaaaacggtattgagatcggataattagaatccttataaagataacaggctgtttcactagaagcagccttttttttaaataatacttatggtcaataaaagtgttttaagaaagctttccaaccaggaattagaaggatatctaaaggagggcaaccgctttgtaccggaagctgttcagatagcttttgaaattctggaagaaagaggacgtgttttcaatgagcaggaaaaaactgccatacaacaattaattcagtgtaaaaaagaacaagaggagacaaaacatacagaagagtttgaaatctggaaagatcatattacagaagatccggatgctatcaggctttattcacgaatgactatttttgtcagcagtgttctcttcagtacaattcccggtgctattctgctcgcgcttaatttaatcaaactcaaaaaatactttcatgcgtttctttcggtggtatttggcttccttttttttatatttcagaagtacgttctggtttctcattttaattttggtacaacttcccgatacagtcccgaaattggggtcatagcagcaggagctttgagcttacttatcatcagtgttttagcaactccgaaaaagcttccttaccgcgcggaatcttatattttccctatgattttatgtgccggaactgctgttctgatctatttttattttcaggagtggttttcattttatccgctggcaagggttatcaatatattcagacaataataaggagctgattcccgctatccacttttactcctcgcccctggcaaagagccaactgcatgctgtggggtaaccgtttctatcgcggctggaaatagtacaaaaagaccatttataaattcatgagattgcttcgctttcagctcgcaatgacttgttttcgtagttatttcttggtcagctttgccaggtaagcatcttcatccctcaaaactctttctattttaaaaccattatttgtggcagcattcttcaaagtattaaagtcaagatacagccaggtaatcggttcttcagattctcctttataatgaaccacataatccagttcgccataatatccgcctgcaggaatgtatactccaccatccttatcacgatcgaacatataaagaatatctgtactgtcgatcaggatctgtcctttatcattcaataaggtatgcagcttctgaagataggtatcaatttttgctaggctttcaaaaaccccggtgccgttcatcagcaataaaatagtatcaaatttctccccggaaaaatcaagcatattttcacaaaccgcttttttaattcccctcaacttacaaacctcaacagatttgggtgaaatatccaatgcagtcacatcaagatttttttcattctgaaggtataacgaatgagaaccagcccctgcaccgatatccagaacctttccttcggataaatgcagtgctttctgctctatatcattcatttcttcaaaatctctgaataagtaattcaccggaagctcatccagctcggaaattgacgtttcagtctgcagatcttcaggattttcattatgataataatcccagatcgctctgcccattaaatctttcatacgtgcaaagataggtcttcgggatgcaaagttcaaagtttgtgattcaggtttttgagttacgagttcttattgtttttcattaaagcggttgggtgtcattattataacgcaatagatcgcaatttttttttgagatcgcgtactttttaatttcgcgaaggcgtttcactcagcaatgaaacagtaaatatcttagctaaatgaaatgcctttgtgaacgaaattactttcagatcggattaaaaaactttgcggtccaagcgttaaaagaattttcatgatagcatttgggcacattattataacgcattaaaagaattttcatgatagcatttgggcacattattataacgcaatagatcgcaatttcttttgagaccgcgcactctttaagttcgctaaggtgtttcactcagcaatgaaagtaaatatcttaactaaatgaaatgcctttgtgaacgaaattactttcagatcggattaaaaaactttgcggtccaagcgttaaaagaattttcatgatagcatttgggcacattattataacgcaatagatcgcaatttcttttgagaccgcgcactctttaagttcgctaaggtgtttcactcagcaatgaaagtaaatatcttagctaaatgaaatgcctttgtgaacgaaattattttcaggtcggcttaaaaaactttgcggtccaagcgttaaaagaattttcatgatagcatttgggcacattattataacgcaatagatcgcaatttcttttgagaccgtgcactctttaagttcgctaaggtgtttcactcagcaatgaaacagtaaatatcttagctaaatgaaatgcctttgccagcgaaattactttcaggttggattaaaaaactttgcggtccgggcgttaaaagaaatttacgctatgtcattgactactgactatttgaaatttattcataacttattttttaattaaaatcctgtttccgatcaagcccagaaacaggatttgaaatataatatgctttcagatcagggtattttaaatcctgatcatttcttaaaactcaaaagtataagacaggttgaatgttcttcctcttcccttataattaaacagttccggaagtccgtaagtggcatataaaacctgggaacgcttgctccagatcgtctgataatcggtattaaacaggttctgaattcctaagttgaattttccccagttgaaatggtatcccaccatcaggtctgaagtattatagccttccaccacattattcagctcgtctttctgcttgaaattctgcagagactgaaatctgaatgaccagttttgaatgttatacccgatataggttaccagttttgaaggggaagcattgtaaatctcctgcttctgccattctcctttgttgtctacttcagatttgatcaaaagtccgctggccccaaaatacactccattacttaaagaataagaaacctcagcttcaattcccatattccttaatttcaaatcattcacaagaatctggaatgtctttttatctacagctactgttttgtcagaattactcaaaaatccggcaatctgagctcttagaccgcctctgttgacacgatatcctacctcaaactgattcgttttgattgcctgtaaaggctgttctttcacattgatactggatacgacatcccagtttgttcctacaagtttatactgaccgattccgtaaaacttggcgggatctgctaaacttgctccttgggaaaaggttccccaaacctgatgctgctcattaaatttgtataacaatccggcattggccaatgttacattataagaactttcaccaccaggaattacagatgctgaacttccatagcccatggcaacctgcgtttgctgttctgaaccaacaaaatcgtccatttttacgttgatatgctgataacggattcctgcattcaactgcagttttggaagaatgttatattttgcctgaacatatcctgcgtaactttgtgaatggttggttgggtacctgccaaggctgtattttgtttcattgattaaacctccgctggacattgtctttgcaatgtcataaacagattgagttccttcaaatttttcaaaatcaaaatctgctccatacgtaacgttcagtccgcgccatgattttgataataaagctttaatcccggaataataagtatcctgctgggatgaggacatgtatggtattttacctgtctgtaaagtaacatttcccgggaatggataaaatcctaatttttcgccgcgggttgccagctgtacatataggtcctgtccgcctaaaataccatttccgttatatgctacggttgccatataacgttctgttcctacatttttatcggatgagaagccatctctcatttccagtaaagaaggattttttgtagtaaaggcacttaagttttcacctaaatataaacttctgtctccattaaatttagaattgtaatactgaacagaggctgttattttatgtttattgttaaactggtaaccacctgttgccaggatatcaaccgactggttatactgaaggtctgtctgggtaatatcggtaaaaagctgtttctgatctgcaccatacactccaccattctgctgataagcaactcccagtcttccgaagaacttatctcctttggctgcaatagactgagcggcacggaaatcgtggtcatctttcccaataaatcctgtacgcactcccagttctgtctctccgctgatcccttttttggaaggtgtttttgtgataatattgatgattccgccggtagcattacctccataaattgaacttgctcctgaaagcacttcaattctttcaatattaaaaggatcaatagcatccagctgacggcttatggcacggatactgttcagagaaactccatcaatcattaccagtgcagagcgccctctcatattctgtccgtaattggttcttccttgtggaccgatgtccatagaaggaatcaggattgacaacatttctttgataggaactccgcttttcgcctgctcccggatcttttctttctgtactacccaaaccgttcccggaacttcagagatttttgtaggttttctggaggctacgatcaccacatcttcaatacctttagaggcaatagaatctttaacggtctgggaaagcatcactcccgaaactaaaagacctatgaacgcatactgctttttcattctttctattcaacgttttataatgccgcaaatataattcttatttagaaagaataaaaataacaaaatatgaaattttcccatattttatgatggtaaacatcttcttacagaaaaattaagcttaaggcgaagcccctcttaacactctaaataccttactacaatcctaatgtttcaaaaaagtttaaaatttgacatcttcttaaaagcgtaaaatcccagcccaacgaaggaccaggattttactgtgaaaaacaaggttatcttttatactgcagggccagctgcatcttttatttcttccaataatttttttctttcacgaagtctccttcttgcaataacagacttaccgccaagaactcttacaaatctgaaatactggaaacgttttgcgccaaaatgatgggtagcaacataaatcaaaactccaaatcctaccaaaataatataaccgaatatctttttggtagctatgataatagcattaagctgaatggctttcatattggcggctacattctgaggagtaaccgtcattccgtccatataaacagcaagatctcctattgcggttacctgaaaacggtactgaaaccaagagtacagggttgaaaagattcctacagcaaggaaagttctccagaccaatacaagcccgatggctgccagcatttcatccatttcaagcttatccagcgtataaaaccatacggaaataaacagtgaacacattccgtagccttttaagaacatcggcaggtaccagttgtcataactgaactccagcaccatagaaaaatacatgataatagcatatccaaccatagctgcgaaaccggaaaaaatatacattttcaatggtttttcttttttgaaccagaaaattgccagaactccggccaggataattccgggaatcatcaataaactcagcctggtattggttaattgatcataccccaatacgcctaccgcaaaagtattctgaatagaagcagttcctaaaaacattcccagccaaaaaagcataaataatccgtgctgcacattattctttgtaaaaattttgaatgaaaggtatggccgttttaaggttagctgacagatggaaagaagtgcaaaacttacaaaagcagctatacttgcattcataatattcttcgaattgaaccaatcctgctgtcttccaaatgaataaacataagccgaaaacataaaagttgaaatgaaaagcaaaatacttaaccaatcgatataatgaaggggaacttttaacgcaaaatatttgttatgcataaaaatccagtgtatcaaagctaaaataaaacataaaactgccgtgaacaggtaaaactgctgccagttataaagaagagcgaactctgcagcatagtacgtagccacttgattcatgacaagtacaaatgtgtagaaagcgccataaaatacaccgcggttcccaatcatcaccattaatggcagaaacagctctatggtgaccatcatcttcataaagcctatcattaaagaagtaaatatgaagatcataggttgtaaggtagtcccgttcacataactgagcagtcctaaaagcaccagaagcaaaaccatcttgtctcttaccttgaatctcattttgattctgagaacaacaggcatacaggctcccatccctatggttgtagcgtagtttgcccacataaaatattctgtcatggcaccggtaccgcttaccagagaactgatattcccggtatatactccaccaataggcattaccacggcaagcagcaatacaatcagcagaagctgtacgggtttcggcacccagtcactatataatcctttgttgtacatgatgaatttagaagttagaggttagaaactagaagttagtaactgaaagctttcagcttaacttctgtattttctaatcttttaatctttcaatgattaaatcttttaattactgaccgatattcacattcatattcattccggcgctcagtttatccagatcttcttttttattggaagctgtaaactctattcttacaggtattctctgctgtactttaataaagtttccggtagaattatctgtaggcacacttgaatatcgtgaaccggtagcagcagaaacagctgttactaagccttcgaatttttttccgcctaaagcatctgctgtcatggaaattttctcaccgattttgatattcggcatctggctttccaggaagttggctgttacccatttctgtccattcagaacgattgttgccacctgttgcccaggttggattaattgtccttcagaaatcgttctcctacccattactccatcataaggtgcggtaatcacagtatatgaaagattaattttcgccatatccagagctgatttcgttcttttaatctccgcatcattaattccaagcctgcttttcacttcagtagtagaaagattggcagattgtttttgattgactaaagtctcataagcagctttttgtgcatcatattctgtttttacctgatcatactgctgtctggtaacagcttcagcagccagaaggtttttatatcggtttagattctgttctgcattccataatcttgcttttgcccctgcaatattagactgcatgacgttgatattgttggaaaccgtattgacagaagagcttgttgctgttttttgagccatcgcattctgataagctgcttctgcctgtcccagttgcgtaagaatttcacggtcatccagtatcaccagtgtatctcctttttttacatgctgatgttcaatgaacttaatttctttgatgtaggccgaaacccttgtattgataggattaataaattcctctacctgcgccgcttccgtataagttttgtttccgatatggaaatattcacgaattaaccagaatagtccgaaaccgatcaccagaaaaacgatgatattggaaatgatggctctgattttattggttttatttttcttttttttattctccgcaggagttggtgtagtattttgagtagtttgttccttgttttccattgtgttgattttcagttttaaattaaagtgttcctgtagatttcaaaagattgtaatactgatacagtacattgatttctgcattggcataatcaagctccgactgcagtttctggttctgggcatcaatcatttctgcctgtacagccagctgattcagatatttggcttctgtaatcttgtagttttcttccgccagtcttttagcatcattcaggatatcggcctgctgtatcgcttcctggtatttggtataagctgcattcactcccatatccacattctgctgtaccagagtcattgcatcattcgcctggttcttttgcagctcacctaattttactttttctttcgttttatacagtgcatctatattgtagcttaaagaagctccggtctgccagcctcccgaatacatatccagaacaggatttctagttgtgatcggtctttgcagtgtatatcctccaaatcctgcaacggtaggggcattatccgttttgataatctcgatattcttatctgctaccgcaatatttttttgagccgatttcagcaaagggttactgtcatgggcaaggttcatataataatccatgcctattccggattctttgttctctaagttttctgtgggaacgatttctgtgtctgaaggcagtcccaaagcaatatttaaattgtaattaaggactttcttattgttagaaagggtcagaatcccctgatcaagatttttgatggccagttctccacggattacttcgtttctggtcaccatgccctgctgatagaatttctggatatttttaagacgctcctgagccagttttttattattctgaaacacttcttcctggttccggattttataaacatccagataatttgaaattaccagaaatttaacatcctgtttgtttttttccagatcaagttcggaaagctgctcacgaagtcctgccatttcaatagacttattcaccaagcctcctttgaagatcagctgtgttgcctgaactgcataagaacttccataatgcggcatcggaacgtttgtagaattcgaaaagtccttatcaatggctactgcatcccctaagtagaactgacttgtagaagctgtaattgacggcagtttctgaagttttgcaacattggtgttctgtttggcaatatcaatgttttgtgcggaaactttgagctgctgatgattctgaacagcaagttccgctacctcacctgcggtcatctgtttaatctgttgtgaaaaaaacagcgcaggaaaagctgctatcaagattgatagtgctgtttttattttctttgtcattttaccttgttttacagatgcaaagttaggtcaacaacaaaatcaatcaaatgtttgatttttggaaaaagatgttcaaatgtaagattttaattttcgaactgatgcctgtactgtgtaggacttacttccagatgcttcttaaaaaagtgagaaaatgagtattgatcactgaatccaaggatagatgaaatctccgaaaccggtttattggaagagtttaagagaactttagcttcattaatgacaattaaagcaatgatctgactggcagatttacctgtaatggtctttaccacagaagaaagatgtctggttgtaattgactgcctttcggcatagaactcaacagttctttctgtaagatgatgctcagcaagatcagtaagaaatacaaatacaatttcttcctgtctggacatctgattcatagaactgttgtcttctttggagatgattcctgccatctgatagcagaaaacagagaaaagatgttctaccatctctttcttatagagcatatcggtatcagaatccaggatatacttcaggaaattaacacttttccagactacttccatttcgtcttcaggaaaaggaactcctttattcatctgctgtctgaaataccgataagtaatcaggcggttaaactttaatgataatgctgaaatgaattctcttttataagaaaccatccttgactgaaaatcgcccgtcactcctaccacttcataaatggtttggggatcggttaccataaacatattggcagaaacttccagatcactgaaatgctgacggagttttatggttccggatttaataaagataaaagcaggattatcggggcgaaaaggcttaccaacggctattcgctcgaaaatattacgttccgtaaaaatatcaactccgaacttttctaaggcagacataggacaaatgtaagcaatcttaccagtgattacaaaattttattattttagcatcaatccaattttctgtcagtatgagaaaggttgatctattatttgccgaatacagtaaaagccatagaaaccctacaaacaagttcattcactggatttgtgtacctctgattttctggacgattctgggatttacctccctgattcccgcaccccatttctgtactccttatttcggatgtatcagtattgtaagccttatagtgattcttctgattactttattttatatcaggctttcttttaagatcacggtagtaatgcttgctgtaatgcttgttatggagcatttcatttatcttaccaacataagtattgaaaagcaatcctggatagtttatctgtctgtattcatcattacctggattttccaatggataggtcacaaaattgaagggcaaaaaccttcttttctcaaagaccttcagtttctgctgataggaccgatctggcttttaggatttattttcaaaaaaacaggaatcagatattaatcttccaaagcataaaccgcaaaactggccagccaatggtctcctccgtaattcccctggaaaagcagcggcaaaccgttagccaggaatacatctgctttctccctgaaactttttttcagcggatgattggcaggaagggcatttgaaattcctttcatacaccatgctttggaaaaggacaatcccaccaggtgaaccgtctgataatcgctcaaatcactaacaacaggaattttttcaatattctccagacttcttttttcgtagaaagcattcagccactgtacaaattctttttgagggagtactctccacatcagatctgcaatctcaagacttggagaaaagaaatctgaaccgtccggttccagataagcaggtgttttctgatcttttaagaaaaagtatttcgctttttccaccagctgattttcgaattctttatctttattggctcttgcccaatctatagcaaaagccatagcaaatgcagtattcggatgaactccggttctgttgggataggtttgttttggaagatacgttttccaggatttaaggatctgatctgttaatggtttcagattctgatgccatattttagctttcggatgatcccagttggtgagttcttcatccagttttaatatccatgcccagccgtaagttctctcaaaagtccctgtcagctgatattttgtaaaatagtctgcctctgtctgcagtttatctttctgaaatgattcatccagaattttttcaatctcctgagcattggaaagattgggttttgttttcaaaagtcttgtcagcatccagtgtccgtgaacggagctatgccagtcgaaacatccataaaagctgggatggagatctttaggtgtcaaagaaacttcacctgcattattgataatatgtgccgttttattaggatattcctgattgatgcagtgaagaggtttatcggaaagcttcattgccatttcgtctgtgagtttcggagcctcctgggcatacatcagaaatggagaaaacacaaatgctaaaagactttttttcatgaattaaaaatagaaataatttacagtttcagcaatttttccaatcggttttgaaagcttttattctgaattccggccaatatgcaatatgaaacaatttttaagcacaatttttgatgatatcatcagaaactaagtctatgaaaaacattattcttcttttatccggcattctgcttatcaactgcagtaaatccggcaatgatacatatgaagcgaaagctgatttgatggaagttgtccctgaagagaaaattacagcattatcttctccggcccctgttatttctgagaaaacagtatccgataaaaatgaatccggcacagaaagctatacccacaagaaaaccgatacgatttccaaaaaaattatcaaaaacggagatatgaagattcaggtgggtgatattaaaaaagcgcaaaatcaggtcaatgaaatcatcagaaaaaataatgcctatatccagaaagaagaattccagaatacggatatggatgataatcttacgatgactatccgtgtgcctcataaaaattttgatgcccttatcaattcattttcagatggcgttggatctgttttgtctaaaaatgtttcatctgatgatgtgaccgaggaatataccgatgtagccataaagctggccaacaaaaatatatatcttgaaaaatatcgggatatgcttaaaaaggcttccacaacgaaagatatgctggaaatacaggaaaaaatccgggaactggaagatgaaattgacatcgctgaaggcaggcttcgttttattgatgacagggtgaattatagcaccctgaatttaaatctgtataaagaaaaggtgagaagttcagccacctctaaaattggctttggaagccggtttattgattcactgaccgaaggctggaacagttttgtaagcttcctgctgggaatggtttcactatggcctttctttctgaccattcctgtcatagttttcttttggagaaaatggaagtcaaagaaaaagagtcaaaattaatttattaaaaatccgggcatctaagatgtccggatttttactgcattgtcaataatttattctgtttccagtgtttgattaaaaatcaagaataatgcaataaacaggttaagaattgttaaatctttttgagcaaaaagggtaagaaataattgctattttaccttaaatattatttccccagcacaaatactgcagggattttatgaagttccggcttttgcttctgccagtctttgattgattttgttttaatgaattcatgttccgggtcattaatattggcagcaatacacagtttggaattcggtgacaaaaatttacacaaatcttcaaaaagctgattgttccggtaaggagtttccatgaaaatctgtgaatatcctgttttctggacaagactttccagatgcaggatctgtttctttttttctcctttatcaataggaagatagccatggaaagtgaactcctgcccgttgaatccactggaaatcagcgccagaataatagatgacggccctgaaacaggaatcaccctgatatttttctcatgacaccatttaacgatcaggtttccgggatcagcaatacaaggcaagccggcttctgataacaatccgaagtcctgccctttcagcatcagctcctgagcttctttaatatctgcattctctgtgtatttatctagcagaaataacttcagatcggcctgctttttttcgggagcaaaaaatttaacaacctttctcgctgttttttcattttccacaaagaaataatccgtttgcatgatataatccttcaaaacaggtgaaaagtggttgatagaagtattttctgataagtaagcaggaagtaagaaaagcattgtattattttttagttctttcgtttaatgagggttgtgggaaatattttgtaagatccatagagaagttaacagaggtaattttccaggttccgttgatcttcatcagtgtccagatttcttttccccagttttccattttaccgtcgtaccaaaagctgtaatcaaaattggcagaggcaattgatccgtcttctatgatcttaatattgtcaaatttttcttcagatttatcatctttaaagcttttgataaaagctttataatcatcggcaaagtagtaatccgctttagggtttttctcaagacgtttagcctgtgtcctgtctttgtagatgccggtccagagtacgggttcctgaaacaaagaaagatatttggcttcatcacgggacttaatgcatcccataaagtcatccattactttacggatctctgtttcatctttagtttgggcaaaacagaaattaaagcttactaaaagcagcagcaataattttttcatggttattattttagtatttggtttttaatggcatcacatcccttatccagaagctggaagacattttcgaaatctttcatatctccccaatacggatccggaacctcagcattttcatgatctcccaatacttctaaaaacaatgctactttcttgcgttcttcttcgtttttggttttagaaaccacatcttcaaatacatcaatatccatacagtagattttatcaaatgtttcaaaatctcttcgggtgataggtcttgatttctgttttgagatatcaatattatggttggcagcagttttaacagctcttttatccggatgttctccttcgtgcaatgaaatggttcctgctgagtctaccacaaagttttccggcacttttgttttcatgattccttctgccagaggacttctgcatatatttcccagacaaaccattaatattttcataggtcagtaattataaaaaagacttttaacaacaaaactaaataaaaaatgaagaatacaacgatccttcattttaattattttaaagctcagcgcttatttactgtttgattctttcagtaagatcttttacgtatttcttgatttctttatcaattttcgatacatctttgatggtatcacaagcatacattactgttgagtgatcttttcctcccatttcttcaccgattttagtaaatgtcgaattggtgaattcttttgagaaatacatcgcaagctgtcttggcaatgcgatctctctttttcttgtttttgaaagcagctgctcttttttgattccgaaataatcacaaaccacttcctggatgtaaggaatattgatgacttttttctggttggcagcaattctgttaatggtttctttcagcaattcaagactaaggtctctcttatatactgtagagtaagcgatcactgagttaattactcctatcagttctcttacattggttttggcttcggcagcaaggaagtccagcatatctcccggaagaacaattccatctctgcttagtttatcttcaatgatctgtcttcttgtagaaaggtccggcgatttgatttctgcagaaagtccccatttgaaacgggaaacaattctgtcctggatatccataatgtctgcaggcgccttatctgaagtaaggataatctgctttccgttctgatgcaggtgatcaaaaatatggaagaagctgtcctgcgtagctgattttcctgataagaactggatatcatcaataatcagtacatctaccatctgatagaaattcgcaaattcagtctgtttgtgtgctttggcagcagagataaactgctggataaacttttcagatgataaataaagtacaactttatcagggaactgattttttacttcaagaccaacagcctgtcccaggtgtgtttttccaactccataacctccatataggaataatgggttaaatgctgttgctccaggtctttttgcaatcgatctggctacagttgctgcaaatttattgctttctccttctacataactatcgaatgaatagtcaggtttcaggttagaatctatgtttacttttcttattccaggaaccacaaatgggtttacaatattggcagagaatccctgcggcattgtttcctgtgttttcggagtaggaacgctctgtcctttgatgttcatggtaaccggcttttcttcgccttttggtctgttttccatcacagaataccataatttcactccttttccaatatttttcttcagggcagcagaaagtagggacaggtaattatcctctatatattccttgtaaaaatcgctcggtacgatcaacgtaaggttattggccaccaacgaaagcggctgaaccttatcgaatagcatatcgaaagatttttcaagttttttaaggtcagaattgtcttcagcagcgttcaggttatcgcgcataaactgaaggcatttctgccaaatcatcattaaattgtcatccattttttaagccccgattattctttgtttgtactgtgtttagaaggaagacaaaggtctaattttttcttttcaaaaaaaaatattgcaggtattgattatttaaaaatatatttgtatgtataatttaacacctaaaatgatacacacaacacactcaatacgagtacgttacgcagagacagacccgatgaaatacgtatactacggaaactatgcaacgtacttcgaagtggcgagagttgagctcttcagaagcataggaatctcatacaatgaaattgaaaaccaaggaatttggcttcccgtttcggactacaaaattaagtatatccgaccagctttgtatgatcagaaattagaaattcacacctatgtcaaaaaaattccgggagtgagaattgaatttgaatatgagatttacaatgaagagcatattaaaataacagaagcgtccactactctattctttctggatgcaaaaaccaataaggtaatcaaatgcccggactttctgatggagcttattaagaaaaactggaaagaaaattaactgcggtttttagtttgagagtggcagggtttgaagatttgagagtttaaggcttaaggtcctgaattaatgtaaaaggtaaccagcaacaaagacgattcgcaattcataacaaaagaaccccgtaatacacactctatttatgaattaattcgcacctttgtatctctatttactatcccttatattatacactatgaagattgcttttttgggacctcatgccagttttacacagcttgccgctgctcagctttttcctgatgacgaattgttgccacaagccagcattctggattgtttcaatgccgttgaaaacggagaagccgtaaaggcagtagtgccattggaaaactctattgaaggaaccgtatctatgacgctggattatttatataagaccccgtctattaaaatcgaagcagaagcagtaatgccgattgcccatcatctgatgattcatccggaaaattccattgagaatatcgaaagaatatattcgcacccacaagccctggcacagagctttcattttctggatactcattataaggaaattcctaaacaggacttttcatctaccgcagcagcggctaaatttgtttctgaaaatccggacactcctattgcggcagttgccaatcagtttgccgctaatttgtatggtttgaaaattatcaaccgtaatattcaggattttgaacagaatcatacccggttcatcattatttccaaacagcaaaacaaatatcagaatgatcaactggaaactttgggcgaaaaatccggcatgctgattactcttccggaggatcaccccggcgggcttcatcaggttttatccgtgtttgcgtggagaaaaatgaacctaagcaaaattgaatccagaacgttaaagacaggtttaggaaattatttcttctttatcaatgttgaaggcccctggcaggaagttttacatgggaacgcactgcaggagcttgaatcaatcaatgccaacgttgattttcttggaaattacaaagaatttcttctggaaagctagaaaaaacaccataaataggattaaaaacactgtcattcgggcagtgtttttttgttatttggtactaaaaacacaaaaaattaaaaaaatttcacaataaatcaccacactgaccagttgttccggaccacacaaaaataacccacacattggggagaattatattttgttaaaaccctaataaacaatgcattaattcaaaaataaatataataagtcgtaattaaattatgtggtaattttaactaaaaaataaacatatgtttaaatatattacaactttttaatgttaaaattatagatttcacaatgtcgggtataatttttattgtatatttgcttagcaactaattaaaaaatcttgatcatgaaaactaaactttacagcttactgttagcatgcgcaactttacctttattctctcaagtaggtattaatacggaaaaccccagtgcaactttagacataaacggaaatgcaaagatccgtactactccagcggctcctgcattaaccgggtatcaggtacttggtatcaataatgccaattcagaagtatcttcgattgatcctcttttgatctatgcggctgccaacaccaacacctcagtatatgcggcaaagaaaacagcaggaatcagccttttaagccttggactttttccttcgggattcagagctgtgaacttcctagcagcagaaagaaccataggatctgccagcttattcagtgacacagataatacgtataccattccatccacaggtgtatatgctgtaggcttcacattccgttatggaacaggtctccaggcttctttgttagccaataacccgggaattggtatcgtaagaacccgagctggtgtagccactacgatagacagccgtccgttcagtggggctaacctgattttattaagtcttacgatttcagaaagtactcttagctcagtttattccttccaggcaggagacaaagtttcatttggacttgtcggatcaacagcattagacgtaggcttattaggatccagtgttgcttctttctacatctacaagatatctaattagtaaaaacatattgttagttatatacggttgatccatcacatttctgtgatggattaatttttggttatatttgataaaaactatgaaatgaatgaatatctccttattatattaatcattatcgttgttcttattttcaataatctgaataccagaatcagaaaactggaaaaggagatctcagatcttaattataaaatcggcaataaacctgccggacctgaagttacgccagagaaaactccatctgaagaaacgatcatttcacagacaatatcacctcaacaggtttatcgtgaggacacaaaacatactgaagaacctacaactcctcccggaaaagactggctggctcccatttttgattttctgaaacagaatgcacttaccataattggtattttcaccctagttctgggaattggttattttgtaaaatatgcaattgacaaaaactggatcggtgaagctgcaagagctggcataggtttttgtaccggagcaggcatcatcatgaccggacatttcctccgaaaaaattacaaagccttttcctctattattacaggaggcggaattgctgttttatatttcactgccacaattgccttcagggaatatcatctttttagtcaaaatacaacttttgccataactgtcctgattacagttgcctctatcattttatcatattattataaaagcgaggtgctgattattttttctcttataggaggttttgcagctcccttaatgatcagtacgggacaaagcaattacctgttcctctttatttatctcacgctattaaacaccggaatgctggtagcctccttccttcagcattggaaaagcgtgggctggacagcttatattttcacaaccggttatcttttctcctggaccaatgaaagtcccgagatcttaagcattactttttatctgatcagttatgtggtattctatattttcgcactgcatgattacttcagaaaaaaaatcctttcaacctctgatattgccattcttgcgcttgctaatttttcaagtgttctgggactgatctatatttttaagacccttgggtatgaacctcctattattttcccgcttatttttgctgcagccaattctatcctgctgtttagagaatatgcacataagaatttcgggattgcttattccgtctttgcaggactggtgacaagccttataacaattgctgttgccattcagtttaaaacccacctcattaccagtatctgggcaatagaaagcaccctgcttcttttcatctggaaaaaaaccggccataagattttcaaagtcttcttttacatcctgtttccattggtaatgattgcccagctgatcacatggactgaatattttggaacaaaagattttaccatcatattcaatcctccgtttattaccagctcatttactatcgtttctataatgatcaatttgtatttattaaggaatgggacaaaagagccggagggcaaagacaataacttttttgaagatcttatcactgtaatcagctatggtgctatttatattacgttcctgcttgagattacctatcatatttcagaaatgcattggtcagcagtttctactgcagggctgttattcagtatcttctatatttttgtattactgcttttaagaaaatctctggatatcagaaatgacattcagaatattctgatctacctgctccttttattaacagttctcactatttctgtatccactccggcagtagttacagctgttttatcaaaaaaactgtatagcggtttctatctgctgcatctgctgctatggataccttttatatatgtatacagcaaaattattccttactcggagtttcacaaacgtctgatttcctactggatactttcctttgctctcattgtattggtaagctgcgagctgcatcattcgtatgttttgctggtttcaaatgacattcctcaatcttatgaagcgaataaacattttaatattctttatcttccaatcatatggacgatccttgccagtatttttatttatacaggtttaaaaaggaatatccaggagtataacaaaattggttttgcgctggtgggtctgatggtattgaaactgtacggctacgatgtctggcaaatggataatatttcaagaatcagtgcctttattgctcttggaatcattttattgttaagctcattcacttttcaacgcctgaaaaacatcatcagaaatatggtagacaagaaggataaaaatgaagaaaatgaggaggccgccggatgacaatcaggataaaagtttttatctctaaataaaatgtaaaacaatataagatttcattcagattttataaaaaataactatatttatcacgtttttaacagttacatattctgattatgaaaaaaatactctattcttttttactattttcctctgtgactttatttgcacagcaaaaaaatcctgctgtaaagtttgcagtggctgacaatgctatcggaacagtagaattattcaatacaactacaataaagaacctgatgcaggtttcaaaagtttacaataacccggcaagttttccacagagtttacaaaaatacagttctgtttttaccaaagggatcactgaatataagttcaaaaatgggcagaatccatttgataaaatggcattatctgaaatcaatgtacaatacaacatcccggcggataacccggtatttattgaaggatatgaatttactgacaccagcgcgttaatctacccgcagatcaggaaaaaaatggaagtaaaagattataatggtaaaaaaacattgttcatctatacaactgaataattgaatactataaaaaaaggatgctctaaaacagcatcctttttattttaatatttattgttccacttttttcttagctcatcgtagattttcttttctgtagaattattcccgggctcatataattttatatttctgatttcttcaggaagaaagtcctgttctacaaaatttccctcataagaatgggcatatttatagtcttttccatagttaagatctttcatcagttttgtaggagcatttctcagatgaagcggcacaggcagattacctgtctgtttcaccaaagccagcgcttcgttaatcgccatgtaagcagaattacttttaggggaaaccgccagatatatagcagtttcactcagtataatcctcgcttccgggtttccgatcacattaattgcctgaaaacagttgttggcaactaccaacgcattcggattagccaaccctacatcttcagctgccagaattagcattcttcgggcaataaacttaatatcttctcccccggcaatcattcttgccagccagtaaaccgcaccgttaggatctcctccacgcatagatttgataaatgctgaaataatatcataatgctgctcaccgtttttatcatacaacgccatggtctcctgaagaacttcaagaacatccgaatttagaatttcttttgtatcagagtttttatattgattcagaaccaactccacggaattgatcagctttctggcatctcctcctgaatattgaataaatgcctctttttccaggattttaaaatcagttccctcatctttattgtacctttccgaagcgatatcgataagctcttccagcttttcatagctcaaagcttttaaaatgtaaacctgacttcttgaaagcagtgctgaaaccacttcaaagctcggattttctgtagttgccccaatcagtacaatccaacctttttctacggcatgcaataatgagtcctgctgagatttattaaacctgtgaatttcatcaataaataagattggcgactttccggagaacagattctgttttttggcatcttcaatcacatcacgaacatcttttactccggaagaaactgcagaaagcttatagaatttccttcccgactgctccgaaataatttcagccagcgtggttttgccggttcccggaggcccccagaatatcagcgagttcagggtattgttttcaatcattttcctgatggttcctttatcgccggtaaggtgctcctgccccaatacatcgttcagggttttgggtcttaatttttcagctaatgggatattttgattcaaagtaattctatttttttaagatcaatgtcccggatttccgatctccgaaacttataacaaatttaaactaattttcatttttttaccctatttttgcattgttttgaaacttacattcaataaaatcattacatttccactggtaattttgatcaaattttaccaatggttcatctcgcctttacttcccaaaaactgccgctacgaacccacctgttctcactatatggtagaatcacttcaggtacacggcatctttaagggcttctggctgggatttaaaaggattttaaggtgccatccctggggaggaagcggttatgaccctgttcccccaaaacataaatgtcaataatcaaactattaaatcaatagaaaaatgaatactttttttttcagaatttactttgttctgtttgcgttgatcactcaatgcctctttgcacaggaataccctggaggtttatctgacggaactttagatatcaatggaaacaatattcctgtaaaaatctattctaccacggagatgggggaccttacggcttttcctgacagggaatcggataaaaaccagtcttttgttgtcatcttaaatgaatcaaattttgagcctgaatattacaactatggcgcttcaactttagccaaatataaagattcaaagtatcagtttttcgataaaaactttaagcttattgatacttccgttaacagggataatatttcaaaattcaaatatgcagtaaaatcagtgaagcctattactgattctgataaagtagagcttaaaactccgtttaaaatatgggatccttcaaaaggaattcatatcggatcctttacccttcacttttatagtctgatgtttgtttttgcatttggattcggatatgttttaatgacaagaatctttaaaatcgacaacgttaaccaaaaatacctggagccccttttcacatggacattgatcgggactattcttggagcaagattaggacacgttatcttttatcagccggaattatttaaagaagatttctggagcgtatttttgccaatcagtaccaaaaacggtttaaaatttacaggattttccggactggcgagtcatggcgctacaatcgctttgattttcacaacattatattattcatttaaagtcatcagaaaaaatcctttctgggtatatgacagattaggtattgtagtggctttgggaggtgcatttgtaagaatggggaacttttttaattctgaaatcgttggtaagccagctgatcccaactctccgttcgctttacttttcccgcaacaaagcagcgaatatggtcttaccgttccgcgttatccaagtcagttatttgaagcggtagggtatgttcttcttttcattttattatggattctttacagaaaaaccgataaaaaatatcaacaaggctggttatttggtttatttttcatcattctttgggcaatcagattctttgtggaattccttaaagaaccacagggagatgaattcatccagattggcggtctgaatacaggccaggttctatctatcccttttatgattgcaggagttgtaattatgattgtttccaagaagtttaaaatcacaccggaagaaaacgcaaaaccggaataggttcaacagactaaaaggtaaaacagctgaaaagcaaaaaaggcaaatctgtaaaatacagatttgccttttttaatatcttaaaattatttcgctgctactttttcttccggtgttttataaattccttgctgttttcctgttcagctcttcaaaaacacttccaaatgcatcaataacatcagtgggaagtacagattcttttgaatgcttttctgaagctatctccgcagccctgccatgcagccaaaccccaaggatacatgtatgctcttcagaatatttctgtgcataaagtgaagtcagaattccggtaagaatatctccgcttcctcctttggcgagccctgcatttccggtaatattgtaaaatacatttgcctgcggggtaataatctgggtatgatgatcttttaacacaatataaatatccagctcttttgccttttgtctggcaagcttaagccttttgaaggaatctgcagtacttccgaaaagcctttcaaactctttcggatgaggtgtaatgattgatttctttggaattaatttcagattttctggattttttgaaatgatatttaaagcatctgcatccaggattaatgaccgtttacagcttttcaaaaagctcagaaagctcttttctgtttcctgatgagttcctaatccgggacctataccacagataaaatcatcttcaatttcaaaattaaggataaacttttctcctcctcctatgaacattgcctcgggacatgaagtctgtaaaatctcatatccgcattcaggcgccagggcaaatgttaatcccgcacctgttttcaaggctgattttacagccagcaccgcagctcctatttttccgtaacttcctgctacaatggctgccttaccatagctgcctttgtgagaaaaatcctgtctcggaacaaatatagattctatcagcagatcatcaattacagaatatacagcatcagtggtgtctgcgtaagttttgcttaaatcaatatccagcacttctatttttccggtatattttccggtttcaggatgaagaaaagtccgtttccagcattgaaaagtcagcgtataatcagctttcataatgacagcattattgtcaaacatttcatctggtgacagcccggaaggaatatcgatggatattttaatattctttttggtattcagctgctcaacaagcgatttgtattctccttccaacggtcttgataatcctgtcccgaaaaaggcatctacaataatcgttttatcatcaaaggtatagtgttcatcaggatcaaattttctgactgaaattccagacaaatcacgaagccttttaagattaacagatgcatcttctgaaaacttctttttggaatcgcttataaatacatctatgtcaaaacccttaagataaagtattcttgcaacagccaacccatcacctccgttatttccgttaccgcaaaatacagccagctttttatggtttttacaatgttcagaaatccagtgagcaacagccattgaagctctttccatcagctggatggaagaaatgggttcatgggaaatggtaaactgatcccagctgcgtatctgttctgcggtaaaaattttcatagacaaatcaaacttttaagcaaattacaaaagatttttcattatgatattacggttattaataaaaatacggagtcaccattaatgaattaaattatctgtataaagttaaaatatccattaaaatgaataacatgaaatcattgtaaattcaatgttttgggaataaaaaactacataatttagtgttttttacattttttaattatatttttgtgtatatactaattaaaaaaatataaattatgggatttgtaaaagaatttaaagagtttgcctttaagggcaatgttctcgatcttgctgtcggtgtgatcattggggcagcatttggtaaaattgtttcgtctttagtggaagatgtaatcactcctctgatattaaacccggcattgaaagccgccggtgctgaaaacattgcaaagctgtcatggaatggtgttgcttacggaaatttcctttcagcagtaatcagtttcctttgtattgcgatggttcttttctggatcattaaatttgccaataaggtaaacaaaaaagaggcacctgctcctgccggacctacagaagatcagaaattactgatggaaatcagagatttgctgaaaagcaaaaatatatagtctgttaaaaacttttttaaaataaaaaagcacctcgttttgtagactgaggtgcttttatttatagtctgatttaacttattgaatctgtaagatacttgaaatctgctccgcaagggaaagtcctattctatcctgtgcctcaagagtggaagctcctgtatgaggagtaagagaaatcttagggtgagtaaggatttctttggaaggtgttggttcattaatgaaaacatctaacccggcaaatcttactttaccggaatccaaagcctgaatcaaagccgcttcatcgataactccacctcttgaacagtttacaatagccactccgtctttcatgatttcaaattcattctgaccaatcatataaccatccttctgtgcaggaacgtgtaaagtaatgaagtctgaatgttttaaaacatcctgtaacggctctgtctcgatatcaacattgatgaactgattgttgtaaaatttcactttgatgcttgctcttcctacattattatccgcagcaaccactctcatcccaagacctaaggcgattcttgctacttcctggccgattcttcccatcccaacaataccgatggtttttcctctcaattcgataccgggcgcatatgcttttttaagagctgcaaattcagtatctcctactacaggcatttttctgttggaatcctgaagaaatctcgcaccggaaaataaatgggcaaaaacaagctcagccacagattctgaagaagcagaaggcgtattgatcacatgaattcctttttctctggcataatctacatcaatattatccataccaacacctcctcttccgataatgtcgatggacgggcatccgtcaataatatcttttcttacctgtgtagcacttctcaccaataatgtacggattttgtgctcattaatataatctactaaaaactcctgcggaacttttgtagtgatcacttcaaagcctttttctgtcaatgcatctattccagattgatcaaggccgtcgtttgctaaaactttcataaaatatcaagtatattaaaaaatgaaagatttaaaaattcagggaaatgtttccatgtaatttttaaatctttgaattatatttttattcgccgtcttctttgaatacttcaatggtcacttgcttttctaccagatccgtaaatcttcctttataccttgtagctcttaccaggtggttatctatccagtgataatttccccctcttggttttccgcaaagcacgctgtggtatttgaagccatgcttatccagccagtcgatagtgatttgtttcagattttcggttcttgaagtaaaaaagcatatctgatgcccttcatcataccatctgttgatcgtttccagtgcatcagggtatggttcgcaggtaaccattctttccggttcttcattgggaacgtcatcagtaatggttccgtcgatatctattaagtaattttttattccatcctttagaataggactaatgtgttcaatgtattctaattccattactaaatattaagtaacaaagttagcgtttttagaactatcaggcacattaatcttagtttaagttaaaattttactataaaaaataatattcagcgaataatatcaataatttattcatcatttcactcgaaatagttaaaatttttcgttttgaatttcttttcaataaagtgaatccggatgcagacaaatcaaatcggagaactgatcattttactccgttactttttgtctttcccttcatcttgttatcattattataaaaagcatgatgtttaactaaaaatttccaaaatacatttattacccttacatttgtaggaatggaagaatttgtcgttttagtaaatcctgaagatcgggttttagggctgatggaaaagcaacaggctcacatcaatggtctgctgcaccgtgctttttctgtatttcttttcaacagcaaaggagaaatgcttctgcagaaaagggcttcaggaaagtatcattctcctaaccaatggaccaatgccgtatgctcacaccccagagatggggaaacctatcaggaaggagcagcacgcagactgaaggaagagctgggaatagagacagaactttcagaaaaattcaattttatttataaagcagatgtaggcggcggcctttgggagcacgagctggatcatgtatttgtgggaaatcatgaagcgggtttcaatttaaataatgaggaagtggaagccgtaagattcatttctatggaagatctggacaaagaaatttccgcacatcctgaaaactttacagcatggtttaaaatcatcctggaagaatataaacaccatttttaatgatgaaaaagatattgtttttttctgctcttttgacgggaagcctgtttttctcacaaaaagcaaaagtctacgaaaattccaattattctattaatgttcctgaaggctggagatctactaacgacagtgaaattgttaatattttccctaccagccagatcggtgcaattaccatttcggaatatcatgatcttccccttccaaaagaggaagtgaaaaaatttatgctggcactttatcaatcacaagaccaggaaagtaaagtaaaagaaaaaaagagccagaaaggatatacggaatacctgtatgaacattttgatgaaaaagaaaagctgttctgggtaaccaaagctttccagaaagacaaaaacttatatttggtttccatcaattgtggccagaaattctggaacggaaactacatgaccctattcaatgagacttttaacagttttaaaataaagaaataaaaattaaatatgaagaaaacagccttgtacgacaaacatgtttctttgggagctaagatcgtacctttcgcaggttttgaaatgcctgttcaatattcaggggttacagaagaacattttgctgtaagagaaaaagcaggattatttgatgtttcccacatgggacagtttttcatcgaagggccgggttcaaaagaccttttacaatttgtaaccactaataatgtagatacgcttgaaaacggaaaagctcagtactcttgtcttccgaacgaaaacggaggaattgtggacgaccttatcgtttacaaaatggaagatgacaaatatttcgtggtggtaaacgcatccaacattgataaggactggaatcatatttcaaaatataatactttcggggctaaaatgacgaatgcttctgatgaaatgtctttattggcagttcaggggcctaaagctactgagattcttcaaaaacttaccgatgtaaacctttcggaaatcccttactatcattttactgtaggaagtgtggctggagaaaatgatgtgatcatttcgaacacaggatatactggaagcggaggttttgagatttatttcaaaaatgaaagcgctgaaaaactttgggatgctgtaatggaagcaggtcaggaagaaggaattattccttgcggactggctgccagagatactttaagattagaaaaaggattctgcctttacggaaatgatattgatgatacaacctctccgattgaagctggtttgggatggatcaccaagtttgataaagacttcgtttccaaagatgtttttgcaaaacagaaagaagaaggagttaccagaaaattagttggtttcgaactgacagacaaaggtgttccaagacatgattatcctgtagtagatgctgaaggaaacgtgatcggaaaagtaacttcgggaacacaatctccaatgaaaaaggtaggtttaggtcttgcttatgttgacaaacctcatttcaaattaggatctgagatctttattcaggtaagaaacaagaacatccctgcaaaagtggtgaaggctccttttgtataatctgttcaggatataaaaaaagaggctgtgatttcttcacagcctcttttttttggtttaatagcagatgcagcaggtttttctgtcagaggtacagacatctcctactcccggtgtattggaaattacacctccggcaggtccgcataaaatactgcagacaggtaaagaagcaatacctccgttaacttctttcagttctgatctgtttagtttttttgtttttgaaaagtttgttttcatattgtacatttttggtaatcacaaatatagccattcaaaaacaactaacaatcaaatacttacaaaaaaaacacccaatctgatagatataaaaatatccggcacaataataaaaatcattaagccggacaggttctctttaaagctatttattggtttacaccaaagaacttctgtagttcttcaacatttttcttatcatttcctacaaaaatttctttatctgtcataaaaacaggtctttttaaaaaggtataatgatccagaagcaattctttaaaatctttttctgtcaaagactttacatccagccctctcagtttgatctgagtagattttttactgaataacgcttcgtacgattttgttttcttatgcatttctgccaattcctctttcgtgacgggctcttttttaatttcgcgaagttcccagtcagtaagatcaaattgagataaaatttttctgcaggtatcacatgtattgagataaaatactttcttcattacgttttctaaatctgttgttggttaaaattccctttcattgaaagtttcgtctttcaaaagtaggatttaatccaaaaatttggaaattattaaataactttattcaaattttataaagatgcagaacaagcctattacttttcagtttatttcggagccttcagatgttaattacggaggaaatgtacatggaggaagtgtgatgaaatggattgaccaggccggttatgcatgtgctaccacatggagtggtaattattccgttacagtatatgttggcggaatccgtttttatgatcctatcaaaatcggggaagtcgtaaaagttgatgcccaggtgatttacacagggacttcaagcatgcatatcgccattaatgttttttcaagaaacctgaaacagcctaattttgagaaaaaaacccattgtatcatcgtttttgttgctgtggatgaaaatggtaaaaaactccctgtacctaagtggactccggaaacagaggaagaaaagcagcttgaaatgtatgccaaacgactgatggaacttagaacgcagattgaagatgaaatgaaaccttttttgtaaaagaataagattcataatctccatgctgaattcacgaacctgctttttcatattatattgtataagaaattaagattaactaatttagtatcaaccattttaaagtataatatgaaaaatattcttacaatcacagcatttctgttgatggtttttcctcaggcacaaacccataggttcatttatgaacttcagtataaaatggattctaccgaggtcggatatgaaaaagtgaatatgatcctggatatcaccccgaaagaggtaaagttctatggaaaagatgtcgccatcagagattcactgaataaaaaattcggcatgaacttcagctatactgatatgaccggacaggtagttaaaagaaagatcaattcttttgataatgaaaattttatcaacattaaaaatggatattatacatttaaaactacagataagatcaattggacgatcgctgatgagattaaaaaggtagaaaattatactttacaaaaagcaactacaaaatttggagggagaagctggacggcctggttctgtaaagatattccatttaatgaagggccatttaaactgcgtgggttacccggtctgatctttgaactatcagatgctaagaaaaacttcctttatactctcgttaaaagcagagaacttccggaggtctccaatacttcggatttcctggaatccagctttggtaataaagcaattcctattaatgaaaaacaaaagcataagctgatgatggagttttataatgaccctttcgcctttgaaagaaataatatcagcaaatccaataatgaccttagaattaacatcaacggaaaggaaattcataatgtagatgaactgaatactcaaaccaaaagtatgcaggaggttatcaggaagtataataatccgattgaaatcgataaggcgatgcattatccgatatattaaaaccttggtttatttttaagtttgggctaaagccggtggaaattttttaaatttatttaggcgggctaaagcccacctctagtaatgttgacatataattatttaacgacagtatcttttagaattgttactaattacgttatagagattcctccggaatgacaaaagaattaagtactaccaaagacatgatacaagcagtcattgtcatttcgtaggaatctaattattatagcctataaaacctgatgaaaaattaaaaacaggagaaattccttgatatctgacatctgaatgtatagctgatgtttaatgaaaagatcttttatcttttatcttttatcttttatcttttatcttttatcttttatcttttatcttttattattacatttgcaatatcaaaaaggaaatggtgttcttccttacccaaccgctttacaaaagctgatgacgcctgattaaaagattattaacaaataactaatcaggattattatgtcaaaaaatcaacggacacttggtaaaaaagcagtttttcacactcattttttcttcagaaaattcccggcactgccttatattttaaaatggctgttcatcagtatgattataggagcattagtaggaaccgcttctgcaggatttcttcagtcattggaatggactaccaatttcagagagaatcatctctggctgatagcttttcttcctgttgccggatttttgataggattgctttactattacttcgggaaagatgttgaagcaggaaacaacctgttgatcgataccatccatgagcccaaaggcatcattccgtttaaaatggctccctttgtttatctgggaacgattgcgactcattttttcggaggttctgcaggtcgtgaaggaacagcgcttcaaatggcaggtgctattgcagatcagcttacaaaaccttttaagctcgaccgaaatgatagaaaagtactgattatttcagcgattgccgccggatttggctctgttttcggaactcctttggctggtgcagttttcggtcttgaagtttttctaataggaagaatccgttataatgctattttccctgcatttgcttcggccgttcttgctgacctggtgaccagtctctggaaagtaaaacatacccattatcatattgatttcatcccaaaactggaatttttacccattctttacagtattctggcaggtattacttttggaatctgtgccgctgctttcagtaaaatcattcattggatgggatcttttttcaaatcgaaaatcaaatatcctccgcttcgacctgttgccggaggaatcataatagcacttgccgtttttgctatgggtactacccgttatattggactgggaattcctgtgattgtagaatcttttgaaaagcagcttccactatatgattttgccttaaaaatgatctttaccatggttacactttcggccggatttaaaggtggtgaagttaccccgctgttttttatcggagctactctaggcagtgctttatctctttttattcctttacctttcgggctattggccgggatgggatttgttgctgtatttgccggagccaccaatactcctttggcctgtatgctgatgggaattgagctgttcggagctgaatgtggcgtgtatatagctattgcttgtgttgtatcttatcttctttcaggacataacagcatttatgcaaagcagaaaataggagaagcaaaaaacagaagatacgaaagtcagcaggacaggtctgtttcggattttttataaggggtttcgagatgcggggtgcgggttacgagttacgggatgctggtttttattagttctcagttcttcacttataacatcttgaacccaaaatccctcaaacttaaaaactcaaacctgaaatcccgaatcccgaatctctcaaatactcagactccaaaaccctcaaactcgcaacacgcatctcatcaccctcaaactctcccactcccttcatcatttccaactataattcgtaattttaccgcatgttcgattacagattaaaagttttccatacggtagcttcccgcttaagtttcactaaggcttcagaagagcttcatatttcacagcctgctgtcaccaaacacattaaagaaattgaaacccaggtaggcgcgaagttatttgaccgtaaaggaacttctatacagctgacccaaagcggtaagattttgtatgaacatgctgaaaagatcagaaatatctaccgtgacatggagtttgaaatcagccagatcaatcaacaacataagggaaaactgattatcggagcaagcacaacagttgcgcagtatattttgcctgaaattttagccaaatttaatacttactataaagatattaagattgagcttcttacgggcaatacggaagctatttcatcacttttaaaggaagaaaaaattgacctcggtattatcgaaggtgagtcgcagtcttcttattttgaatacaagactttcaaaccggatgaaattgttttggcagcaaaatccgatcatcctcttgctcataaaactttacacctaaaggacctttatcagctggatctgattttcagagaacagggttccggtacgctggagttcatacaaaacagactcaaagaaaaaggaatcaatatcaatgaattaaataccgttatgcagttgggaagcagcgaaagtattaaaaattaccttcttcattcggaatgtatggcctttctttccatcagcaccatattgagtgaacttaaaaataatatccttaccgtcattgatattaaaaacttcagtattgaaagagattttcattttatccttcctaaaggtgagcagtctgaactgattaagcttttcctgagatttgctgagcaataagcaacaagtaaagatataacttatagttatcctatataacaaaatacgatttattttgttatactattttccggaattttggtgcagattttaaaagttcgcattatgaaagatttcattcagaatgaaatgacccggaaaatattctttatagttttggccgtattatgccttacaccgctcatatcttctccaattgcccttgctttgggatttgccctggctgtttttatgggaaacccttttgaaaaacatcttcatcaatatattcatctgctgctgcagatttcaattgtaggactgggattcgggttaaagctggatgaagctcttaatgcgggaaagacaggcttgatgctgactattgtaagtattgttactgtaatggttttgggatattttctgggaaaaatatttaaactggaaagacccttgtcttatctcttgtctgcaggaacagctatctgtggcggaagtgccatcgcggcagtatctcccattattaaaccaagcacgaaacagatttcccttgcgctggcgattgtttttaccttaaattcaattgcgttgtttgtatatcctgcgatagggcatctgctgaatctttcacaggagcagttcgggctttggtgtgcggtgggaattcatgatacaagttctgttgtaggtgctgcaagcaaatatggcgatgaagccctcaaaatagcaacgacagtgaagcttgcccgtgcattgtggattatcccggtttcactgattactatgtttatttttaaaagtaagggcactaaaataaagattccatggttcatcggctactttattattgctattcttttgaatacatatttcccggttcttgatcgtttcagtagttctatcacagttctggcaaaatccggactgaatctgaccctgtttttcatcggttctaccctttcccttcaaaccctgaaatctataggattaaagccattgcttaccgcagtactcctctggattacgataagtgccggcagtcttctttacattatccgttaaaaagagcagcacccttttgaaaacaaaagggtgctgcatattaaatgtggaaatgtttatttcatattgaaataatttctttagatagcagcttcaccacaagtataaacctgcgggcaagcaatatactgtacgcaataccacggtcctgttactgatcctgagcagctgcatccgcaaagagataaatcaggatttccgcttattcctccagtaatgtttttcagatcctgctttcttaattttttagcatttttcataatgttcatgagatttagtttgattaaacaaatatagttttagttacttcccaaagttaaacaaatattaattacacgcaacaaaatttagtataaaagttaataatttattgattataacatgattattatattcaaaacaaggaataacttttttcttttttttaaacagtttcatttattctgtaaactcaagatctttgtcgtgggtttctgaaatcgtaagtgaggaataaaatgccagcccgaatactaccacccctacaatggcagcgctttccaccacaggaaaatgagctttaagtgaatcaaaagccagaatcataacaggaacaaggcctctcaccatattcggaacagttgtcgttgctgtatttctgatattggttccaaactgttctgcggctaatgtcacaaacatagcccaatatcctgtaccgaatcccaaccagacacaaaacagataatattttgtttccgtattggtattaccgaacagcatgatggcgaccccaatcagggtaaagatcaacatgtaaaagatggccattttgcgtgattttaaagcatgggaaataaaaccgctcagcagatcaccgacagaaatacctatataagcccacataattgcttttccggggttgatgtcctttatacctaattcaggcgcaaactgattggctaaaacagccagaatccctatgcaataccacgtaggtaatcctactgcaatacattttaaataccttatcaatcggtctttattggtaaagaaagagagaaagtttccttttgagacatttttatgctcaatattcttgtaaatcccggattccgatacgctgattctcagtatcaataacatgattcccataatcccaccgattatgtaagaaatgttccagccaccagccagctctacagtaagctgggcaacaacagcgcccattaatccaaatccggcaacaactgaggttcctattgcccttaaattcttcggcaggctttcagaaaccagcgtaattcctgctccaagctctccggccaggccaataccagcaatgaaccttaaaccggcatattgatatactaactgctcttttggaaaataaggcagaaagccacaggcaatattagccaatgaatacaccagaatagacccgaagagtacggaaagtcttccttttttatctccgaagatcccccagaaaacacctccgagaagaagccccaccatctgacagttcagaataaaggttccgtctgcatcgggattcagtcccaatgcctttaagctgggtattctgacaattccaaacaaaaggagatcatagatgtctacaaagtagccgagggctgatataataacgggaatagagaaaatgtacttcagtttcgaagacagggacagttcttgcattttggatttttaaattttgttaaaaataaaaattaattgaacaaagtatctttttttttacatatatctattaatctttgatttatcctaaatagtttatttcaataattaatgataaaagattaaaaatgtaaatacataaataatatttttagtttttttgaaagtcaatattaaagaatgatgaacgcttacaaattattttctgaaatcattttaaaacgcttttatttctgaaaaaaaatatataaaattgcattagaaatagatatcgacatatcatttaaaatataaagcattagcttttcttgtctcggtaaactggtaatttaaaagtgtacaagaatatgcgatgctcacgcttcggcgtgggctattgtttatctgtacacaggtataccagtacctccgagacagtaggcatagttccacgctttttttgtttctgaaactgattagctagggataaaaattaatttaaccatttggcacttgtagtacgtaatacaaatgaaaaatggataaatagacttgcaagcaagacaccaataggaatctaatgtgcttataaactttgattcacatttaacaattaaaaactttaaacaagatgaaaaaattccttttttcgggactattaatgattagctccctatcttttgcagcagtatggacagtaacaactacttgcggagttgttggaaaaatcgaaattgccgataatgctacgacctcccaagttgcccaagcagtaagccagtataattataatcaatgtggtgttagacctgctaagattaatctcagccttgaaccatagccttttttattagggttcgttaaattggcgaaccctagtaattaaaatctaaaaatatgaatctacaaaaaatactattctttttctttatttgtatgatcaatttcttatcctctcaggatttaaagtctaattatgtatgtacatataaattggattatataataaatgggaaaaaagaaaatgagcaattcattatgcatattgatgctaaaaataaaagatcattttttcaaagttcaataaattatgcaaaggatacaatagatataaaaaatccaatgcaattagctaattatgaaagtgattttaatgaaaaagtgctatttgataataattcatttaaggtttttgaaaccgttatagatgccaagctatcatattctgaaaatcaaaaactaagctggataatattagataaaattaagaaagaagaaagtgtaacaatacaattagcaaaaactaacgcttatggaaggacttggtatgcttggtttagtaaagatataccaattgactttggtccttacaaatttaatggtttaccaggttttatcgtttctctatatgacgaaaaaaagaactttatatatactcttcaaaaattcaaaaagaaaaataaaacaataaaacttccaaatcctaaaaattataagaatattcctaaaaaagcttacaatcagtctagatttaaaatacagacagcagatagcggagttattatttttaacaatgcaaaggaaagggaaaattggatgaaaaagcttgaagaaagatatatagtttcgcccttgttagatattgagtttccaattaaataatattatatggtgtttatagagattaagcagaaacttactatctattctagtactcttcgtattcggtttagtacatgggattataagtctttcataacaaacaaaccctatcaaaaaatcttgatagggttttattaaatatttttctgattattatctggcaatattcacagctcttgtttctctgatcactgttacttttacctgtcccggataagtcagctcattctggattttctcagagatatcgtaagaaagctgggaagctacttcatcgtttacttttccgctttctaccattactcttagttctctacccgcctggatggcataggcactggatactccatcgaagcttaatgctgcagattcaaggtctttcaatctctggatataagattccaatacctgtcttcttgctcccggtcttgctcctgagatcgcatcggcaacctgaatgattggtgataataatgatttcatttcaatttcgtcgtggtgcgctccgattgcgttaacaacctccggattttcaccgtatttctcagcccactgcattcctaataatgcgtgtggtaattctgattcctgctcaggaactttaccgatatcatgtaaaagacctgctctttttgctaattttacgtttaatcctaactcagcagccattgttgcagcgatattggcaacttctcttgagtgctgcaataagttctgcccgtaagaagaacggtatttcattctaccaacgattttgatcagttcagggtgtaatccgtggattcctaaatcaatgatggttctcttacctacttcaatgatttcctcctcgatctgttttcttgttttttcaacaacttcttcaattcttgccgggtgaattctaccgtcagttaccaatctgtgaagggatagtcttgcaatttctcttcttaccggatcaaaacaagaaagaagaatggcttccggtgtatcgtcaacaatgatctctactcctgttacggcttccaaagcacggatatttctaccttctctaccaataattctacctttcacttcatcagactcaatattgaaaactgatactgaattttcgatagcctgctctgttccgattctctggatcgtttggataacgatttttcttgcttcgtttttagcattcatctgagcttcctccatgatgctctgaacgtgtgcctgcgctcttgtttttgcttcagctctcatggtttctaccaattctgctttggcttcttcagcggtatagttggaaattttctcaagtatttctactttcttagctgttgcaacatccagctcctgctgttttctttccagaatttcgttcttcttagcgtagtcagcaatctgcttatccagatctttttcaagtttcccggtcttgctaagctcgtcattcagcttatgttctttatccttgattcttttctcaatctcctgcattttcttttcgcgggcctgaatgtcagcatcatgctgtgatttcagttccaggaatttttcttttgcctggagatttttttctttctttatggattcagcctgtacattagctttttctataaggttttcggcattcttcttggcatcatctatgatgaattttgctttagtattcagagaacttctggaaaaaaacattcccactacagccccgattaccaaacaaacaacaccgactataacttctatcataatatatattgagttttaattgtattcatatctaaataaaaaaagcctacaataatccagagattgagagtaaactcctaatcaacacgatttgaactgatttccactgtctgtaatccggaagtccggcgcgccattcaatggacatttgttcggtaattgtttagcgttgagtttacctttaatgtgttagaattattgtaggcagtaatttttcaggaaaaaaaatctatttcccgatttcattcaacgattgattaatctgtgctaatctttcgttggtagaattaatatttttctcgtagttaagagaaaccacttctgcattggttcccagtttaagggcacacatagccaaagcatcctgtttatctcttacatcgaaattctgttcaaaatctttaatcatattctcgatctgcttccctactttacgcaaagtttcttcctctgctgccggtacgttcagcggatacactcttcctgcaatgttgacggttattctccttatctccattataatccactgttttgaagctgagcaatacagaaatcaatttcttttaccaatctgttgatatggtttttcattaatctattgtgttcaggatttcctgatattgctgaataaagttttatatttttttgttcttctgctaatacctgattttttcttctttcttcatcatacttcttcttcaactcttcatgctcaatacttaattcttttaaattttccgtaagatttttatagttcttttgcagagtcgaaatctttctctctaattctgaaaaattattttctaaatcttgaagcatttcaggtttgtatattctaactaaaagcaaaaataaaaaaataataacactaacaaaaataaaacgctctatattttgatatataaacaaaaaaggaggcgccagagcgtctcccatgtattttccactgaaaaattttttattcaaatttcagaacaaacattactgctcttgtctgcaatgtagaaactgcagatgcccagtaaggaggtgtagttgcgttatccgccactttctcattgttcatgaagaatgttcctctgatcgcaggagttagtttaaacttattgaaataaaactggattcccatttctgcagaccatgcaaagttgtgggtggtagatctgaagatcccctgcatgttatcatctgtagaagttgcattagactgaaggtttactacgtagtttacccctgctgcaacgtaaggtcttgagttgtaccatctttgtccgtgaagctccagaagtaccggaatatctattaatgtagatttaatttctcttactttatccttttcctgtaaagggaacggtatgaagggatcatttgttaaagatccacctgcataaatatcattggattgagtattaaaagtcaactgtctttgtgcaaactgtaaacctggctctattcttacgtctaaatagtcgttcagtctccattttgcaataagcccggcaccgaaactataactttccttagaggtaacaaggttttcattatcattcatcccatatttcggatgtaaaacaatgcggtaatccagtctgttcccgttcaaataaaacccccaactgaatttctgttcgtcgaaatcttccaacttgtccattctgtttcgggttctgaattgcgcgtttgcaaaaacggcaacatttactgaggttaaaaccagtgcttttaatagaaatttattcataggttactttgttgctttataaattgtggctatacctaaacttaattttttatattcaactttcttaaatcccgtatctaaaagaatttgcttcatcttctccccgaaaggaaaagcatttacagaatccggaaggtatgtatatgccctattatccttggaaaccagtctgccaatcgcaggcaatatatttttgaaataaaacatataaaatggtcccatgaaaccctcaacctttgaaaactccagtatataaacacttttgttatctttaactactcttcttaactctgccaaacctttggtaaggttctcaaaattccttactccaaatgcaacggaaaccgcatcaaatctattgtcctcgaaaggtaaattttctgcatctcctttttgcatggaaattttgccgtctaatttaagtttttttattttaataacgccaacattcagcatttgttgtgataaatctaatccaaccactttagaaccggttcctttttcaatagttattgccagatctcccgttcctgtagccacatccagcacttcctgcggattatcatttttcatccattttaccagtttatttctccacaaaacgtcaattttcatggataaaacatggttcagaaggtcatacttcggtgcaatgttgtcgaacatatcctctacctggcttttttttgtagcctctgaattgtagggagtaactttggtgatatcttttgtcaaaacttaaaacttgtaatattctttgtaataatttaggtaatcctgctttctgaagattttggatctcgattccactttctggatattcttgatcactttgtcatagtcttcatccacattgtaataaaaatcttctgtgtaaagtttattgaagtgtctggcccctccgtaataatcctttccgtcaatgaccgttttatcaagattggccagtaacgaatcttttttaaggttataaccgtaatactgatcattaatgtagtaatcctggtgtgtaatattgatcagaccacgaagtttattaacttcaaatgccgagtcatacagcatttttttgttctgatcaaaaacctgaatagagtttttccctttattcaaatccacatgcacatactgccccgctgaaataattccttcagatccgttgttgatcttgaaatagtaggtgttcggggtaggattatctacaacataataattcttcttggctaaaaaaaggaagtagatcccaaaggcaacgataaacgccacagctgcaataagtaagccttttaaggacgagttgtttttcatagattgtaaagtacaatttttgcaaatttaataatatttttaattctccgttattaatattaattattaactttgcaactttaaaaaaatcatataaacgaatgccgaatacgatcattattggctctggatgttatattccgaacagagttattggtagagattacttcatgaattctgagttctacactgaagacggagtaaagattgaaaagcctgtggaagaaaccattgcgaaatttgtagagattacagaaatcgaaaacaggagattcattgaggatcatctttccaactcacaaatcggttatgaagctgcaaaaattgcccttgaggatgcaaaagtagatggcgaggacctggattatattatttatgcaagcaattttggggaagttactgaacacggatatgctgattttatgcctaccatggcagcgagagtgaagaacaaactgggaatcaaaaacagaaagtgcgtaacctacgatatgcttttcggatgccctgggtgggtagaagccatgatcctggcagataacctgatcaaagctaaagtagccaaaacgattctggtaataggaggtgaaacattaagccgcgtaacagatcctcacgacagaaacagaatgatttttgctgacggtgcaggagctgtagtcgtaaaagcaacagatgaagaaaatgtgggaattatcgctcacaatacaatctgtgacaatggcccggaactgaactatcttgaaaacgctccttccatcaataaagaagtagatcagagacgtctgtatgtaagaatgttaggaagaaaaatctatgaatacgctctgaaaaatgtaccggttgccatcaaggatactattactgatgccggtctttctattgaggatatagacaaaatcttaattcaccaggccaatgctaaaatggattacgccatgattgaaagacttcacaagctttatgatgtgaaagaatacgaccatgctatctctcctatgacgatccaggatttcggaaacacttctgtagcaacaattcctaccatgtatgatttaataattaaaggaaaaatggagggtcaatcgtttaaagaaaaaggtaacattgtgatgacttcggtaggtgccggaatgaacatcaatgctatcgtatacagatttccttaaaaatatttaataaacaaaaaaatataaagcacagggaagttattctttgtgcttttttttgatcagacatgcaaaagaattttttaatcattgccggaatcttcctctttttggaagtatatatttaccaggctgtcagaacgcttaccgacaacctttggatcaaaatcggatattgggttatatcattagctgtgtatggaatcttcgcttatgaagttacccattaccagcgatcagacagaagcatggtaagggcccagatcatgatttcattatttttgatttttattcttccgaaaattttcgtggttctgtttttattaattgatgatatcatcagaatcggaggctatcttatcggtttttccaaaccttcagaaaacttcttcccggaaagacgaaaattcctgagccttgtcggattgggaatgagcggggttctttctgctcttttcatagatggaatcacgtttggaaagtacaggcataaagtgagaagagtaagggtaaatttcaccaatcttccgaaaagcttcaaaggctataaaatcatccagatttctgatgttcacagcggaagcttctctgatccaggcaaattagagcatgccattgagctgatcaatgaacaaaagcccgacctggtgttatttaccggagatatggtgaataatgttgcggatgagtttaaaccctttattcctctgttttctaaaatcaaggctaaagacggcaagtttgcggtcttaggcaaccatgactacggagattacgtaacctgggaatcgcctgcagccaaaaaagaaaatcttgacaccctgatccgctatgaaaaacaagccggatttgatatgttgagaaacgagcacaggattattgaaaaaaacggagaaaagctctatattctaggtgttgaaaactggggattaaaacctttccctcaatttggtaaaattgatgatgctttaaaaaacgtaccggaatccgccacgaagatcctgatgagccatgaccctacccactttgattatgtggtaaaaaaacatcctgcaaacatccatctaaccctttcgggacacactcatgggatgcagtttggtctggatcttaaaaatgtaaaatggtcaccggtacaatataaatatcctaagtgggcagatttatatgaaagtgaaggaaagctgctgtatgttaacagagggtttggagtattgggatatccgggaagagtgggtgtattgccggagattacactttttgaactgagttagagaggcggggtccgggatgcgggttattggttgctggttgtttggttgcgagtgagtttattccgggttacgtgttgcacacaacatcaaacattaaaccttgaacttaaaaccttaaaccctttacctaatccctgcaatctaacccctacaacctatcacctaaaaaatataatctttcatacgggaagtagccatttccctgtcattgagaaaagtaaggagggcatctaatttgtcctccatttttttacccgaaaataagctgcggtaaaaaggaatatcaaaacggtattttttaaaatccgtaaactgccatgtgttaagatagatcagcacaaattcttcattctgcaaagtctccagcaccatattctgataatatttcatcggcaggatctggaatacgaagtcattatagggcagctgactgtaaggagagatactttccgggacaatactcagtccgtcctcttctgtaatttcggtatctcttttgagtcttttgaaaggaaaaagaatattggcattatcaatattagaaacgtaattgaattccatcagcttcagaatatcctgcggaaccttcacatctttctggcggattcccctgatctgtttttccagcagatcctgaatattctttttggcattttcaatttcttcaggatttgaacctttattataaaaagcaatttcatgccctttggatgaaattgcttttattaaattctgaagtttttcagtaagagaaatctctacaaaaaaacttgatttgatatcatgaatatctaaaattctaagaattgctttggtattattttctatgattttcaatcgctcttcatcggcaatccggaagcctttttttacttcagcttcaatacaagtgatgttaaacgtcaataataccatttcaattaaattttatataaacattttaatacattaaaaatcagatgttaaaaacatatttatttaaagtattactttacattattaattcttacctaattttactttcagatttttgatcatatctttcgtcatttcagaaattccgaaatcatacgtcagaccccagtcttttttcgctaccgaatcatcaatagaagccggccatgaatctgcaattgcctgtctgaaatccgggttataatcaatcgtaaaatccggaatttctttcttgatttcttccgccagttcttttggggtaaatgacattccacccaaattgtaagaagaacgaaccgttaaactttcttttggagcttccattagtttcaaggttgcattgatagcatcatccatatacagcattggcattcctgtattctcggaaataaagcttgtatattttccgtcttcaatggccttgtagaaaatctcaacagcatagtcagtagttccacctcctgcaggcgtcttccatgagatcaacccgggatacctgatacttcttacatccactccatgtttgtcgaaatagtattcacaccacttctcccctgccatttttgaaatcccgtaaacagtggtaggattcaacactacatcctgttccacatcatgctttggaattccttttccaaatacagcgatagaacttggccagaagatctttttaagaagcccttctttcgccatttcacaaaaatgaaggagtggttcaagatttaatttccatgcgaaaatcggctgtttttccgaagtcccggataaaagcgaagcaaggtgatacactgtagtgatatcataatctttaattacctgtcttaccaattgcgtattggtaacatccattctttcatagtgtccggcagaagtaattccttcctgccatctgtccagtcctgaagcaacaacattttctgctccgtggatttcaacaagtctgtttgtaagttcggtaccaatttgtcccagggcacctgtaatcagtattctttccgtataggattccattttcagatttttttagaattgtacaaaagtaaaaaaaacatgtcaaccataataaaaaaggtgtatttaaaaacatttctctgataaccatcttcatcttcaattaatttcaatgaaagaaaaaatcaaatgcaatgatcatcaggctgtgattcactgaaaattcaataattttgtttcaagaaaaaacaatcatatgaagaagattttaattgcttcgatgctgttggcagttcagttcagctgggctcaattcacagatatcaatattatcaaggaagtacaggtaaaaaacaaaggtgtggtagtctctgcacatcctttagccagtgaagcgggagctaaaatcttaaagatgggcggaaatgcttacgacgctgttacagcgacacagtatgcgcttgccgttgtgtatccgcaggccggaaatattggcggcggtggatttctggtaggggtcaaaaacaatggggaaaaattcacattggactacagggaaactgctcctaagaaagcttcacgggatatgtatatcgacaaaaaaggaaaagcagatactgatctttctcaaaacggaagactcgcagtaggcgttcccggaagtgtggctggattttttgctaccttgaagtattgcaagctgccgatggaaaagatcatccagcctgccattgatctcgcagaaaaaggatttgccatcacagataaagaggcagaaatgctgaacaaccaaagagagaaatttcagaagcacaataaatcttctatcatttttgtaaaagatactccctggaaagccggagatctgttaattcaaaaagatcttgccgagactttaaaacgcatccagaaatcaggagctaaaggtttttatgaagggaaaacagctgaactcctggttgctgaaatgaaaagaggtaacggaattatcacgctggaagatcttaagaactataaagttgcagaaagaaaagctcttgaatttgattataaaggaaatgatgttgtcaccatgcctttaccatcaagcggcggagtgctgcttgctcaaatgctgagaatggcaagttttgaaaacctggaaaaatatcagcagaactcaacaaaagcagttcagattatggctgaagcagaaagaagagctttcgcagacagagcagaatatatgggggatccggattttattcaggacaaaacttcttacctgatttctgacgaatacctgaaaggcagatggaaaaatttcagttttgataaagctactccaagcgcagaagttggcaaaatcatagaacagcctaaggaatcgatgcagactactcatatttccgtattggataaggacggaaatgccgcttcagtaactacaacccttaacggatattacggaagtaaagttttagtttccggagcgggattctttttaaataatgaaatggatgatttctctattaagccgggagtaccgaatatgttcggagctgtaggtggtgaggccaattccatccagcctaataaaagaatgctttcttctatgactccaaccattattcttaaaggcggaaagccttatatggtggtgggaactcccggaggaacaacaattccaacatcggtctatcaatctattgtgaacgttgtagattttaaactgaatgccaatctctcagtaaatgcaccaaagttccaccatcagtggcttccggaaaccattacggtagagaacaatttccctgaaagtaccatttctgaactgaagagtaaaaattatgttattgaaaaaacaaaatatatcggaaaaacagaaatgatcgttcttgatgaaaatggaaatattcatgcagtggcagacggccgtggagatgattctgttgccgtggaataaacaggtcagattatcaaaaaatacagtttcggcttcattcttcgaatggagccgaaacttttttaccaccttataagaccattcctatagattcttttcaatgacttttgtcatgttttcagataaattttcttaattttcgcccttaaaaaaacaaaacgactgttctttgaaagcaaaaaaaatatacaatcagctttatttccaggtgattatcgccataattgcaggtattcttcttggaaaattttatcctgaactgggagaaaagatgaaacctttaggggatggattcatcaaattggtgaaaatgattatcgctccggtaatcttcattacacttacgttgggaattgcccatatgaccgatttaaaaaaagtaggaagaattgcaataaaggcaatgatttactttttcactttttcaacccttgctcttattatcggattaatagtaggaaatattctacagccgggacatggtttaaatattaatccttctactctttcgggtgacgtttcacaatatcaggccaaagctcatgaatctactcttacgggttttattatgaatattatcccggagactttattcagtcctttggtgggtgataatattcttcaggttctgctggtggctattttaatgggagttgctttggttttaacaaaagaaaaaagccagaaagtaactgattttttacaggatctgtcaaccccggtttttaaaatcgtacatatgcttatgaagcttgctccaatcggagctttcggagcaatggcttttacgatcggaaaatatggacttcattcagtactgaacctgatatttcttgtcggcacattctatattacctctattctttttgtcgttatcgtattgggggctgtggcatggtataatggatttaacattttcaaatttctcttttaccttaaagaagagcttctccttgtcctgggaaccagttcttcggaatctgccttaccgggaatcatggaaaaacttgaaaaagcaggctgttcaagggcaattgtaggcctggtagttcctaccggatattcttttaatcttgacggaaccaatatctatatgactcttgcttctctttttattgcacaggcattaaacattcatcttcctattgaaaagcagctcatgctccttctggtagcgatgttaagttcaaaaggtgcagcaggtgttacaggcgcggggtttgttactcttgcagcaacattggctgtagtcccggaaattccgattgcgggaatgaccttgattctcggaattgacaagtttatgagtgaatgcagagctttaacaaacgttattggaaactcagtagcaacagttgtcgttgccaactgggaaaagcagctcgacaaaaaccagcttcaatactgcctggaccatccgcatgatgttgagaaaaagcttgaagggtaagcaggtagcaaatgggagattaaggtagcaggttttaggttgaagggattagcaattaaagactaaaccaaaaaactttaaaccttgaaccttggaccttaaatcagaatattcagacttgaaggctgtaccttaatgtgaatcggtgatttaattttattgaattcaccatccagatgccagtttttggtattgactttaaatgatatttcagagacaggaagataagtgacatattcatcatctttcaatcttttggtaaacattctgaaagcaaaaagcgcagaatacgtaagcggaaatttcttcaccagaaccatatcaaccaaaccatcacttttgctggctttgggagcaatgtatgcattgttaccaaactggcgggtattggcaatgttcatcatcagatatcttccattgtactgctgataagcttcatcaaaaaactttactttaattggcttataattgaagaaagtcttcagggaaactttgatgtaatttttgaatccgcggcttgttttttcaaattcctttacaacctttccgtcaaaacctgttcctgagacattgatggaaagcctgtcgttcacagtaaaagtatctattttcctggagttttttgcttttattttttccaaaagttcatccaggtttttgctgaatcgtgtctcattggaaaatccgtttccagagccggccgggaaaattgcgaggattttctctgtattaataaggtttttagctactgtagaaatagtaccgtctcctcctattgccacaaaaatatccacttcctcaaaatgagcctgaataaactcatctgttccgggaatagattctgacacgtaatacaacgggtctttcacctttgttttaagttcgttcaaaaacggctgatagttttttttggccgaaaaaggattgataataaaagctactttgtccatcaccacaaaattaaaaaatgcttccagaactggaagcattaatttatttaattttcattctttctttgaattctgcatttaaggtacctttcagatcttcccatgaaacaggaattgtaatatcaccggccgcgaaagctgcaatttcataaggactgtagtgaaaatacaggtttttgtcatcaaaatagaaattatcagaagccggaattttatctaccaataacatttccgaattcttaacttctccgtcgccatccatcgttccgctgttaattttatcgatatttttcatcagaatggcttcaattttatttttaggcattgaagtaatatcttttaattccagttttctgctgtttttaagatcaaaaaccctttctgaaaatccgtaattatcatgagctcctccttcgtaaccgcttcctaaatactggatatgcatataaccatttttattggaaatcaggttcatatgtgagcttgaataccaattctgggcatacgtcacatctgaaagccagtctttattatcgttttttacaacattgaaatagtcattcttttctttatcaagataagcctgaagcccggctttggaaaagtctttgattttttcattctggaaatagatgctgtccagcagtttcttatcttttaaagtagggaaaaccaagagctttgaagtgaagctcacttttaaggaatctgtaatttttgtagaatcatttacttttacagaatctactacaaattcttctgcagctttgttttctgttttttctgcctgtcctgttgtttcgctttttttacaggcagccacggccaggaaagaagataatgctataacagcaatcgtatttttcataatttattttttgatatcaaatacaaaaaccattcaaaagatgaatggtttctgaaaattttttattttttatttaaatcgtactaaaaaattactttttaacaaggctgatcacctgattttcaaattttgaagcaactccccagatttgtttaaatgcgggataatattctttcggatagtctgaactgttaacctttgtggttgtagtcacctccagcttatttcctttttgttgtacagaataggtataggctatttctttatcttccgttacaatctttttctctttaggcatttcctcaatcacatatccatcaggaatttcaagaattacctttttaactttggttataggagatccgaaatcgataggatattttcggacttcagtctgatcaaattcattggaattcttatttaaaaaaagcattggattaataatcattttctttcctactctgtcaataaggtttgttgaagaaaacttcatactgctttcaaattctccgttttccaatacttttgaatcaatatccgtgaaatctattgagaaattctctttatactgctttttatatttttccggattatcatcatagctgtctttaacatacatggcataagcaccagtatctttgtctgaataggttccggaaatacttccgtcatcattaattctggcattcacggtaaggtaagtattgcttgatttcagattagccatttgaatctgcagtgccttatctttggttaccaggattccatactggttccagtttttaaggggaatttcatccaatgaagactgcttggaggtggcatcataaatatgtaactgatcatccagcttaacagtagccaatacaaaattcatattggatacgttaggagacaccagattgataagaccgttttctacggtagaaataaccaaaggatcagctttaagaccagcttcgcgaagcatcatcacaagaaaaagattaatttctgcatcattccctgttttggtttccaaaagcttcttaatcccgtcttcagtataaattcctttatctttattccaggtaaaagttttctgtacgtatgaaaagatagcatttgccttttcaaggtcagtcttcatttccgaaactccggcaggcatattttcttttgcaagttttgttcttttcagttctcctccaaagtcttcactttcataaagtctcttggcaatctggtcccatgaagatgaatacagcttaagctcaccaaaattggtagagttcagctcggcacttatttttgttctgaaattcctgtcatttcttacaaatttctccgttttaaagccggttaaattttcataagcaaatctaaaggttttatatgaagtaccatacaactgcctctcctccatttccctgtatttaggtgtaagtcctccggtatagtttacattataagacatattgatgggtgcatctaaaacatactctgtattcagtgaaggggtatcagattctatcagcacctcaggaatcataaaccggaacggagatacaatttcatactgatattctataaccgatccgttttttacgcctggaaaagcaaattttgtcagcgtaacatatttattctctttacttttatattgagaactcttttctacctttaaaggaacagccgctccattctcaagattgtaggtaaatgccttgaacttccccagtgattctctgttgcttccaacattataaataggaatttcgagattcaaccagtcttcagctttatctttatcgtatatcttcactctataaaaatatcttttgtgaagattaccggtattggcatctaccataaaataagcagatttgtacaaaatttcggcaggtgcattttcatccaacaaagattttgctttggacagatctgcctcgttaaatttaggtggattcagaaattcatatttcttttgagcgttgagtaatattgcattggcagagcatagaagcaatactattatttttttcatggttatatttttgttattaaaatttttgaattgtccatattcagaatcttttttctgaaattgatatagtcattatacttttctttcggatataatcctttattaatctgtatcttccgggtcaccattacctgtccgtcacctttaacaaaacttagcttataggatccgaattcagaagtgatatttgagttgtcaggaatttcatccactttatagcctaaaggaagaacaaaagcaatttcatactcgtcctcataagacatccctacttcaaaaggaagctcacggttttcatccgttttaaagacagcatcggtaaaaattggtacagatctgaaaagaaggctgtttccggctttcttggagaaattattggtcttgaaatccagatcataagtaataacggcattgtctctgtcgttattaaaatttttcatttcaactttttcaaagtttaaaatgtcaaacctcctttttatagcatcatttttttccttaggatcaagattgacaaaacttaagttgtagtcatactgatttccggtataggaaaagctgccgcttcctgtaatactgttatcttcattaaggttgactcttaatttctgtttttccttattctgttccgctttataaacaggtgtattgataagttctattcctttcggagtcacagcaagtacatttctgtcggtggtactgtaacttaaatggttgaaagcaatttgctgagaggtattttccagccatatatttcctttttctgtaggaaccataagaataatatggtttccacccatagcaggaaattccggatcaaaggaaacctgtgaccgtccggaattgatgatacaataattagaaggaattcctgcttcattcaaaagaatcttcatatagttggtaagtcccttgcagtcaccatacccttttttctgaacttcatccggcagcatgggttgccagcctcctattcctaatgaaacagctatataccgggttttgttctgcatatactgataaattttcttaactttatcttcaacagaaccctgtaattgtaaagacgcaacctcagctttaatagcaggagtagatgcagaaacaggaaccagaagatcattgtaaatccaggttccgaaatctgtccagttattcaaagttccctgctttcctgccagactgaattttgccagagcaaagttgaccgcaggtaagattttaacaggctgtgggatcataaaagcatcatcaatggcaggtacatttttataggtatatgttttatcattgccactgccgctttctatcacggaggtataattgtattttgaagggtaaattttagatctgagttctattcccgaggtgttaacaattttaaactgtgcttcttccagtgctattttagtagaagtaaagggcacaaaatccgggatgaaaacagtatcttcatcttctgcttcgtaagaaaaatcaacagtataaggatattgaaccggtgtatatgaataaaccaatatcctgttatcagaataaaaaactccctgagggttgttcgctacatctttaaaatcagactttgaaacacttttaattttcttccctgattcatcatagattgtaacctttatattcgaaatactttttgatttatcataaggaatgtaagctactgcctcctcgtccccatctttattcaaaactgtagataccttattatactgatattttatttcatcaattttgttgatctgaacggttgtaaaatcctttcgtataacaacatcagcgtttttctttaagtttaccggaatcgcagaagcaggatagctttgtgcaaaatataatgaggcggtagataaagccccaaggactaatattttcatcatagttattaagatgatgcaaaaataagaaaatcttaataactgttaaaaaaaatataaaaggcttcaaccagtgaagcccttaacctaatacttaaaaaagtactgttttgaaatgtacctataaggctatgaacacattatcaacttttcatgaataatttctgaaaagttaaagcagaatatttttattcattctatattgaaagaagaatatgtattctaccgcatgaagggataagcttcatattgtctgcatttcaaatttagaataatttacgattcatataattcaaaaggtgtagaattaatatgaaacagaggtaaaattaattctacaaataattataacaataaaaaagacctcattgctgaagtcttttaattttctctttcttatattatttaatcatttggaatacgcttgtcatcgaattgatcacttccaagtcccaataccggaataaaaataaatccgaaaaggagaatcagaatcgtgtaaagcggtgtttcttttccaaatcctttggcaagtctgtcatatacaacccagcatgcaaaaatattgaccaatggaataaagaaaaggatgatccaccagattggttttttcacgatttccagcaatacgattgtattataaataggaataaaagcagcccaggcatcctgtcttcctgctttctgaaagattttgtacatgcaatatccatagaatatatagcacaataatcctaagaacatagctcctattcctatgcctgcagcggctgcgccagacactgcatctgtcccgttataaggatctgtttgtaaaagagttaacatattatttgttttttgatttgtccaaatataaaaaaagcttccaaataatcggaagcttttttattatatttttaaaaacgtttatgcatcaatttttgcatattttgcatttttctcaataaattctcttcttggcggaacctcgtcacccatcaacatggagaaaatactgtcagcttccactgcattatcaatggttacctgcttcagaattctgtgttccgggttaagggttgtttcccaaagctgctcagggttcatttctccaagacctttgtaacgctgtacttctaccccttttccgtccggagacatttccagagtaaactcttcacgttctttttcgttgtaagcgtatacttttttgtttcctttctttaacaggtataaaggtggttgagcaatatagatataaccgttctcaataagctctttcatatatctgaagaagaaagtaagaatcagtgtagaaatgtgagatccgtcaatatcggcatcggtcatgataacgatcttgtggtatctcagttttgataagttcaatgctttgctgtcttcttctgttcctacagaaactccaagagctgtatagatatttctgatctcttcgttatcatatactttgtgaagcatagatttttctacgttcaggattttacctcttaacggaagaatagcctggaagtgtctgtctcttccctgcttggctgtaccccctgcggaatctccctctacaaggaagatttcagattctgccggatcttttgatgaacagtcagatagttttccaggaagaccggaacctcccatcggagattttctctgaaccatttcacgggctttcttagcggcttgtcttgcttttgctgccaaaaccactttctgaacgatctgcttcgcttcatttggattttcttcaaggaaattagtaagcatttcccctacaattttatctacagcaccagaaacttcagagtttcctaattttgttttagtttgcccttcaaactgaggttccattacttttacggaaaccacagctgttaagccttcacggaagtcatctcctgtaacttctactttttccttctgcggaattcctaaatcatcagcatatttcttaagggttctcgtcaaagcacgtctgaaacctgccaggtgagttcctccttcatgggtgttgatgttgttaacgtaagagtgaagattttcgttgaaagaagtattgtaacgcattgctacttctaccgggatatcatctctttctccttccatgaagatcacgtgctccataatggattcacggttaccgtcaatgtaagcaacgaactctttcaatccgccttcagaatggaaaacttctgaacggaaagatccgtcttccaatttttctctttcatcggtaagggtaatggtaatccctttattaaggtaagaaagctctcttaaacggcttgctaatgtatcgtaattgtaaactaattctgtaaatatagtatcatccggctggaaaaactgcttggttcctcttttttcgctgtgaccaatctcttcaacaccggtctgcgcttttcctctggaataaatctgctgataaacgtttccgtctctgtaaacagtagtgatcatctcattggaaagtgcattcacacaagaaactccaaccccatgaagaccacccgaaaccttataagaatctttatcgaacttacctccggccccgattttagtcattacaacctcaagggctgatttctgctctttttcgtgaaaatcaaccgggatacctctaccgttatcacttacttcaattccgtttccttccttgatgctaacgaagatcgtatcgcagtaccctgccaaagcttcgtcaatagagttatctactacttcataaaccaagtggtgaagtcctctgactcctacatcaccaatgtacattgaaggacgcatacgaacgtgctccattccttccaatgcctgaatactactagctgtatattgtttttgactcatataaaatattaaaaatcctgctcagtgcaaagacttacaaatatcgtgatttttttcgaggtatgaaagttaaaaagtgtcaaaaaaatgtggagttttctttagaaaaacataaggattagtgagccggtaaaagaaacaaaattaaaatgtattggtgagatagcaactgttgtaaatcatattcatcatcaataatttatgcgtaaatttatttactgaaaagttgaaattatggatgattttatagcagcacgtgctcagatggcactttctctgggctttcatatcatattctcctgtgtgggtatggtgatgccattcctcatggcttttgcccattggaaatatcttaaaaccaacaatgaagtatataaaggattaacaaaagcgtggagcaaaggagtggctatcctttttgccaccggagcggtttccggaacaatgctttcctttgagctgggacttttgtggcccggttttatgaaacatgccggtcctattttcggaatgcctttttctctggaaggaacagccttttttattgaggcaatagccattggtttctttctgtatggatgggaaaggttcaataaatggtttcactggttctgcggatttcttgtggggctaagcggacttgcctccggaattctggtggtggcagccaactcatggatgaattccccaacgggttttgattatatcaacggacaataccttaatatagatcctatcaaagctatgttcaatgatgcatggtttcctcaggctcttcatatgacggttgctgctttttgtgcaacaggatttgcagtcgcaggagttcacgcttttatgatcatgcgaaaaaggaatattgagtttcataccaaagcgtttagaattgcggtgggttttgccctgattggagcatttggtgcgcctttgagtggtgatgttgcagccaaatccgttgcggaaagacaaccgatcaagcttgcggctatggaggcgcattttgaaactgaaaaaggagcttcattcgtgattggaggaattcctgacgagaaaaatgaagaagtaaaatatgcagtgaaaatcccaaaagttttaagctttctggtaagtaatgatttcaattccgaagtaaaaggtcttaaggatttcccgagagatgagtggcctccgattgcagttgttcattatgcttttcagattatgatcttctttggtgtggttatgattgttatcggagctgtctatttgtatgccttcttcttcagaaaagaatggctgagtaaaaactggctgttaaaaaccttcctcatcgcaacgccttttggatacattgcgctggaggcgggatggaccgtaactgaagtcggaagacagccatggattatctatggcattatgagaactgcagatgctgtaaccccgatgccgggaatacaatattcattctatttcttcaccgcaatttttgtatccttatcactgattctgattttccttctaaaaaggcaaatccagatggtaccaaaactttatgaccctaccgattctcagtttaacgataaaaacaaaaaatcatgatttacattgtaataggttttctctggctatccatttgtctttatattattctgggaggagctgactttggagcaggtattgtagaaatgttcaccaataaaaaagcccgccataaaacccatgagattatgtatgaatctattgctcctgtttgggaagccaatcatatgtggctgattattgccatcgttatcctttttgttggctttccggagatttataccactatgtctacttatcttcatattcccttagtattaatgcttttaggaattattgcaagaggaacagcttttacgttcaggcattatgatgctgtgaaagacaattggcaggttttatatacgcagatattttattatgcgagccttttgactcccttctttttggggttaattgcagctgcaacggtttcccactctattaatcctgatgcaacaggttttctggatctgtatgttttcagctggctgaactggtttggggtttctgtgggtttatttactgtagcattgtgtgcttatcttgcgtctattttttcattaagagaaacccgtgggaaagaagaattgctattaatgataagaaaatcaaaacaaacaatgatatttgttgtgattacaggaattctggtatttgctactgcttacctttcagatattcctcttttgatgtgggtattttcaaagcctttgggaattatggctattgcttttgctactgttgctttactgcttattttaagagcactgaatacccaaaaattacttccggtgagagctcttgcaggctttcagatggtaatgattcttgtggccgctacctatcagcataatccggatattattcttttaggtaatggacagcatctttcattactggaacatatggctcctgaaaaaaccatcgctgcattgggctgggcattgatgctggggtctttatttattctgccgtttttattttatttgatggcttctttcagtaagcttagaaaataatattatgaaaggttataaagacaaaactgaacttattgaagaaattaaaaaaaggttccttctttacaacaaggaattcgatgatattaaagaaaatgaaaaagattggctaaaagtaggggttgataaaacaccagcccagaatatatcctaccaggttggctggacccaactgctcctacagtgggaagctgatgaaaagaaaggaaaggaagtaaaaacacctgcccctgaatataaatggaataatttaaaaggattatatcagtctttctatgagcaatatagctcctataatctggcagaacaaagagatctcttacaaaagcaagtcgatgaaattataaaatggattgaagaccttgatgataaaatcctgtttgaacctgagcaaaggaaatgggcaacaacacctgctaaatggcctgtatggaaatggatacatatcaatacagttgctccttttaaaaattttagaatacagctccggaaatggaaaaaagaaaaaggtacagaataactctgtaccttttatttttatttctttatcaattttgtctggtgcctcatttggccattacagaaaataaattcgggattaaaggctcgaagctatataaaattatctacttcctactttcagctgcccatctaattttcttaaataacctaatcaggatccagattatttcatgatttatttttaaaaaactcatcaattttctctgcgcattgtctgccttccgcaatagcccatactacaagactttgtccttttcgggcatcaccacaggtgaaaattttatcctgattggttttatattctttattatttccgattaagttcccttttggatccaggtgaatatctaatgcttcaaccagccctttatgctcaacatgcgtatatcctaaggcaataaaaataatatcacattcgagtacaaattcagatgctggtttttcagtatataagttccattttccttcatcagaatctttagtccattctgcttccaccaggcgaattccttttaggtttccatgttcatctttcacaaattcttttgaattcacagaccacatacgatcacacccctcctcgtgggaagaagtaatctgcagtagcgcaggataagtgggccatggcatcgtttcatcccgttctgttggttgcataggtttataataaatctgatatacaatttctgctccctgacggttagaagttcctatacaatcggaccctgtatctccacctcctatgaccactactttttttcctttcgtattaatttcttcttcttcaaaaggaatcccgcttacttttttattactttgtttaagaaaatccattgcgaaataaataccttttgcatccctgttgggaatgaccagatctttgggaacagtacttcctgttgccaatacaattgcatcaaaattacggttcaattcttctacagcataattgacaccaacgttaattccggtacaaaattcaactccttcttccttcatccactgaactctgcgctctacaatatttttatccagtttaaaatccggtattccaaaccttaataatcctcctatttcaggatctctttcaaaaactgtagtactataccccatctggttcaattgatatgccgctgccaatccagcaggtccggaacctactaccgcaacttttttatctgttttcagcttgggaagtcttggcttggcaaaacctttctcgaaagctatttctataatattcttttctatttcctcaatggtaacggccttatcgttaattcccaacacacatgcactttcgcagggagcaggacaaattcttccggtaaattcaggaaaattatttgtagatattaaaatctgatatgctttttgccattgttttttatatacggcttcattaaattcaggaatgagatttcccagcgggcaaccactctggcaaaacggaactccgcagtccatacatcttgccgattgacaattcaactgctgatcagaaggcttctgaataaattccttataatcctttagcctcttttcaacatccagtttagaaggaagttccctctcatataataaaaatccatctatcttccccattaggtaatatcatttatctggttttcaatcactttcttatattctctcggatacactttcgtaaagtgcttacaactgttatcccaatcacttattatatattctgccaatgtgcttcctgtattttcaaaatgttccttgatcagattaaagatcgattctttatcatcctctgtaatagattccagatccgccatatcaggattaaaatgatattctaaggttttatttacatcccatacataagcaatacctccgctcattcctgcgccaaaatttcttccgactcctcccaggacaataactttccctccagtcatatattcacatccatgatcaccaattccttccacaactgcagtcgctccggaattccgaacggcaaaacgctctcctgctatgccattgataaatacctttccggaagtggctccatataaagcaacattgccaacaatactattttcattggcacggataatagcctctttatgtggaaaaataatcagctgagcaccagaaagccccttccctaaataatcattagcatctccttccagacgcatagttatccctttattacaaaatgctccaaagctttgccctgcggttcctttaaaattaaacagcaatgaatgttcattcattccctcagacttataaattttggttaattcgtgggaaagaatagtaccaactgtacgatctgtattttttatatcaaattcggcttccatcgatgtattattttgaagggcgtattgagccgcttcaaccattttccaggaaatggaatgatccagacccacatcctgttcttcagatttaattaccggcaaatcggtttctattttataaagcatcctgcttaggtctatcctttgatgtttccagaaggtaatatctgtttttctttcaagacattgagactgccctaccatttcatcaatggtcctgaaacctaaattagccataatctcacgaacttccatcgcaagaaatttaaaatagttcaccaggtgttcagcttttcccttgaatttttttcttaattcgtccttttgagtggcaattcctacaggacaagtattcaaatgacatttcctcatcagtatgcagccttcaacaatgagcgcagaagttgcaattccccactcttccgcccctaacaaagtagctatagccaaatcgcgtcctgttttcatctgcccatcaacctgcagagtaactctttgtctcagtttatttttgatcaaagtctgatgggtttcagccaatccaagctcccaaggcaaaccggtatgacggattgagcctaaaggtgatgcacctgtcccaccatcatatcccgaaatcagaatatgatctgcttttgcctttgcaaccccagaagctatagttcctactcctgcttttgaaactagcttcaccgataaccgggcatggcgattagcattttttaaatcaaagataagctgagctaaatcttcaatagaataaatatcatgatgtggcggcggagaaatcagtccaacgccaggtgtcgagtgtctcgttttaccaatccatgaatccactttatccccggataattgcccgccttctcccggcttagcaccctgagccatttttatttggatttcatctgcttctgcaaggtatctggcagtaaccccaaatcttccggaagcaacctgtttaatggaagaacggaggttatctccattcttgtcaggtgtatatctgacttcatcttctcctccttctcctgtattactttttgcccctatcctgttcattgcaattgccaatgtggtatgtgcctcccacgaaatagacccaaaggacattgctcctgttgcgaaacgtttcattatgttttctatgggttcaacttcttccaacaaaatgggttttctgtcatttttaaattccagtaatcccctcaatagggaggctttacccatttgctgattgacaagtcttgaatattttttaaaaatgccatagtcattgttccaggcagactgctgaagtaagtgaatggactgtggattaaactgatgatattcattattacttctccaccggtaaatacctcctgtatccagtaatgagttttccatatcttccctgaatgcatcctgatgttttatcaaagcttccttcgcaatttcatcaaatccaataccttcaattctggaaacagctcctgtaaagcacgtattgaccacaagtttattcaaccctataatttcaaaaatttgtgctccatgataagattgcaaagtggaaactcccattttagaaaatatctttaaaagcccatctcctactgcctttttataattatcttttagccttggtaaatcctcttcttcaaattccccatcatcaaacatttgtctgatacttgccaatgccagataaggattaattgccgttgctccaaatcctaataacgttgcaaaatgatgaacctcccaaacatctccaacctccattaccaaaccgatctttttacggataccttttctgatcaaatgatggtgtactgccgaacatgccagtaatgaaggaatagatgcatgctgagaatccagtgaccgatccgaaagtataatgacttcaaacccatcatctactgcatctaccgcatacctgcaaatcctgtcgatcgctttttttagttcaccttcttttccttttgcgttaaaataagtataaatcgttttggcttgaaatctacctgtatcaacacttcttaatttttcaagctgattattattaataacagggttgtccagtctgatagaatgtgcaaagtttttatcctcttctaaaagattgccatttcctcctataattgtagtcaaagacatcaccagtttttcccttatcggatctatcggtggattggttacctgggcaaataactgtttgaaatatgagcttaagtgctgtggcttctcactcaatacagctaaaggagcatcaaaccccattgacccaattggttctttaccgtgagacgccatttctttaatcactccatccagatcttctctggaatatccgaatgctttctgatacttaaaaatatcttctgtctgaagtttattgaaccgaattttagggttgggtaattcggtgatattaatcctcatactttccaaccattcacggtagggttttgaggtacatatttctttttttaattcatcatcactgatgattgctccttttttcatgtctacaagaaacattttacccggctgaagatgcccccttctaattattttttggggatctacagataatgctcctgattcggatgccataatgaccaaatcatccgatgtaatacaatatcgtgagggacgaagcccgtttctatccagagtagctcctattatatcgccatctgtaaacgaaatggatgctggcccatcccagggctccatcaagcaagcatgaaactcatagaaatcttttttgtaatgttccatctgctcatggccatcccatgcttcaggtatcagcatcatcattgtatgaggaagcgaccgtcccgaatggtacagcagctctaccatattatcgagatatgaagaatctgattgccccggttttgttaaaggaagaagcatatccatttcctgaggagtaaaaaatgggctttggaacattttttcagaagatctcaaccaattaagatttccccctaaagtattgatttcaccattatgcgctaaaaacctgaatggctgtgccaggctccatgtaggtgaagtattggtggcaaaacgggagtgtaccattccaaatgcggaacgaattttaggattggtaaggtctttaaaataattccgaacctgaatacttctcaattggcctttataaataagctttttacaggagaaagaagctacataaaacccaataggatcattatttgtaatactggtcatctgatgagaaatataattcttaaaaataaatagctttctctcaaaatctttttcagtatccacatcaaaaggacgctcaataaaaagcatctccatcactggttctacactctttgccaaatctccaagatcaatattactcaccggaacaggccgatatcctaatattttaagatgtaacttatctgcagactgtgcaatgacctctttacattcttcccgaataaaattattctgagaaaaaaataacattccaacaccgtaatatccagattccggtaaatctattccgacgtttaatgcctcatcatataaaagctcatgggggatctggatttgtatccctgcaccatccccggtattactttcatatccggtagcaccacgatgctccatgttctccagcatggtaatagcatcacttacaatcttataactttttactcctttaatgttcgctacaaaaccaactccgcaggaatcaaattcaaattcaggttcataaagaccctgatttttttaaaattttctggatttttttttcgtgttgtattcatctacatgttcattttcatatcaaatgtagtaaaaagaacaatcttaaagaatttaaattacatttattttattaaaaagcattcaaagcatagttttatcctaaaaaaacaaaacaataaataaacataatatcaagaatacagcaaaaacataaatattagataataaagtatatttttttattgaggctaacaccggacaattaccggattactttaaggaattactgctggaaaaaagaaaaaggtacagcatagcactgtaccttttttatttatattttctgagaaattctaagctaatttcatcaaaagattttcgtcaattttctcaactttcacaatattgttctttgtcaaagttttggaagctttatcccattttttaccggataactggcttctttcttttacttcagccaaagccatcggctcttcctgagaattaaggatttcaaggattactttttcgtcctcacccaattcaatctgcggtgcagctttttccggtctcatctgagggaagaataatacttcctggatagaggcattatttgttaagaacataatcaatctgtccattccgattcctaatcctgaagttggcggcataccgtattccaatgctcttaagaagtcctgatcgataaacattgcttcatcgtctcctctttcagacaatgccatctgtgcttcaaaacgctctctctgatcgataggatcattaagctctgaataagcgtttgcgatttctttaccacacaccattaattcaaaacgctctgttaagccttctttgcttctgtgtttctttgttaatggagacatttcgatcggataatctgtaatgaaagtcggctggatgaagtttccttcgcatttttcaccaaaaatctcatcaatcagttttcctttacccattgtctcattcacttcaataccgatagacttagcaaaatcatataattcctgctcagtttttccagtaatatcaaaacctgtaaatttcaggattgcttctgtcatagaaactcttgggtaaggcgctttgaaatcaacttcatgttccccaaaggtagcttttgtagtaccatttacctggattgcgcagaattccaataatttctcagtgaaatccatcatccagttgtaatctttgtaagccacatagatttccatagcggtaaattccgggttgtgggttctgtccattccttcgtttctgaagtttttagagaactcatatactccgtcaaaaccacctacgatcagtcttttcagatataattcgttggcaattcttaaatataatggaatatccaaggcattatggtgcgtgataaacggttttgctgctgctccacctggaatcgactgcaggattggagtttccacttcaaaataacctgcatcattaaagaatgttctcatggcattgaacagttttgttctcttcacaaaaatttcttttacctgcggatttaccgttaaatctacataacgctgtctgtatcttaattcaggatctgtaaagccatcatgtaccactccgttttcgtcagttttagcctgaggaagaggacgtaaagcttttgtaagaagcgtaaagtttttcactaaaacagtcttctctcctacctgcgtggtaaacaattctccttcgataccgataatatcaccgatgtccaaaaggtgcttgtatacttcgttatatagttctttatcttcacccggacagatctcatctctgttgaaataaacctgaatttttcctttagaatcctgcaattctgcgaaagaagctttcccctgaattctgcgggacatcaatctaccagcgatctttacctgtttactttcagaaaaatcctgttttatagattctgtagtatctgtaattgtatactcatccgcagggaacgcattaatccccatttcagtaagcttgttcagcttttctcttctaatgatttcttgttctgataattgcatttcttatttttctaaaagcgtacaaatttaggcatttttgacttgaccgtcaatggcttttttaagaaattttaaaaagtggtaaagatgcgggatattgggttcgggataggtgtttagaaatgcaagattacagatttgaatgattgtgctataaccttaaactttgaaccttggactttgaattttaaataaaccagctttttctgtctttttgaggaataaatgtccaggcaagtattctgcttattttttgtccctgggccatatcgatggttttcacttctgcagcttttactttctttaaaagattcgtcagtttattgagattatcttttttagaaaccaggcatgtaaaccaaagcacctgtgttgaaaataatgcactttcatgaatcatctttgtaataaatgccagttcaccaccttcacaccatagctcagactgctggccactgaaattaagaagaggtttggatttctttgattgatgaagattttttgtttttctgatatttcctttcatggcagactcctccgaatcatgaaaaggaggattgcacattgtaaaagttaatctgtcttcaggtttgataatattgacaaagatatggtctgcatcaggttgacttttcagctgaataaccgaggaaagatcttcattttgatccagaatatgctgggcattttttaaagaatcctgattaatatctgttcccagcattgtccagccgtaagatctgtgactgattaaaggatagacaagattggcacctgtccctatatccagaccttttacagaattacctgtgggaatttcatcaagctgttctgccaagagatcggcaatataatgtacataatctgcccttcccggaatgggaggacaaagattggtgtccggaatatcccagcctttaatatgataaaaatgtaagagtaaagctttattgagcagtttcactgcttttggaatgctgaaattaatggttaccgtttgataagcatttgtaaaaacatagtgtttcagttccggcacacaagaaataagctgatcaaaatcataaggattacgatgcaggtttcttgtgtgcagactggatttttcagcggacatattttatttcttctgactcaaaatatattccaccatttttttggcatcttcttttgacacctgtggatgggcagccataggcacacttccccatactccacttccgccttctataattttggaagcaagcagctcggtatccttttcagaatatttccctgcaatttccttataagaaggtcctaccattctttcattcacagagtgacatcctgagcaatccaatgtttcgatgatctgatcaccggaaagattagattttgccggttctgaaacagtagatgtttcagaagaagctgccacttctgctgtattttcttttttagaacaggaaaggatcataaaacccgttattcctgccaaaagtatttttttcattatttcttcgctgtagaatctgttttagcagcttcaggtgcaggtgcagccggagttgcagcagctggagcagcagttttagcagtagaatctacaactgtagttgcttccggttcctcaagcattgtgttgctatcctgtaaagagtgatccggcttttttttgcagcctgtcaataataaacctccgataaatgcgattgctaatacttttttcatttttttctaatttggaagcaaaaatataaaaaataaacttttaaacttatgacaaatgttttctttgaggaaatatttttaaggtcatcatcttaatcaaacaataaaaataattcaaacatcggagaattttaaataagttgttatttttgcagatcggataatccgaaccaaaactcaacgtattaattgaaaatgtatgattaaaaaaaatgtatcaggtacaacgctctttgttgtattggcttccctccttctgtcatgtgacaactcctcaaacgagccgcaatcagaatattctgataaaattgaatcggtaacgcttttaaaaacaacaaaatcctgggacgggacaacgtatccagcctatccttcatcacagccggaaatctcggttcttaaaattgccgtccctcccaattcggctctgaactggcataaacatccggtcattaatgcagcatatgtagaaaaaggcgaaattcagattgaaagaaaagaagatggcaaaacacaatgggtaagaaaaggtcaggtactgcctgaaatggttaataccggccacaggggtaaaaccggcgaccagggagcaaccctgattgttttctacagtggaacgcctgacattcctttgtctgagccggtacaataaatagttcaaacctatgttcgcaaagtaattatcataaaactctatttttggttcgcaagggtacttcgttcagctaatgacaacgtcttttgctgagtgaaacgctcttgcaatcgttttaacagttatttaataacatctttgcgatctcagcgtttacataaaagattattatagttatctttaatccatggttttaatttcaaaaattctgtttttcgtcagtcatcatggtttttatactgtgatcctgctgctggtattctttggagggctttcatacctcaccaaaaaagcctggcttttaattcctatcattcctctggcaatattaaacggattcggaggacaatttctgaatgcgtggtttttaaacaaatatggtgttgaaagcacagctattatcacctctgatgtagaaacaaattctactctgaatgacatgtacattcatgattacgaagccattgtgaaaaagcaagacggaaaatataccactacttttttctctaccactactgcagccatctaccctatcagaaattcaatcagaatacccggtgataaggatatacctgtaaaatacattccgggctatgaaaaaaatattgtcatcctttatgaccaatccagggaaggaaaaattttactgcaaaatgaaaaactggctcctgttaattctgcaaaaatcaaatacgaggcagacaggacgaataaggaattcattaaagaatatattgatgcccttgaaaattatgtgaaagactatgatgatgaaaattacaataagaaaattgaggaattgcgagaggagctcaaacagcttaaataggagattcttatgttaagtttttttattttctgattttttttcgtcctggtatcaaaaaaatttctacatttgtcccatgttaaatatgaacaacaataattggtggtggctttcaaactcttcgtcgggtctgaaggtattgtcatgttgttaattacagcagaaataatcaaaaaacaatatataggctttgacggataccgttgaagcctttttttattcataaatcttaccaataaaaacaaaaagatgtttacagacacaatcaaaataaaaactgtttcgaaaaaaacactgggagaccttcatactcccatgaatatttacctcaagatcagggataaattccgtgatacgattcttcttgaaagttcagattcaaaaagtattgataataacttttcctttattgcggtaaatgcgattgccggaattgaagtaaaaaacctcaacgaatacgaaattaaacttcctgcatctgctcctgtaaagcagtttattatggaacgaaatatcacagatatttttgaagattttcgcaatattttcaaatgcgaacccaccaatgacgcaatagagcagaccgctcagagcctttttgggtatacgagttttgaagccttacagtttttcgaaaacataagccttaaagcacaaagcaaagaagttgaaattcctgtcctgagatacagattataccaatatgtgattgctatcaatcatttcaatgatgagatgtatcttatcgagaattttattgatggtgtaaaatctgagcttcaccttttggaaaaccttattaaaaatcagaatactcctgtttatcctttcgagaaaacaagtgaggaaacctccaatattacagatgaagaatatattgaactggtaaaaacagcccagaaacattgtatgcgcggagatgtttttcaactggttctaagcagacgatttgaacagaaattcaaaggagatgaattcaatgtttaccgtgctttaagaaatattaacccttccccttacctcttctattttgattacggaaattataaattattcggttccagccctgaaagtcagttaatcattaaaaacaataaagccattatccatccgattgccggaacatcaaaaagaacagggaattttgaagctgaccttcaagcaattgaagttttaaaggcagatcccaaagaaaatgcagaacataccatgctggtagatcttgcaagaaatgatcttggaaagcttgggaaaaatgtaacggtgaccaaacttaaagaaatccagctgttctctcacgtaattcacatggtaagtgaagtgactgcagatgtttctgatgacattaatcctcttgaaatggtgtctgccacttttcctcagggaacattaagcggtgcaccgaagcataaagcgcttcagctgatcaaccaatatgagaaagattcccgtgggtattacggtggctgtatcggaattataggattgaacggaacctgcaaccaggccattatgatcagaactttcttaagtaaaaacaatacattattttatcaggcaggtgccggattggtggcaaaatctgtccctgaaaatgaactgcaggaggttaacaacaagctcaatgcactgaaaaaagcagttgaaaaagcagaaaaaatagtcgaaaaataaactcaccagctatcaaccagcaacaaaaaacaaccggcaactatctaacaaaaaaataatgaacaacactataaatactcagcagccacagcttaaagttctcgttttcgacaactatgacagttttacctataaccttgtccagattattgaaagaattctgaatcaaaaagtagatgtggtaagaaatgacgaaatcacactggaagaagtgggaaaatatgacaaaatcattctttctcccggccccggaattcctgaagaagcaggtattttattagacctaattaaagaatatgctcctacaaaaagcatctttggcgtatgtctcggacagcaggctatcgcagaagctttcgggggaagcctgatcaacctgtctgaaatctttcacggagtagctaccacaactgagctggtgaaagaaaataccaaacttttcaaagatttggattcaggattggaagtgggaagataccacagctgggcagtaaatccggaaggtttcccggaagagctggaaatcactgctgtagataaagacggaatgatcatggctttacagcacaaaatatatgatgtacatggcgtacagtttcaccctgaaagcattttaacgccggaaggtgaagtgatcattaaaaatttcctattgtcatgaaaacttcagaaaatccttcagcaaccataaaagcacctcaaatgaaagaaatactgcaatacctgtttaatcataatacgctttcaaaatcagaagccaaggctacaatgattgaaattgctcaaaataagttcaactccgcagaggttacggccttcatcagtgttttcctgatgagaaatattaccctgaaagaactggaaggcttcagagaggctttactacaaatggctgtttctgtagacatcgattccagtgatgccattgatattgtaggtacaggaggtgatggaaaagatacgattaatatctctacactcgccagctttatagtggccggagccggccaaaaggtaacaaaacatggaaattacggagcttctaccactacaggttcatccaatgtactggaagaattaggatatcagtttaaaaacaactcggaacaattgaatgaggatcttgaaagagccaacatctgctttttgcatgctccttacttccatcctgcgctgcaatccgtggggttgttgagaaaatctctgggattaagaacattttttaatctgttgggtccgttagtgaatcctgcaaaacctaaatattcaatgatcggagtatataatcttgaaattgcccggatttaccagtatctacttcaaaaggaagaacgtgaatttattctggttcatggtctggacggatatgatgagataagccttaccggcgacagcaagatcattaccaaaaacggtgaggaaatctattctgcggaagatttaggtttcaatccggtaacattggaagatattaaagctggtagttctattcaggagacagcaaaaatatttatgaatatcctggaaggaaagggtacggaacaacagaactctgtaatccttgccaatgcatcaacagcactttacaacacccataaattcgggacgtatgatgactgtcttttaatagctcaggaaagccttcaaagcggaaaagcattgaatagttttaaccttttgattcattaagattcaccattcacttgcaaagcaaaattcactattgaccacattacagacacacaaaatgactatactggataaaattattgaacgaaaaaaagaggaagttgctgcagcaaaattacgcatttcccttgaccgattaaaagacaccgctttttttggaaggccaacatattcactgaaagaatccatcaaaaataaaagtggaattatcgctgagtttaagagacagtcgccatcaaaaggaatcatcaacaataatgttgagcctttagaagttgtttctgcttacgaaaaatttggagccagtggaatttctatcctcactgatcatgattttttcggaggaaatttaaatgatgttctcagtgtaagaaatgaaatcaacataccgattctgcgtaaagatttcatgattgatgcgtaccagttttatgaagctaaaagcattggtgctgatgttgtactactgatcgcatcttgcctttcaccagctcaggttcaggaatttacagacttagcccacgaactgaaaatggaggttttgcttgaaattcataccgaagatgaactgaaacattttaattcaaaaatcgacttagttgggatcaataacaggaatcttaaagattttaaagtagatctgcagcattcggttcagctgaaaaaccagcttccaaaaggcgttttttcggttgctgaaagcggtatttacagtttggaagattttcaatttttaaaagaaaaagggtttgacagcttcctgatgggtgaatattttatgaaaaatacaaatccggccaaagcgtttgaagaatttgcttctcaaatttaaaataagtaataatgaacctgccaactccgaccataaacctacaacctctgctcaaagtctgtggacttacaaaaccgggccagattcaggaattgatttctatgaatgtagatttcctcggttttatcttctatgaaaaatcacccagatatgttttgaatcacctgagtgcggaagaaatctcagctattgatcatcatggaaaaacaggtgttttcgttaatgaagaattggatatcattctacagatggtgcaaaaagccggattaaattttgttcagcttcatggcgatgaaagtgatgatttcattgttgaactaagacaaaagctgaaccctgaagtcggtattattaaagtcatcagaataggaaacaatgcagatgaaaataaaatgaaaataacgcagatttttaactttcaacggacaatctgtaacctgcaacctatcacctattttctttttgatactgacagcaaagcctttggcggaacaggaaagcaatttgactggaatatcctgaatgaacttgagattcccctgccctactttttaagcggtggcatttcagaagataacatcgaaaatattgaaatgctgaagcaacagccttttgcattggatatcaattcaaaatttgaaacagagcccggacataaaaacattgacaggataaaagaatttaaaagactctgtcaacccaataaataactaaaaaaacacacaatgatgaatatacatttgctaaaaaagacattttacaaaacactgtttccgcctaaattcggaaatgaaaaaattcagaccctgtaccattttgttgcggagaacgacagtaacacggaacattgggaagcaggcggattattgtctgatttcatctgtattattaaagattttgaagaaggagacatccagtatttttttgaaagaatcagcctttggaacagctattacctggttattatttcggataaatttttagaaaaccatgtcagatcagtagtaaagtatgacttaggattaatttatgctaaaatatttttactttatgacgattctgattcttattatttgattgataatctcgaaattgccatcacgatgtatcagtcgaaaatagataaagcaaccttaatagatttactgcacaaaattgagttgttatattataaaaaactgatcaccaaacaacaatatgattaccatcttacatttattaatagtttaaacgcatgaaatatcagataaaagaaactcaggatttaaaggaaaaggaaatagaacatattttgcagctatgggatatttctgcatggaacgccatgaaatctgcctattttattacttttttcaaagattcggaatttcatttcctgctggatgtggatgaaaatatactggcggttatgcgggtgaattttgattttaccttaaaaatagcagataatgaatattcctttgcggaggtagtaggacttgtttccgctcataaaaagaaaggatatggagcagcgttggttcgtcatttcaaagaaaatgccacacaaagaaatctggaggcgattggtttctgccattcagaacttcgtcctttttatgaaaaatgtgatattgaaatccttcatgacaaagccaaaatgatcaaagaaagtatcggctcggaatgggtgaattctgaagatgatgatattctgattttttatacaacgcaggaaagaaaagaactgctcagccagcttagttctcaaaacaatgcttacttaataactaaagaataaaaaatgaattataaaaaccccgatgaacacggatattatggagaatttggaggagcttttatccccgaaatgctctatcccaatgtagaagaattacaaaagaattaccttcagattatagaatccgaagatttccaggcagaatatcaggatttgctgacaaattatgtaggccgcgctacaccactatattttgctaaaaacctaagtcagaaatatcagactcagatttatttaaaacgggaagacctcaaccataccggagcccataaaattaataatgccttaggacaggttctgttggcaaaacgacttggaaaaaccaggattattgctgaaaccggagccggacagcatggtgttgccactgcgacagcctgtgctctactgggtttacaatgtatcgtttatatgggagaaatcgatatccagagacaggccccgaatgtagcgagaatgaaaatgctgggtgcagaagttgtggctgccacttcaggttcaaaaaccttaaaagatgcagtgaatgaagccctgagagactggatcaacaatcctgtgacaactcattatgtgatcggaagcgtggttggtcctcacccgttcccggatcttgtggcacgattccagagtatcatttcaaaggaaatcagagaacagcttaaagaaaaaatcggaagagaaaatcctgattatgtgatcgcctgtgtaggcggtggaagtaatgctgccgggactttctatcattttgtagaagaaaaggaagtaaaaattattgctgcagaagcaggaggactgggtgtagattcaggaaagtctgctgccactacatttttaggaacgcttggtgtacttcacggaagcaaaagtcttgtgatgcagactgaagacggacaggtcattgaaccgcattctatctctgcgggactggattatcctgggatcggaccttttcatgcgaatttattcaaagaaaaaagagcagaattctttagtattaatgataatgaagctttaaaatgtgcttttgaactgaccagactggaaggaattattcctgcattggaaagttctcacgcgctggcagttttagacaagaagaaatttaatgaaaacgatgttgttgttatttgtctgagcggccgtggggataaggatatggagacctatctcaaaaatctgtaaaatgtaaaaagtattcatgtaaaatgactttaacagataaaacctgatcataaatacattttatgtgaatacatcaatacaaaaaaagaaatgaaaaaactaaatatatacttcacagcaggaattccacaactggaagataccgctgatattatacagctgattcaggattccggagcagatatgatcgaaatcggaatgccttattctgatccggtagcagatggccccgttatccagaaagctcacgaactggctttacaaaacggaatgaccattgaaaaactgttgtcccaattaaagaacatcaaagataaaatcagaattcctgttattctgatgggctatatcaatccggtattgagtttcggatttgaaaagttctgtgcagcatgtgcagaaagtggtgtttcaggactgattcttcctgaccttccccctattgagtttgagaaaaattatcaatctgttttaaagcagtacaatcttaattttacctttctggtgactccggaaacctctgatgaaagaatgatctatctggattctttaagctcaggatttctgtacgcagtaagttcttcctctacaaccgggaatgaaaatgccgttttaaaaaatgaaaactacctttccagattagcttccctcccactcaaaaatcctgtgatgatcggatttggaattaaatcgaaagaggattttgaaaatgtaacggaaaaagcggatggcggtatcataggaacagcctttgtgaatattttgcttcaagataaaaactggaagaagaatgccatagattttatccattctgtaaaagggtaaaattcactaaatttgtatatcaaaaattgcaatgaatacaaatcaaaataaagtagtagaatttgaagatttagggatcagagaatatcagccggcctgggattaccaggagcaactgatgaaaaacatcattgataccaaaataaaaaacagagatcttcctgcggaacagcataccattacgcccaatcaccttcttttcgtagaacatcctcacgtttataccttaggaaaaagcggacatgaagaaaatatgcttgccggtattgataaactgaaagaaattgatgctactttcgtgaaagtaaaccgtggcggagatattacctatcatggctacggacaggttgtaggctatcctattctggatcttgaaaacttttttacagacattcatttatatatgagaaatctggaagaagtgatcatcagaaccattgccgaatacggcattcagggagagcgctctccgggagaaacgggtgtttggctggatgtgggaaaaccttatgcgagaaaaatgtgtgcgatgggagtgaaagcctctcgatgggtaactcttcatggcttcgcattgaatgtaaatacagacatgcgctattttgaatacatcatcccatgcggtatcaaagataagcaggtgacttctttaaaaagagaacttgaaagagaactgaatcctgtagagatggaggaactgaaggcaaagatcaggaagcatttcgcagatgttttccaggcagaattgatttataaatagtcaagtttaattacaatataataggcccggtttcaatagttgaaaccgggcttttagttttatcataatgttatttttattcgcatagacgatccacaacgttgttattctgcaggaatctagactcagaaatcctgtaataataaatgaggataaaataagagtttagattcctacggaatggacaaagaataaatagacttatcttattaaagaatatttgtatgtcagaaataaactatccaccttgtctattccgtaggaatccagatctcgaattctattttaaaattcttctggcctttcagaattatactattcttaagattgttttttagatttaatctatattacatagcttagattcctacggaatggacaaagaataaatagacttaccttatagaagaacatttgtatgtcagaaataaactatcgatccaccttgtccattccgaaggaatccatacctcgaaattcattttaaaattttctatgtttcaaaattctactattcttgagactgttttagatttaatccatattacatagtttagattcctacggaatggacaaagtataaatggacttatcttattaaagaacatttgtatgccaggaataaactatccatccaccttgtctattccgtaggaatccagatctcaaaattcattttatttttttgtctttctgaattctaccattaaaaacttcagatttttcagctattttcaatattataaaatcaaaacacaacagaataatgtatttttttcaaaaaaaatcttgtatatattttaatttttattacttttaatatcacaaacaagtgaactattacaattaaagagttcactaaaactaaacaccaaaatataaaaactatgaaaaaatttctgttatccatgatggcattcgtgacgattctgtcattcaatgcctgctcagattcaagtgccaaccaggacccgaatcttgtcgctaaagaatctaacgaagtcgttatgaaagatttcggtaagactgttccggtagggattgaaaaagaagatggaaaatttaaaatctcatttatggttactgcccagccgtatgaaattgcggacagtaaagaaaatgcaggctatatttccatgatcagacaggctgttgagaatgaaactcccgttcatgttttccttaaagccaacaccaataaaattgcaaaagtagaaaaagcaacagatgacgacatccgttattttaaatctgtattcaacaagcaagagagaggtgaaagcaacaaagcagtcagtattattcctgatctggcaacactcaacagtttgtttacccagatcaaaaaccaggcttgcggaacttctacagcatcttctccttgtatcaccttcagatatccggttgacggatgttacgcaagggctcacaaaatgagacaaatcctattgaacgccggctatgactgtgaaaagcagttcgtatatggtaatctgagagcttctacaggaacatgctgcgtatcatgggtatatcacgtagcaattttggtaagcttcaaaaatgcttcaggaattgttgaaaaaagaatcatagatccttcattattctccagcggtcctgtaacagattctgcatggagagctgcatgtaccaacacaagctgtggatctgcttctgtatcttcctacgccaatacagcaggaaatgtttattacagaagtccgtcaggttcattactgtatgataacaactatgtgaataccaattgtgtattaaacatattctcatccctttcaggatgttctccttccccagcaccaagtgtagcaagctgtggattttaattaatttataaagaactcctgcaattattttgatacattgcaggagcttttttatttaatactttttcattatgaaagcctggtcctatttattattactttttattatgattgcatcctgctccggtaattccggttcacagaatttaacctggtataataacgctactatttcagatatcactgcagatccggataaacctgatgaagtagtgcgtgttgccattggcatcagtgctcaggtattttatctttccaaaaaatctccggattataaagctcttatggaaaaagcaacccaaagctttaagaaaagtaaggcatataatataggtattgaaaataaaaccaatatcattaaagaaatgaaagagattcaataatcgtattatctgattactgaaatacctgcatctacttttacttctgctccatggatatatgatgcctcctccgaagccagaaacaatactacattagctatttctgaaggttctccctgtcttttaaaaggtatggtaggaattatatcttcgatagcgctttcaatttgctctccggttaaacctgtattgttaaaaatattggttttaatatgaccggggcttactccattcacacggattccccgttctgtaagttctacagctaaagttttgatgaatgactgcaccgccgattttgcagcagaatataccgaaaaattaggcatggcaatatctgttgctactgaagtattgaaaataacggagcttccgcttctcatcaatggcagcatctgctgtacggtgaaaaaagggccttttaccaaaacattgaagagttcatcgaagtgattttcatccacatattctacaggagcaaattttccgtatcctgcattggcaaaaaccagatcaacctgctcagtatattttctaacctcctgctgaagattcataagatctttcatatttccggcattggacacgattccgaaagcatttttttcaagcttgtccaaagcaatatttacagattcttcacttcttcctgtaataataaccgttcctccttcttcaatgaatttctgagcagtagccagccccattccgttcgttccgcctgtaattagtgcggttttgtttttaaatctctgcattgtttttagtttaaattctatggcaaagattgcaatactattgttttgaaaaaatccagttcttgtggaattaagagaaaaggcgaaagggcaagactgcgaaaaggcaaacggttaaatggtaaataatgcgattattatttgcgatttagcaatttaaccatttagcctttttactcttttgctttttaccattttaaagttcatcaataattgtcatcaataaaatcattcaaaattaaattgcacacaattaaattggctataaatttgtattgttaaatcagctgaacataaaagctgaaattttaaaaatcaacaagtagtttaatttaaaaacaaaaagaaaaatgtcattaatagaagatctgaactggagacatgctgtaaaagcatatgatccaaccaaaaaagtttcacaggaagaccttaacactattttagaagctgcaagactggcccctacttcatcgggattacaacctttccgggtaattgtagttgaaagccaggaactgaaagaaaaaatggtagccggagcattaaaccctgaagtgatgagagattcttctcacgttttggtgtttgctgcatgggacagctattccaatgaaaaaattgacaaggtttatgattatcatactgacgtaagagatcttccaagaggccgtttcggaagttatacagataaaatcaaagaaatatacggtgcacagactcctgaagagcattttgcacacactgcccgccagacttatattgcattagggattgcccttgctcaggctgcagaacttaaaatcgacagtactccggcagaaggattcagcaatgatgttgtggatgaagtactgggactaagagaactgggattaaaaagcgtaagtcttttgtatcttggataccgtgatgaagctaatgactggctttctactatgaaaaaagtcagaattccaatggatgaatttatcataaaaaaataataccttcatcgaatctttcgtactcaaaaaaattatggaaaatcctaaaacacccaaactggaaaaccagatctgctttccactgtacgtgatcgccaaagagattacgggactttaccgtccttttcttgatgaactcggcattacttacccacagtatcttgtgatgatgatattatgggatggagacggacttaccgtaagccatatcggggataagctgtttctggacagtggtacactgacgcctcttcttaaaaggcttgagtctaaaggatttattacccgaaaaagaaaaaaagaggatgaaagagtagttgaagtatttttagacgaagcgggcaggcagcttcagcagaaagcctgtgaaattccggggaaaattcaggaaaaactaggaatacaaccggaagagctgctgcaccttaaagacacggtactaaaaatattaaacaaaatagaaaataaatgaaaacgttatatacaacccaggtcactgcaaaaggaggccgaaacggacatgtaaagagtgaaaacggtgtattggatcttgatgtaagaatgccgaaagctttaggaggcggcaatgatgattttgccaacccggaaatgctgtttgcagctggatattctgcatgtttcgacagtgctctgaacagagtaatcagcctttctaaggtaaaaaccggggaaacaatggtaacagcacaggtaagcataggacagcttgaaaatggcggtttcggactggcagctgaacttgatgtgaacattccaggagtttctattgaagaagctcaggcattgacagaaaaagcacaccagatctgtccttactccaatgctaccagaaacaatatggaagtaaagctttctgtgaccaacaacgattaatccaatttttttaagcatagttataacgaaaggagctgtttccatggaaacagctcctttttattttttatttaacggcagattacgcagatgagcacagatgattgtggatatttttatgtatatagtatttaagaatgtcaatcatcatcaccttctgtctttcatcagatcgctcttctgataggcgtctacttttttataggaatcgttcttctctttttcttttttatcagagatcaggattccaaaaagatggtcgatttcatgctggaaaataaccgctgtaaagccttctacaatttctgaatatttctgccctttcagatccacatattccagctgaataaccttacttctgtaaaactggtctctgaaatcagggatagacaaatcaccttcaggaccaagattctgcagatcggaacgccagacaatcaccggattgataaagtattccagtggggctccttctttatcaaaacgctgtacccagatgatttttctgttgattcctacttgtggagctgcaatgcctactccgccatctgttgaaagaagagattctttcatcctttttaccagaactgcaatattgggatcaagaggatctgcttctgaagaaatgttcagcaatgttttatgctgattggaatctgtggtctgataaatcggcaaggccgtattcacatcaccctgattaataattgagagctcatgggaagtaagtttctgggcgttgagaaatccaataaaaaagatcagcagtacggaaagtttcttcatgttttttcaaatgtgataacaaaggtaaaaattgtgttgtaaaaataatttatttagcaatgaattttaagttttggctaaagccgttgcctcttttaattaaaaaaagccgggctaaagcccgaccctattgaatattttttcctaataattgaaagtctaaaaagtcttggtcatatccgcgggaataatcagattgaaatctgtcgggatataatctttggccggcactttcagttcaggatcttctgattcaaaaacggagataacagccattttcagattaggatttttctgtttgatataccagtagattccaccaaattctttgctgtgatagttcccgttataatggacgaaagtttttccggcctgatggtttttaagaatagattcagccatcgttgcatcttttgtagcctgggctgaaataaaattcatcacttttgttccttccgcatggtctcccatcatctttttcatttccggatatcccggagtgtctaaagtcactttgataggcagctgcgcaatataagttttctctttttcgcttaatgtatttaaagattcaaggccttctttggcggtttgggaggcatatcttcttgggatattggtagcaataaacttcagctttttatctttggcaaaatctaccaaaggtttataatctgttacgtagttattccataaacgggcagaatccttgaatgttttggcatcaaattttccattcagatactgatccagctgagcctgattgtctctttcaaacatttcagcccctaaaataagctgtccgttctttttcgcaaacaaagcttccgtaatttttagctgaagccaatggttgatggaactgttatgattttcaccaaaaaagaccacatcatattctgccaactcttttaccagtttttctgtctttacttcctttccttttttatcataaaactgatatgctttaaagtcctgagccttcaatgaacagaagccggctatcagtatcgctatgaaaatatttttcattttgtttttataattttaccacaaattacacaaatattctggcaactgcagatcgtttgtcataaaaaagaccgctttgaatcttacaaacaaaacggtctcattcaaattatctaattattacttttctaaagctgcaacaagatccttccattcctgaagttcaggaattccgggttttctctttccaaagaactggacgataaagtcaccttctttgttgaatacttcaatagcggttacttccccgtcttcagttggtttcttaacgatccaggcttctgcaattttcgttacatcaaggtgcaggttgaaatccggatccatcacgttgaaccactgctggtgccaaagtgttttgtttacatttcctgtgtggatctgaataattcctctgtttccaacgaaaaccatgatcggaacgtttttctctgaagcgtcttcaaggatatttactactttggcattatctattttcttagcgaatccttccggagccagtctcaaggcctgcgttctgcttactccgtattttctggtcatcatgaagaaatcatgagtgtctttcagttctgtccatgcttttttgaagccctccacatcaatttccgaatctgctttttcagcctgctttggagctacagcctcaaatacaaatgcctggttctgatcttccgctttaaatttttctacaattgtttcgaaagcggtttcattactatcttttgtcagataaatcttatgaagtgccaatccgtcttttccgaaaaactgaaggcttttcttatctccttctactactgcaaaagcaaacttccagtggttaaggaaaattcttagatcgatatcttctcccacaaaaagctgtgcatgcggactgctgaaatcaccattcagataggttccttttctttcatgaacacactcatcgttacgggtaagtgccattacttttccgagttgcccggcttctgtaaggattccctggaaatccgggttcagcaccgttacgccttctcctatgcctgtcactaataattctgcttcacttactcccagctgtgcggctgcatttcttattctgatatgtggattttctgctttcagagcttcccatttttcctttaaatcattaactaatgtgctcattactttacttttttatggttaaaattgtatatattcttcgtatggtttcgtttcctgttttactttttatttcttcttctttttcagaagttttcattcttttgaaatggcttttggaggtcagttcttccatttcgctgttgctgtataaggtgaaattaaattccgtaaacggtaatttttccatgaactctctttgcccgaatgtaagaacgaacgttccgtcatctttcaaaaccctgtagatttcatttaaaaaatccaccggattttcccagaaatacacggtgttaactgtaaatattttatcgaaggtctcatcctgaaaaggaagcttttttccttcgtacaacacaaattctgcctgactttcaaattctttattgagccttttagcttcattgtgcatggtttcagaaatatcaattcctgtgtacctgaggtttttggcaagattcattatacttttaaggtgtccggcatttccgtgccctatttcaaggatttgctggtcgtcatctatcgaaagtgttctgatactttctaacgtcatactgatgttagtggcattcatcatttcaccaatctcgatgcctttttcaccctgaggattggcaagattctgtgcgaggattttgagttcttctttttccatggttatccaaaaatgatcattgggttattcgtaataggatggccgcagatggtacatggaaagttgtaggctttactgatattttctgccgtgaaaacttcctccggagttccatatgcggaaacttttcctgatttcattaataaaatcttgtctgcaaattgagcagcaaggttcagatcatgcaaaacaacaatggcactgttggcttttttcgtgaattttttgatgatttccaacgctttatactgatgtttaatgtctaaattattcaacggttcatccaggaaaaccagtttatggacaacttcattctgtaactgcgccattaccctggaaagatgtacccgttgtttctcacctcctgacaaagaattatagtctctgtccttcaaatgaaaaatatcggtttcatagagcatattattcatcgcttcaagatcttcttttccgggctgggcatcaaaataaggataccttcccatcatgacgacatcttttacatcaagcggaatatcattgctgttgtgctgtgaaaattttgctttatgttttgaaagctccttcacattccattcctgaatagacttatttttaaataatactttctgctttccggatttcacttcatctgccagaacactcagaagacttgacttccctgctccattcggacctacaatggctaaaaattcgccatattccagggagacatctactccatccaggatacggaattctttatgtttataattaatctggtgtgccttgatcattacagtgattttttaaatttaaccaaaatagcaataaagataggtcctcccatcaatgcagtcagtattccgatcggaagttcggacggtgctacaatacttctgctgaatgtatctgccgtcaacaataaaatacttccacacattgctgataaaggcaggataaaggtattatcggatttgaataaaagccttaaaatataaggtacaatcaatcctacaaaaccaatagttcctgaaaatgctacgcatgttcccaccattaaagctactgtgataatgatctgctttttcaatttctccacattgattccaaggtgctgtgcatctttttctcccagcatcatcgcattcagagcttttcctttaggtaataaaatgatgtaagctatgatcattacaacggtcagaatgatattcttcgtccatgtggcagctgccagactcccaagattccagaaagttaaatctctgagctgttcatcttttgaaagatagatcagaaatccggtaatggagaaaccgattgctgttatcgccactccggtaagcagcatcatcactacatttgtctttcctccgcttgttgaaattctgtacacaagcatcattgataaaaaagaaccaataaaggccgctattcctaccagtgaaaactgtaccgcttcaggaagatattctttaaaatgtcctcccaaaacaatcgcaatagctgccaacaatgtcgctcctgatgtaaggccaatcaaatctcctgttgccagtggatttttaaaaagcccctgaaggctcgttcccgaaactgaaagcattcccccaattaaaatggccataacgattctcgctgctcttacatcccagatcacatatttatcacttaaggacaaagacggatcaccttttataaattgccacaggatcatgaacggggaattccctccgaaatcataaactccggtattaagtgacaggattgctatgatggtaagcagtactgcacttatgataagataaaagtatagtttactttgtgttttcaattaaaagtttatttaatgctactgctgcttctcccaatctcggtccgaaacctgataccaaacctccgtccattgcgataatcttcttatttttaccggcattggtttgtgatactcctggcattttaaggactccttcatttcctcctgctccctgtaatcctgtttcgaagaagaataatacgtcagggttggcctttacaactgcctcgggtgtcaatggtttgaaatcttcaaaatcagttacggcattttctccgcctgcaaggttaattaatgaagccattggtgtatttttaccgcttaccatcagcatatttcctctggcatagatgaacagtacttttggctttttagcaatgggctgtacttgtttcagatcagcatcaattttatcatttaatttctgataatctgtatttccgattgcttttgcaacctgttcgatcagttttttagttccttcaaccgtatattcctgtttaaaaacttcggtttgaattcctgaagatttgattttccccatcaattcaggattgatatccttatcagaagcaaggatcaatgttgggtttacagacatgatcggctcaatcgtcatcgatctcatatggcccaggtctttagctgtagcttttaaagaggctggatatgtactggtaacatcggttcctacgatttctttttcgtgtcccaaagcagctacgatctcggtaattcctccgttgagtgtcactattttattgttcgtttttggtgcttcagaactggtttctgttgtattttcttttgctcctgtttctgcttttttgcaggaatatactgcgacaagaacagaagctgcaaggatgaattttttcatgatatactattatttgattatttataaaggttcaaattcaaaattggtgtaccctctttctccttttgtatttttcatagtgttgaatctgagtttaaaataaaaaccttcagcatcttttaatacaaagaagcggtctgaatacacaaacggaaccggatttgttgctgttcccgtagtggttctccacttatctcctattgctctctggtcattgaatacaaattttgcaggttctacatcctttagtttaaatgcgctgtaagcggcatcaagacttcctgtgacatttacctgataagctcccacaccatttaaggtatttgttgtcacaaaatcagcataaaaataacttcctgcactgttgtttggtcccatgaatacctcattggtaaaggttgtgaacgcaaggtcccagttttttttcttaggctgaatttttaccggtgtacccgttttcaggctgaagaacgcaaagttgtactcagtatctttagtaatgatatattctttgatatctgcttctgctgcattcaagtcagcataacggattttgtatccgttctgagctctcaggatctgaattttcttccaccctctcgggtcgccggacaatgaaactgaacctgccccgatattggcggcagaaggtatctctctcccaagattgatcaggtaaacaggattatctgcatcattttctttgatggcatcaattcctgaagtctgagtcagaaaatttccatcaggattgtctacatattgcatgttggcagcatcaaaagttcctacctgagcaatgtctttcagacctgagatatcagcttcttttactttactgatgtctgaagcattggggactttaatcactgtcatagccagagatccgttcatgatcacacggaattcatccccagtataaaaaccaaggtcccaatctgttctgcggttaacggctgaactggtgtagtcacttaagtcaatccaaacctgattgggttctgtaggaccaccgatattcacacttacttccgatcctgtcattggaggaaccggaaccggatcttcgtctgcagagagacaagactgtgtggcagcgataatggaaagaacggacactatttttaaatacttcatcatagtaacttattatttaaaattgaaacattaatcgggcaaaatagcttctgccgtagtataaattaacaaaaccactcgctgctgtatgggctgaacctgccaccgcagtagagttcagtctcgttacatcaaatatatttttcactccggcagaaatttcaaaatgtttcttccagaaaggctgactcacgataaaatccatcatatggaagctatctacttttccaagccggaagccgcttactccatcggatacatacattctgtccggacctgtaaacttgtaataaagggcaaaattggtatctgtgcttttcagtttataggttgctgaagcccctgcctgtactaaatactggaaatctgtaggggaagaagatttcaaatcgttcatcgatacggatgttccgtttacagatccccttaaagagagggcaaactgatcttttctgaaatctacgttagctgagaataataaatttttataggtatcaagattcatgtatttgtaagtggaaggctcttttaccatcaccatttcaattctgtcccgtacatcaagatataatgcgtcaagtccataagcgatcttccagccattgtctgccgaaaagttctggttccagaagagtcctgcagagaatcctttttcaggatttaaatccggatttccctggacatcatgattaagattcacaaaataagtgtacagttcatcatatttcgggaaacggttggctgatcctataaccgcacggagatttgaattttcagaagttttatatcttgccgataaagagtaattgtactgattattgaaattttcgctcaaagaaagccttactcccggtctcagagagaatttgtctgaaacattccattctgcagaaaggaaattggaataagtaaatatttttctttttaccgcttctccaaagaaatctccagcgatcagtgcagcatatccattagtataatctaattcatatcccaactgaaaatcgaagactttgctattgaggaaattactgaacatccctcttgaataaacaacatctgtcttataataagatttttcatcctgacggctctttattgttctgttcggaatatcataattgtagtcataatattttctgtcctggttctgataagagaagtctcccaaatatcggatatgtcccaggttggtttgaatattaaactggtgaatccagcggtccgtgttgtatcttctgtctctgctttcataggaaactccgcctgctccgtcattcagaggatttctgctgacctccggattgtaaaagttgaatttttcattaagataagacagcttgtagaagaatgttgttttgtttttcgtgtatctgagtaatgctgatgcatcgtattggtctttcgggttccattcatatcctctctggttatcctgcccgaaatatttgtagcctttactttctccttcgtaccccataaactggttatggttgaaattgatactggcaaaccattcattactgatattataatctacattcaagttctggatatgtctgccgttaccctttttcttaagatcataatggtctcttatcgtttcttcctgcaatgaacctcttacacttattttttttgtaccggtctttttcgtaataatgttgatgaccccggcaacagcaccgtttccgtactcaacgcccatgcttccttttacaatttcaattctttctatattgcttaaggtaattttggtaaggtcaatattactgcccagtcctgtatcccccactaccggaatattgtctataagaatctttacatagtcaccgttaagtcccatgatattcgcggttgaatttccggagcggctatcaggagtgatctgtatgttaaggctttgattcaaaacctcggcaacgttcgtggctgccatatttttaatctgttctgcatctataacatcaaccttatatatcgatttgttaatggactgctgcatgtactgtcctgtaataacaacttcttcaattttcttttgataaagagaatccttttcttgtgcattcatccataaggctatggataacgttagaacggaaagcactttcttcttcataagggtacaaattttcgacaaatataaaacttttatttagactcattaaaaataaatatatatttttgtggaataattctaaataaaaataatctcatgaaattaaaattacttttcggaactctgatgtttacagccttaactgtgaatgcccaggtatccagcatcaatgaaaatttcaataatttcactgtcggaaataccactttcccacagtttggctggtctgccatcgttgcaccaatcaccggtgagtttcctcccgtacctccaagaatgattgtagcaggagattccaacagattcatccagtcatacgcaggaaacaacgctacgggctcttcctacctgatttcaccgcagattgaaactcccacaggaaataaaacactgacttttgatacgaccttggtatctccatctcctggccccggaagcatccagattggaatagcatctaatcccgcagatatgtcaacatttgttcctgtcggaaatcctattaatgtagcgacaatcggcactgtacagaatatcagcattaatattccggcaactacaggatcttacatcgtattcaagttcatgcctactgctacccatgtagccattcaggttgataatgtcatttataatacagcagcttcattaggcgtttccgacaacaatacaacaacagagaatttcagatttgctttaaatgctgatcaaagcgctttagaatttgtcatgaaaaaagatcctaagaacattcagatctattctgctacaggcatgaaagtagcagaaggaaagctaaacggaagaagatttgaaataaacactcttcagacaggtatttattatatgaatattgaaacagcagaaggaaaatttattcaatcaaaattcattaaaaaataaggttaatcagactattatttacctttttaaagccgacagaaacgatttctgccggcttttttatttatgattttttcatttttaatgatgatcacaaaatagaaacaagacaaaaatcatgtttttatttagactgattaaaaataattatataattttgtggaaccattctaaataaggatttaaaaaataatttatgaaaacaaaactattattggcttcggtactggcaatatctgttcagcagactgttttggcgcagactgacgcattgggatactcacaggtaaacatgactatgggaagcggatatcagaatcgcgtatttgtgaaccttgcggatggcaatatggtttcccagccagccaatacctgggatattgctttttacagaaattcaaattatgctttcggatcgagagtgaatgatgcaaaagatatcgaagtattcacagcatcaaccaatttagccgactgggacaatatcagcatcagcaatgaatcttcatggggagcccctttgtacaatccggatcagacaactgactggagccagggcgcttttgaacaaggcccggtgacctctcccaatcctaatattccttcaacaggctggggagtttacaatcctgtgaaccaccatattcagggaaaagcaatttttgttttaaaatatgcttcaggagtttatattaaattcgctattgaagatgcatttgccggatatacgttcagatattcaaaatggaacggtacatcttggggagctactgaaacaaggaccatcgccaatggtacagatgattcttatttcaattatttctccttcgataccggagaaaaagttccgaatctggaaccatccagaacggcatgggattttgtattcaccaaatattacactttctatatgggtgtacagatgtacccactatccggagctattcaaagtcctaatatcaaggttgcgatggtacagccggaaactcaggaaagtgcaggttatagcataccggccaatgctaatttctcgtcaacaattacaacggtgggacactcgtggaagggtatcggaacggtaaaaaatgatgttgtctactacgtcaaaaaaggaaatgactactacagaatgtacttcaccacgaatggtggagcaagtacaggtaacatgtatttcaaatacaagaagattactgaaacactaggcattaccgaagttgggaaaaaagcatctttcggtctgtatcctaaccctgcgacagctgataaaaaggtaactgttctttttgatgttaaagaaaaggcaaataacaaagggaatgtagaggtttatgatcttaccggcaaaaaggtctattctgtggaacttaccaatcaggctggtttctataagcaggacctgaacctttctacccttacttcaggaaattacctggtaaaaattacttacggaggccactcggagacgaaaaagcttatcgtaaaataatctttcaattttaatactttctattttttctaataaaaaggcggtttcagagtattgaagccgccttttattctttactgaaattgaggaagtctttaaattttaaatcttaaatccttcaatatcattaatatattttaaatcctttgtaaacttctgccgagctttccatgattttggatgcatctttacggaaatccaacaaatggtcctgcccattatgcctgttgtggtgctcaacactttcccaaagctcgatcaggaaaaaagttcctttattatctttatcttcaatcaggtcatactgcagacagccttcttcttttcttgtttctttcacaagcttctgaaacagctctacagcatccatcagataattttcattaaacttaaaaagtgcaatgatatgtaaattcatgttctaatatttagtgatgtaaaagtaaagtattttcaaaatcaaatatctttttacaccttttatttttccacaccgaacataatttttaattaaaaactgatttataaatagttatagaactcattacaatcaccaaagttccgataatcacaaacattttcttcacaggaagcttagccgtaagcatggcagaaaaaggagcggtaacaattcctccaatcaaaagtccaagaatgatattccagtgctggattcccagggtaaagaaaaaggtgacggctgcagtaatggtaagaataaacttggccacggtagaacttcctacggcaaatcttggagtaaatgcatttttgatcaatgttccggttaccaaaggcccccagcctcctcctgcaaaggaatctatgaagccgcctatcacacccagcctgatcaggttggtttttcttttcagggctttactttgtttttctttaaatgcatttgataaaatctgaaaaccgagatataaagtataaaaagcgatcaatgttttggtgatctttgcgtaatactctccaagataagtaagacatactgcaccaataattgccccgattacagccggaatggccagcttttttaccagactcttacttacatttttcaatttaatgtggctgacgcttccagcagcggttgtaaaactttctgccgaatgaatacttgcgcttacaatatgcggcggaatattcagaagcatcagtgttgtggtacagataaccccatatcccattcccattgatccggcaacaatttctgcaaagacccctaccagaagcatccagtaaaaaatataattattctttgcaagaatagtctgcagctcttccaggtatcccagttcatacattgaaaaaacaatgatggaaataacagcagctgttacaaaaagaacattaagccttacctgaatttttcttgaaatcaccatattataaaccgtttttgttcattactatttttatgatcattgtcaaagacattcaacggttatttgccattcctatttccaggtcggaattttttttcagatagaacatatgcggcagcccaatggactgcaatagcagaaggggtgatcttttgtgattggttttcttcttcttttgaaatcatagtttattcatttgaagtagtgcaaatatctgataaaatatctatcctacaaaacaagtagactattaattcaaaaaaaaggatcaggttaatcaaccagatccattaaagttttactttccagaatattcagggatgcatcccgaacctctatcagcacatcatgaagtccgcagtggtcttcattgcagtcttcacatttttcatagaaattcagacttacacagggaagcatggcaataggcccgtttaccaggcgaataattttagccagtttcacattttcaggattttctttgaagaagtatcctccaccctttccttttttactgtcaaggatatccgcttttttcagttcaagaaggatattttccaaaaactttaaaggaatctttttatgttccgcaatttcagaaataagaatcgggccttcatttcttttttctacaagatatgaaagcgccttaaacgcatattgagatttttttgaaagcattacagcaaaaataagaaaattgtttaatatttgaaaaagagagaaaagtgaaactgtaaatgcgtaaaagataattttttcatccgtaattttacggttttatataccacatttttgcctttctgccattaaatcattatgtttgccatatgttcagtaaacaagaggcacagcaattaaaaaaggaattttggacagctttcggaaagtcatttcccagaaaatggattctttatgataccaaaatcaaggacatggcatttaaattttcggccgacaataaaaaagcagaagtttctctggatatcgaaatgagagatgaaattttcagaaatgcctattatgaaaaaatctggtctctggaagatattttaaaagatttcgttggagattttcagaaggaagaatattttacccttgaaaatggcaaagtgatcagcaggatatgggttgagaagcatggcgtttccatttttaataaaaatacatggcaggaaatttttgaattctttgtagacaaaatggatggctttgaaaggttttactatgaatacgaggatttcataaaagatatatagaatacttacgaaataaacactattttatgcttcggattaagataaaaaaagaaaacttatctttgctacaccacttaaactaatagatgaaacaaaataacatgattaaaaatgagaaaagtgtacaaaaacatttttggagaggtcatttccaaaagtaaagctgtgaagctaaacgaatatcatctgtattattatgaagaaggtaccgatttcctgaaagaaattgaatttattaatgaagacagtgtttacaacatcaattattttttaagtgacgaagaagacgaaacccaggtagtggattatcttaaagaaaaatctgatttttttgatattgaaaaaaaagaaaccacggacagctttattatttctaccaataaattatattccttatctgtagacgacctccccttaatttctaaaactgttttcaaaaaagacgaccccgaaaactttatctgttcacaggtcattgataatgaaacccacgaaccgcaactcgaaagaactataaaatgctggtacaccaacgataaaaacggtgaaaaatatgcagcgatagaatgcagctatcaggaagacgggaaacttgagctggctgtagataaaactccggatcccgatcatgaagaaaactgggttcattatgattatgacactttccacgatcttcaggcacaaatacctactgatatcagctattacaaaacagccgccttacttcccaaagaggcatatcagcaataaactttttacacatcatctcatttttaaaattattaaatggaagagaatcctattttttttgcagacggaaatgatccgcaaatgattgaagcttacaaaaaagcacaggagacttttaagtatttctggcgtgaacaatcctgggaatacagaagaattattccggggcttaccgtatcatgcgttaaaactgcttttgaagagcaggatgaagaaaccggagaaagcctggtagaacatatgtggatcaatgaagtattttttgacggggatcatgtaagaggatatcttattaatgagcctaacaaccttaaaaatgtacaggttggcgattatgtcgacattcctttacaaaatatcacggactggctttttgccatcactccgagtgtacagaaacctaaaggactttccagactgttttcatcttcttcaaccccacttccaaaagcttacggaggttttaccattcagaaaatgcgtgctgatatgtccgatgtggaaagaaaagagcatgataatgcctggcagcttgatttcggagatttcaatgatatacttttggtgaataaccagaaagaaaaccctgaaaatctgattgaacatccgatgagtaaaaatatgagagaggaatttgcaaagttcttacaacagtatccggatgagcttacacaagctgatgaatacggcctgacacttcttcacaaggaaacaattgcaggcaatttaaccactgtgaaggttgctttggaagcaggagctgataaaaatatccgttctaaaaaagggaaaacagctctggattatgcaaaacagctaaactgggagcatcttattccggtattggaagggtaaaatattaattaagagtattataacccaaaatttgtttaaacttttatttttgaaacattaagattgtattaagttgttgagagtattaagataagcttcgctttaagcttaaaaatcagaatgattcatcttaactatactttatttcttaaatccttcttaatggtttttaatattcaacatttttataagtctaaacaaatactcaatactaagtttttaaaataaaaattccggaagaaaaatcttccggaatttttatttattcttatccaaacttcttctttcttaaccagaagaacaaccctccgagaaggcctataatagccagtggaagcagtaaattcagccactgccatgtagatttctcttcagtgattctttgtctgtcaagaagtctttcttcgatatttctgtttctcagttccatcagattgctgtcatccagcaggtaatccaaagcatttctcaggaactgttcgtttccgaattgttcgttcgtcaataaatctactcctaacggaagtggttttcctttgatcactttgtttcttcctacatctccgtctgcaataacgatcattttattttccggactggatgttttgaatcccgggtaagactttctttcaattcttgatgcatacgcagaattaaatttcccttccaatgctacagcgaagattttcggtgtacttggtttttccatttgtcccagactgtctacgcttgcaatttctttcagatccacataatttggaacctgtttcaacagtgttctttcactggattcaaaaagaacttttgttctgatattttttctgccacccaatgtatcaatggaagtcgggaattcgaattttacagggttaatatttttggtaattggattattattttcagctattccaagaggataataaggccatggaaggcttgtgtactgagggtttccacttacttctcctgtaaccagtcttaatagtgcaaatttcttaacgtcctttaccaaagccggattgattctcaccccgtaattgaaaaagaagtcggtcatattgatatcgatcgggaaaggcattacttttttggatcttgttaaggtatccatttcagcatttaccgcatcaatcatccaaagtgtttttcctccattcatgatgtactggtcaagaattactttttcattatctgtaaaagcttttctcggttttgcaattaccagggcgctcatctgtttcaataaaggaacatcttccagtgaaagctcagtctgatttttaggaataataggtcctgcatcatagttttccatcgccagctgcacaaatccctggaattcatccggattcaattcatcatggttgaccaaaatcccgattttcttttttttggctgctgcaatatttttaatattggaaacaagattatattccagtccttcaatagatcttgttagttgctcatcggcatcaattcctgcctgctgtaccactaaaggaatagaaacaccgtcattaccgtgtttgatcacagcgtaagggaaaagcgtgatctgtgagattttcccgtcttttacatccggaagaatagacggctgcattcccattgccataagggtatcctgagacattttggttttaatgggatcgataaatttaaaatcaatcttcggattaatttttctgaactcttccagcatgaacttcgtttcgctttgcaactgtttgaaacttgccggaaaatctccttccagatacacttcaacagtcaggggcttttttacagactctaatactttgatggtgttatcagaaagggtatatcttttttcttttgttaagtctaatctgattcctgaataggtcaggataataaccaaaggaacaactgcaattaagaaaattcccagtggagatttagcattgaacttcttcatacttctacttctttttgttaataaaatgattagccaatactaatgaagcgcagataacaagcacaaaatacgctacatccttagcatcaataagccctcttgtaaagcctaggaaatgctggtaaaagccaatattctgaagaatgaaatcagctccacccaatagtttataacttgccagctgctcaattccaaaatacataatgaagcacatgaaaacgcccagcagataagccataatctgattttgtgataatgaagacgccaggattcctactgctgaaaaagcagctattaagatcatcagtccaatataacttccaaaagtcattcccagatcaatatttcctgccggaactcccaaaacatagactgtataaaggtaaattaatgatggaattagacataaaattcccacaatccacacagaaagaaatttgcctgtcaccagttctgaaacttttaacggttgcgaaaaaagccagttcaatgttccggtttgctgttcttccgcaaaagtcttcatggaaagggccgggatgataaacatcaacagccatggtaccaatacgaaatagctctgcagtgaggccattccaatctcaaaaatattagaatcgttgtcgaaaaagaacaggaaaagggttgctatcaggctgaaagcggcaatgatcacccatgcgctccagtttccaaagtaactccaaagttctttctttaaaattgcaatcatagttttttgtaagatataaaaaggatgaatgttttcaaacatacgtcctgctccacaattatttgttttttttgtttttgttaaccagttttaccgtcatcatgatcagcaatacaagaacgaaaaatcctgtaattaattgccaccagtattcaatcaccatggattttagaataaccgtaaataccaccagaaacagaatgaaggttgctatttcattcgcctgtctcagcttgatgttggcaatgggtagtgtacctccatgcagatcctttaaatgaaggacttttttccagcaccagtaatggtaaatggcaagtccgataaggaaggtcagtttcaaatgaaaccacggcattttcatcagcccggtatttaaaaagatcatgaccaatccgcaaactgccataattactcctgcaggaacggtgataatattccacagccttctggccataaaagtatactgctctctcagaattttctttttttcttccggaaaatcatcagtgtccttatagtaaacgaaaatcctcacgagataaaaaattcccgcaaagtagcttaccataaaaataatgtgcagcgctttgattattgtataaagcattttaataaataaatttattgatagaaataattttacaatcctggtccaaactcttcagtacatcaaaaaaaatctttttcatatcctttacattattataataagaatatcccataaaaatagccagccccaaagagatcaatataattccatacgtggttccagaattttcatccgtataaaaaggaacaaaaatccctaaaagaagaacaagaatgagtacatcaaaatatttaactccaatagatactttaagaaactcttcattatttttgtctgaaacaaattttcctataaaagacaaatattcattccccatcacttttacttcaaatccatcatcagttacttcacctttaaactttttgccattataatcaggaaagctcttaaatatactttcttcaatcttagatagtatcgatttttttggcttcgaaaagacaacctgatattcggactttaaaaacatttcaatttaatcaggcacaaagataagtttttatctaattcttaaaaataaatttcttttgatcaggaaaacccaatcaaaaacggatttctataaaaaatagttcggctcggggcagcgaagctgcccgagccgaaccttatatttttattattgtatccaattcagcgattaagagatcactcctaattcttttcctactttttcaaatgcagcaatcgccttatccaggtgctcttttgtatgagctgcagataattgaactctgattcttgcttttcctttcggtactacaggatagaagaatccgatcacatagattccttcatccataagcttttcggccattttttgagaaagcggcgcatcgtaaagcattaccggaacaatagcagcatcgccttcagggatatcaaaaccttttgctttcatttccgttctgaagtattctgcattttccattactttatcacgaagagaagtatcatcagaaatcatatccagtactctcaatgcagctcctacgattccgggtgccaaagagtttgagaataaataaggtcttgaacgctgtctcagcatatcaatgatttcttttttaccggaagtaaatccacctaaagctcctcctaacgcttttcctaatgtagaagtaatgatatctactctacccattacgtcatttgcttcgtgggtaccacggccggtttttccgatgaagcctgttgcgtgagaatcatctaccatcaccaaagcatcatatttgtctgcaaggtcacaaactccttttaagtctgcaacaataccatccattgaaaatactccgtctgttacgataattttaaaacggtggttcttttcagaagcagcaatcagctgagcttccagatcctccatattattgtttttgtatctgtatctagccgctttacaaagacggacaccatcgatgattgatgcatgattcagttcatctgaaataatagcatcttcttccgtaaacaagggttcaaaaacacctccgttagcatcaaatgcagcggcgtaaagaatagtatcttcaagaccaaggaaatctgcgatttttttctcaagctccttgtgaatatcctgtgttccgcagatgaaacgtacagaagacattccgtatccgtgagattgaatcatatcctgagaagctttcatcacctccggatgattggataatcccagataattattggcacagaagttcaaaagcttttttccgttagcctctatttctgcactctgttgagaagttatgattctttctcttttgtaaagtccgtcattctcaatattctgaagttcattctgtaaatgttgaaggtatttttcagagatcatttttagtaattttttagatgtgctaatttactaaaaaggcagtaaaataaaaccttttataagcttaattctaaaaaatcagttcaggtttaagttttaacattattagtctactaatttagtaggataatatttatatttgcttaaattttgaatatatgagattaaagccggtacaaaaaataaagacaatcagctcagatacctttattaataaccatatgaagccgagaattccaattattattgaagatttcgtacaccctgaaagccaagctttcaaaaagtggaattatgagtatttcaaagaaattgccggagatcagatggtcaatgtatatggtagtgagcttgattccctggacagagtcgcaagtgatcctattgcccagactacattctcagaatatctggatctgattcaatcaactcctactgaacaccggctcttcttatttaatttactgaaaataaaacccgaacttaaaaatgatattatttacaatgatgtaacaaatggtaaaatactgaaatggctgccatttatgtttttcggcggtgagggttccgtaaccagaaaccatattgacattgatatgtcccatgtttttatcacccaattccggggaatcaaacgaatctggctcttcccctgggaacaatctgattttatgtataagctgccatacaattttcacagcctggttcagattaaaaacccggattacagaaaataccctgctttactctatttaaatggctatgaagcagtcattcatccgggagacacgctgtatataccttcgggatggtggcattatattcagtacgatacagaagggtattccatatcggtaagagcactgccttcgagtcctcttgaaaaatggcgcggttttaaaaaccttgtcatcaccagacattttgataacctcatgcgtaagatattcaaagaaaaatggttttcctacaaggtcaggctggcgagacaaagaggagccagagcagcaagaaaacaaagaagctttcaaatctgaaagcttcttctgtattctatttttaaaatcccgaaaagtaatccttcatactttccaagcctttattttagtgcttaataaatttaatattcttttcatcaatcgtaataaaataagctcccggaaccaattctgcaattccaattgctttacctggctgatacgttccttttccaaccagctttccgtcaattgcgtgaatcgtaaagtccacagctctattgatgcctttcagattaatttcatttttcgcaggattcggatataagccaaagtcttccttctcaacagaagaaacgctcaatgtattatcctgggtaaccgtagagtttttctcaattatctgatactcgtaattaaactgaacacttgctatcgggaaggttaccgattgaaggaaatattgattattagaggtattgttaagaaccagataagctgtctgcccggatgttcctgtcactttaatcggcaaaggcatttcgaaaaagcttaccgtagagctgctctgtgtctgtgaaactttaaataaagcctgatttccgctctgcatccactttatggtataggtaggatatccttctccatacacccaatcattaaaaaactctgtaaaatctgtccctgttgactgcagtaaagaggcattaaaatcagctgtacgtgcatagctgtaagcaagattcggtcttgcatgatagtctttcagtgcctgataaaacacagtatcccctaaaatccatttcagcattctcagcacatatcctcctttggcataagtaagtctgctgtcaaatattctgttgatgctggaaagtccgctatccggtacatatacgcttccggttgtgcccgctgtaatataattggactggccttgtaagtaattcagaaaatctgtattgttcatcaatagtttttcattggcaacatgttctccgaatgtggcaaaaccttcattcagccagatatcattccatgcaccgcaggttaccttatcaccaaaccactggtgagtaagctcatgagcaataagctgcttgctccatccgcccatagaagacatagtttgatgctccattcctcctccgtacataaattccatgtgtccgtatttttcattccggaaaggataagaaccaaaataagtttcaaaggtatccatcacctgctttgtccagttaatattagctacactggttgcattggagttcgtggacggataaatataattcacaaaaggaaaaggaggatttccgatggtatcagtaagctttacaaaatttgtaatcgaaagagcaatcaggtaggccggcgtaggatacattgttctccagaaggtcagtttggtatttcctgtaggaaaagtttcagacatcagctttccattcgctgctacgctgtagttcgacggagtcgtaattttaaaatcaaacctttcaattttatcatttaaactctgcttggtaggaaaccaatcctgtgcaccataaggttcatttaaggtagaaagcaccggagttccgctttgaagagccgttttgaaagcatcattacttgtggatggtgctcctgcataatagatggtaagagaatccagtgtattggcagggatagaggccggaaaatcaattttcaattctttcgaaggaagctgttgaaagcttgtaatgttggttccatgatatttcacctgggaaaccgttaatgaattggaaagatcaaaataaatacttcccatagtctgtgtaggcttaaaatgtgaagtaaccgatcctgaaatattatacaccgcaggatccaggctgacatccattctctggtattgtaagtcgtaattcagggtgttgggattgatattccctatattcattttttgggtgaaggattttttctctttttcgattaatcctttcatatccgtattttgcctttgcttctggccataaaattgttgagacaataaaaatcccaacaccaaaaggtacaattttgtcatgttttgaaaaatttaatcaaatataaaaaaaaccttttaatcaatgattaaaaggctgttataatatataaaataaaaaatttctaaagatctaatgcaggttcaagaattttctccattcttttcttcaccatatctaccgatccggaatagttattcaccatcaaagagaaaaccagtgtttttccggagtttgttttcagatatcctgccagcgtttttactttattcaacgttcctgtcttcgcaaaaatctgtccgtttccgccagcattaaacattctttttaaagttccggattgtcccccgacaggtaaagaagtcagataagatctgtaataattctgatccatcagagaagtaaggaatttcacctgggaaataggagtaacattattgcttcttgaaagtccgcttccgtcgatataatttaaaccattcatatcgaaacctgattctctaaggtgattggtcactacaattcttcctgattctgaagtctggtctcccattttctgatatcctaccgttcttagcaaagcttctgctaaagaattgtcactgtgctgattggtataataaataatatcacttaacgttggggatttataggcagaaagcatttttctgttttccggagctgcatctgtcattttcggcgttacttttccggtaacaggaatgccgctttttaccagtgtggttctgaaagagttggcaagataagccggagcatcaggaagtttggtagttaaaactccgttgccttcgtatttatcagcatataccatctgatgattgtaaggggaaacgtagaaaaatttcttttctgtggagaaaccactttttttaacaatcagtttttcgttggccgggttgatatcgcgggtacttcctgcaggtaaataatagttattgttttccaaccatacaacattttccggaagcattgaaatattgcctttgaaaagcgctgtctgaatgataatatcaccatttacctttttgattccctctcttgaaacgccgcttacgaaatccgaaatgatatctctgtaagatgccgctcctgctttgtttgttcccaaagaagggtcaccgcttcctatgacataaagatttccatttaaaactccattttcatctacggttcctgaatattccagctgagtcatccaacggtagttttcgcccagcatattcagagccgtttccgttgtcagtaattttgtggtagaagcaggtactaaaggagtattttcattgtacgaagagatcactttcttcgttttcgggtcatacactacgaatccccaggttgcatttttcagcacaggatccgccatcattgtgttcacattaatgtctaccagttcttttgctgacaaaacagttttttccaccaccgtgctaacgggtgaaggtaggtttaagctgcttttttgattgtcataattctgagaataaagaacggtagaaacggtagattgagccaggaaaaaaccagaagccaacaccgctgcacttgaaatatattttctgaaatttaccatctatctttttttgttctatagctttgactcaataaaaaatgacaggttaaatcattcattaaaagaaccaaacacttaatcaacgtccaaaagtagaaattattgtcatataacggaccacagccacattataaaagagtgtaaagtttgttaaaaattgttaaaaatccacaaaaacatcttttttaatgctttgatatgcagtgatttcatcaaattctttcaaacttattaaaaccatgcttttgaatttttcatagttcttcccacggggaagcttaagcataatctggaactggtacaaattattcaactttgcaatctgagctctttcagggcctaaaacgcagtcttccggaaggtattttctgagaatagagcccagaaactgagaagcgcggtctgctttatcctctcttctgtgtttcagctcaatcatgatcagcttggtaaaaggcggataatgaaatttctgtcgctctgtcagaatatatttatagattttcgcagggttattcatcttgatcagctgaaatacagaatgatcaggattaaaagtctgaataagaatttttccttttccggaaaccctaccggctcttcctgacacctgcgtgatcagctgataggctctttcttccgccctgaaatcctgtacatataacagagaatccgctttaggaatcgcaacgagttcaatatgatcaaaatccaatcctttggaaatcatctgtgttccgacaatgatatctgtttctccgtcttcaatcttttcatacagcttttcgtaagcaaattttttacgcatagaatccacatccattctatccacctcattttccggaaacagtttggaaacttcttcgtgaatctgctctacacctactcctctttcgtttagcttttcagaattacatttaggacaggtctttggttttgaagctctttgtccgcagtaatgacatttcatctcattggccgctttatgatacgtcatcaccacatcacaattggagcagtaattcacataaccgcagctttcacattcaattacattggaatagccacggcgattatgcaggacaatagcctgtttttttgcatctaccgttttcttaatatcctcaataagcttcagagagaaattacctgaaactttcttagattcctgcgcttccttgaaattgatcagctcatattccggcagattaacgtttccgaatctttcattcagaaaaacgtatttcattttatcttttctggcgctgtagtagctttcaacagaaggtgtggcagatcccaggatgactcctgccttataaagtctccccaaaaccaatgaggcgtccttagcattaaaataaggagatacttcccttggtctgtaagcagaatcatgttcttcatccacaacaataagtcccaggttctggtaaggtaaaaacagagcgttacgggttccgatcagaatacggatatcgttctgcttaattcttctccatacttccaccctttcaaaatcagtaagtttctgatgataaaaacctaattgcctgccgtatttcttttctaaccgctgggtaatctgtttggtcagggaaatttccggaagcaaaaacagaacattttttccttctttaatacattcatcaattttctctaaataaatatgagtctttcctgatgaagtaacaccgtgaagcagcacattctttccttcctcaaaagcttcatcgatctcggatttggctgttttctgctgttctgaaagttcctccagctcttcaatttctccttcatagctttcgatcctgtctttctgcatataatattcctccacaagacctttgtctgctaaaggtttgaagtgcgagctaccgaaatagccatcttcaaacagttcagatttctttataggcgtatccggattttcggtttgtttttccagaataagaaggaaaagatctttttgcttttgcgccctgttcagctttaaaagaatttctgtaaggttctgattggccagcacctcatcattaatccttacatacgctacttctttagctttatatttttcagcaatcttctcatcaatttcaatatactgaagatcgataagcgaattgatggttctgatgatatcttttttaggaataaatgcttcaatatccgtcaggttgatcagctggcgcacctcaagtgcctgaatcaggtacatttcgttgacatccagattttcaaaatcaacaattgcacctgcttttaattttaaataggtttcactttcaagttttaaagaagaaggaaatgaaaacctgtaaatttccccaagattgcacagatagtattctgaaagccagttccagaaatcaatctgttcctgaggcagaataggttgatcatccagtatgctgatgatttccttggcaacaaaattttccggtgcatgatcatgaagctcaaatacaattcctgtatagattttcttcccgccaaacggcaccaggacacgcattccgggctggatttcggacatcatctcttcaggaactttataggtgaaagatccttttaaattcaatggtaaaactatctgagcgtactgcaagggaaatatttaaaatgtaaaattagatttttcctgagagaactgcaagtttgcggaaattctttcataatcttaacacaaccgtaagcaaaagcagttataggtgttttgctgcctcatttgtccattccgtaggaatctaaacaatcagatagtatacaatctaaaattgtcttaatttatttcaaaacaatgatatgacaggctggattcctgcggaatgacaaagcgtgtggataaaagaacaacacaaattcagaaaggatcgaagaaaggattcatgaatgactaaaaaagcagttccgtgatctgataccagaatgcagaagtaaaaaagcctacaataatactgaacccgatgatcagattggtgagttttgtattcagcctgaactgttctgcgataatacttgaggtgaccaacgtgggcattgctgcttcaaataccgtaatttttgctacatttccttttattcccaataataaagccattcccaagacaattgcgggtgcaagaataagcttgtaaagcatagacatggacatctgcgggaccagttttttccatccgttaaatttcagctgcaacccgactgaaaacaaggctaaaggacttaccgttgctgccagcttatcaaagaaaggttctgcaacagtaaagtcaataaactgcgacaaaaccaaagcagaaatacaacctattaatggcggaaatgtgatgagtctttttaaaataaataccgcacttacctttccggatttgcttcctccttttactgctgcaataattcccagcgtagaaagggcaaagaacatggtctggtcacagataattgcaatactcagaagcccttcaccataaaaagcactgatcagcggaaatcctatgaatgaagtattgctgtaaccacttgccagttccaaagtgcttctggagcgccttgaatagcctctgctcttgctgtaaaacatcataaagaaaaagcagaacacagcaattaaaaatgtggctgcaataggaaacagcatttctgttgtccattttactttaggcaggtatttaaaagaaactgccggaagagcaagataaagaatccaggtattgatacccttatgagcatcggggtggatagattttgttgctttgaatatcattcctgcaataatgcataccgcaatcagaacaaaatttaccataactgtaataaaatatggaacaaatttacggctgatttttcagttggaaaggtaaaatttatatttttttgagttaaatttctgatgaccttttaaaccttatagattttaaaaacctataaggttagagagcttttactgaattttaatctttcatcacattccacaggctcatcacctcaactttttccaaaggttttgaaagggtaattctttttgaagttccaggcaggagatcaaagaaattatcgctgaaatgagtatcaccgatcaggtaaatatctttggctaaaacatctgtagagatttcaatctgagtaggtgatatttttctgatcttaatctcaggttttaaaagttttaaatctttcggtttatcaaaatagaaaagcttttcaaattttgtatctttttcagagctgatctttaaaacagctccggacaaatcaaactgagccagctctgatttgctgatgtttcggattttcttactaatatcagcattgatgacatctggctgattggctttccaaagtgttttccctctaaaattaatgagttcaaacgtgatatctgttgttaattctttcagcagatcactgatcagataaatatcataatctttttctgtttccgttattgagatcaaaacaggttcaaagcttcttttcgcctgataatggaaagctttccagtttcctaaataatcaatagaagaccatgaaactaccggccaacagtcgttgagctgccaatacaacgttcccatattatagggttttgcacggcggtgagcttcaatggcaatctgcattcctcttgcctgcagcagctgtgaaacataattatactgaacaaaatctgacggaactttgtaatcacgcttcagatattcattaatgatatcccagcctctggcgtgcttttcatgcgctttgatcgttggattctgaaggtttaaatcaggaattccggaaaacattgattttgtagtttcaagagtaggagttccctgaaaaccatattcagacatgaagcgacctactttttcgttgtaaatctcaaacggctgctcaccccaccatacaccccagtaatgagaatctccttctgtaagactttctttatgcccccagccgatagacggagaactcggccagtagatatttttatctgacttcaggttttccgccaatgccttgggaatgacatcgtgaaacaattttttatagtctttccaaacctggagagagtcattttttgaatatttgaactgcttctggtatccccagttgacaatggcttcatcaatttcgttattcccgcaccacaaagcaatggacggatgattctgaagtctggtgacctgatcttttacttcttcttttacgttgtttaaaaaggcttcatccgccggataaaagcttcctgcaaacataaaatcctgccagaccaggattccgttttcatcgcaggctttataaaattcatcgtcttcataaataccgccaccccatatacgaatcatattcatattggcgtctttggtgtctttgatcagtttctgatatttttctctggtcattctaggtgaaaaactatctccaggaatccagttagttcctttgatatacaatggctctccattcactttaaagtaaaatgactttcctttttcatctttttcctgaaccaattccacggttcttaaacctatcctgatatttttaacatcaatatttttctgatctttggaaagctttactttgaaatcatagagattagcttcaccacgtccatttggctgccaaagcttcatcccgtcagtatcataaggaaccgaaatagtattaattcctttttttaaagatattttttggtggattttattaagatctaaagtgtaatttccagcgttttgagcataaatctccacgtcaaatcgtaaatcattaacctctttagcagttctgttctggatatccttaactgaaataattttagcattattccagaattccagttgaacgtctttccagattcctgcagtaaccagccttgggccccagtcccacccgaactgatattgagcttttctaacaaaacttcttggtgattcgggcatggtaaacggaacttgttttgcaagttcttttccggtatttaccgcagaggtaaacctgatctgtaatgtattgttacctgctttcagatattgtttcaccgggatattccatttcctgaacatattatctgtcttcttcagcagcttaccattaagataaatttcagaaaaggtatccagtccgttaaagaccagatcaatattatcattcattaattcccgggaagaaaccgtaaatgctgtttgataatcccagttttcattttctatccactgtactttcttttcattttcatctttatacggatccggaatcatcttgttattcatcaaatccagatgaactgttcccggaactttcgcaggaagccagctttgttcttttgagtttttgaactgccagttctccgaagacaggcttctttgtgaaaactgtgcatgaagaatattctgcatgaaaaagaaagcaaaaaggatagttttattcattaataaatttgttttgaatcgttatcataccggtgattttgtcattccgaggaacgaaggaatctctattttatcagtctagattcccactacgcctggaatgacaaccagagtacgtattatttattcttcaatgcaatcacctcatccgggctggcaaatgctccaccatcagtaatggctgaagaatgaaagtaaccggcattggtcaccgctcttatttcttcaatattggatgaacggagtccacctccaacgagtatttctatccttccgttggacaattcaaccagtttcttcagattctcttttccttcagatacattgggtttctgaccggaagtaaggatggttttaaaaccgcattgaattactttctctaaagactcttccaaacctgcggcacgatcaaaagcacggtgaaaagtacatggaagcggtgaggccaactctaccaaaactttattctgttccatattgacctcatcattttcattcaggataccaaatacaaaaccgtctgcacgcaaggatttcaggtgtatcaaatcatttttcatctgttcaaattctgaatcagaatacgtaaaatctccacctctcggacggatcatcacaaaaatcgggattgtaattttttcacgaagctttttcatcgttccgaaatccggagtagttccgccttcactgagtccatcacataattctattctgtctgctccattttcaaaagcaatgactgctgattcaggattaaaacaagctatttctatttttgacattgtattgtatctatttaattttatttcggttcgtcctgccatacatctgcaatcagaaaggaaccgttttcttttactacttttactactgacgggtattctgctttaaaatttttgtctgtcagcactacattgaagagatattcatcttttgaagagagttctaaatcacagcttccaacttcaattttatcccagtcctgtgctgcaatcaggaagcccgttccaacacctgctttgcttatatcaaatttggatttccacttatcctgaaattctttttctgtgagacctccatctacatccaggtcaacattcatcgcatccgttttatactcaaaatactctttggttgtgatcttcctcatattcttttcttcacttccgacatcagctttaaagtaatcgacaatactactttccagccatttcttagcatcttccgcctcattggtttcattattcagaaccactttttcttctatctgctgcggtttggcctctgttttaatctccttcttttcttccttgcaagcaataatgagaagtaaggaagcgataatcgttcttttcatatgtatgttttggctaaagccaatagatgttttattgatttttaaaacgggctaaagcccattcctattgaatttttaattattttaaagcaaattcaggtttttcaaggcggtttcctttctggtcatataccgcaaagttgaatccgtcctggatacaatacgaaccatattccccttgtttattgatcgcgataaaacctacctgaatgtctttcagatttttgtttcttcgctgattgatttttacaattctgtctacagcttccttacaagcttcctgtggatttctgccttgtctcatcagttcaaccacaagatgggttcctacggttcttatcacctcttccccatgaccggttgctgtagccgctcctacctcattatctacaaacagacctgctccgataatcggggaatctcccactctgccatgcattttaaaagccattccgctggttgtgcaggctcctgaaaggtttccctgggcatccaaggcgatcattccgatagtatcgtgattttcaatattggcgataggtttgtactggctggtttttagccattctttccattctttttctgattcgggagtgagaagattttcttttttaaaaccctgcgaaagggcaaactgcaaagctccgtcccctaccagcatcacgtggggtgttttttccattaccgctctggctactgaaataggatttttgacatgctcaagacatgcaacagagccaatattatagttttcgtccatgatacaggcatccagcgttactcttccatctctgtccggacgacctccatatcccacacttctttctttggggtccaattctacaatacgaactcctttttcaaccgcatccagcgcttttcctccttttccaaggatggtccaagcttcttcattggctttcagcccgaagttccaggtagaaagaacaattggtttgttaacagccgttacagcttgttcaggtaattcagcagccatcagatccagtggatttacggcaaatgcagctgttgccattcccagttttttaataaaacttcttcggttattgttcatggtatctcaaattgtataatatccacaaatctaaaaaaaagttctatgaaatcctcatgacactcgtatgaatatccttgtattattttatttatctttactgctgtaatggactcatttaaaattttcaggaatatctctttctttcaggaactctctgatgaggaaattgccattctggtcagtatcagcactccgaaacttcttaaaagaagggaaaaactggcagaacccggcaaacatttcaatcatttatttattctttccaacggattagtaagatttttctttgatgatgaaaacggggttgaaagtactctttttttaccttcggaaaaggaagctgttattatggaaagtccggagtcttacgctaatgaaaatgagaggaaatatactatagaagctgtattggaaagtcagattttcctgttcaataagaatgaatttgaggaacttgcatttcagcacagaggaatttacaatgtatacttaaagtctttaaaacagattatcagcatattaaaaatacgtacggaacaattttgctccacctctcctcattccaggtatgaagagtttctggagacacgtccctttacctcacaaaatgccaacagaaagtatattgctaatttcctgggcatcactccgaactcactttctaggatgacagcacgcatccataaaaaaaggaacgaaagaaaaaaataacttaggaatactttttctcactttattcactctatttttgcttactgaaaatactgttacacaaacaattaaaagcaaaatgagaaaaatacgatctgaaaaaacatcttattattgaaattacctttaatctttcttaagattcacagtaatcaggcatataaatattgacagccggattacgaccttgtttacatttcattattaccttatacaattattttatgcaaagaacattcttacttctttgcctgttactttcatgcaattttgttcaggcatcaacaggcaatatggaagacaatatagctaatgctgcatcatggttaatcttattggttttacccattgcaggaatctatcttttctggaaagttcatatttatccggaaaaagtagcagaaaaaaagaagcatcctcagctgaacgccataaaaagtatgtgcctcctttcccttgtttttggaggccttttatggccggttgctttaatctgggccaactatgattatggaaatcagaacacttcagaaaaagacacagaaatcacggaagaagaatttaaaaccctcgaaaattaagaaatatgctggaattactagtcgcaatatatgccggaatatgctggctgcttattaaaaaattaaaactgatcccctggacatttaccacacaggtcattgtgtactctttacccatttttggatctgttgctttaatattgagtttaaattattactgtcccatcacatctgacgtaaaggtaggaaaccgaagtgtggatattactacgcaggttttaggaaaggtgaaaaaagtatatgtaacgaccaatcaggaagtaaagaaaggagatactttatttgtactggacagagaaccttatgtacaggaaattaaatctctggaagccaaactaagtaatatgaaagccactgtaagctcttataatacggatatttcagcttcaagaaaaaacattgccggattacagtctcagctggatcttgccaataaaagggcggctcagtacaaagaactggtggaagccggagctgccaataagtttgatcttgagcaggcactcaccaatgtacaggatctgcaggccagaataagtgctgcacaggcccagcagcagtctttggaaactaaatcgaatgcttcttatggtggagaaaattcatcagtttctgagattcaggcaaagctggatcaggccaagtggaatctttcccaaacggttgttctggcacctaccgatggcgtaattcccaatgttcagcttaatgaaggagcaatcatggcaccttttaaatctgcttttgtcctgatccagaaacagcagtctgtgattggattttttgcacagaacgagctggaaacggtaaaaaacggtaatgaagtggaactggctcttaaaacagaaccgggaaaagtagtgaaagcccgacttgaatatgtaattgatgctaccagccagggaattatgaataacgccggaggaatgctcggaggaaacggttctacagcaggacttcctgatactgccagacagttaccggaaaccgacggaaaacttattgccaagtttgtactggaagacaatcagaaacagcttactgtgggagcaagaggaacagctgtaatttattctgatcatatcaaaccgcttcatcttatccgaaaagtaatggttcgtgtaagcagtaaaatcaattatctgatccctaaacttcattaacatgtacaagaaattaattttactgggcattctttccggaagtttaagctcatgtatcggttataaagagccaacaaaagaaagcatcacccagcttaaggaaacaagtgaaattgcttctcatgtagaaattccggatgagtggatctttgacagacaagctaactccagatctgtttcctatgactggatcaatgatcttaaaacccctcagctggaaaatcttattaatgaaggaatgctttataatgctgatcttattattgcgaaggaaaaactgaatcagattgagctggccatggaaattgcaggaagtgatctttatccgagtgtaagtgcagtagccaatacttccaataatctggtaagtgatacccagatccgtcgtcttgcattgaaagccaattgggaaattgacctctggggtaaaaataaatcttcacagatggcagcaagcagcaattatttttctgcaaaatatcagaataccctgcttcatcagtctattgcagggatgattgctaaagcttatttcctgaatattgcaggaaatattcaggaaaacaagattgagaattatattcagaagtctaaagatctggaaaagctgtatgttattcaaaagaagatcggaacagcaaatgctttggatatttccaacatctctgcagaaattatttctctgcagggctatcttgaaaaagtgaaaaatgcaaatgtacaatcaagaagatcattggagttgctcacaggaaaatatccggaaggaaaactggcaacacagaattacttcaatgctgtaaattcctctgttcctgaatcctttcctcttcagcttctggagaacagatcagacatacaggcgaatcattttcagattgaaaaagctttttacgaagtacaacaggctaaagcagcaagacttccatcattaagtataagcgcttccttcggaactgccggaagtaatgtggaatccatcaattctctgttttcaaatcctttattaaaagtgggtggcggattagtttctccgttattcaacaatggaaagttgaaaaagaatgtggagataaaaacctcccggcaaaaacagattgttgaagaatattcaaaagccgtcctgaacgctctgaacgaagtagaatcttctttaaccaatctccgttctatagaaaagcagatcacttacactaccagcgctgtcaatgaactgaaaaacaatatcagtctgactgagaaacaaataaaagtaggaacgaacaacagttttgtactgatccgtaaacaaagggatcttctgaaaaatgaaatgaacctcatcaatctggaacttcagtacagaatagagcgcattaatctttatatggctttaggggctgagaacttcatttattcataattttatacttaaaaagactgcgggttattgtcagcagtcttttttatgattgaggttgtttaaacttttatattaatgcggtaatttatccctgaaatatccatacacccatgttccggcaatggcactcagcaaagtaacggatactgctaaagctcccgttccgatctgcgcgaacagaggtccggggcaggctccggtaatagcccagccgaaaccaaagatcaacccaccgtagatctggcctttattaaactttttaggggcaattctgatgggctcgccatatattgtttttatattgaactttttaatcaacgctactgaaatgattcctaccaatacggcacttccgatgattccgtacatatggaaagactgcagacggaacatttcctgtatcctgaaccagctgattacttccgctttcacaaagataatcccaaaaataatccctgctgcaagatacttcaggttgtgataccatggatggataagaatgctttcgtttacacaaacagtgtcctggtgacgcatgttctgttctttttctttttcttttatcatgatataaatttctcttttaaaaattagacttacaaagaaagaatgacaggcagaataagattagccatcaaaaatcctccgatcataaaacatattgtcgctaccaaagaaggccactgcaggttggaaagccccataatggcatgtccgctggtgcatcctcctgcatatcttgttccgaaacctaccaaaaatccaccaacaaccatgatgataaagcctctgagtgtcagcagactttcaaaattcataagctgttcaggaaccatattgctgtaatctgtaattccgtagccggccaattctgctttcagttcgggatttactgttatttcattgggattaacaaaaaaatgggcagcaatcatccctccgaagaagattccaagtacaaaaaacagattccaggcttcttttttccagttatatttgaaaaaatttacattggccggaatgcaggctgcacagatatgccttaacgaagagctaattccaaaggatttattgcccataatcaataaagcgggtacagtaaggccaattaacggaccggcaatataccacggccacggttcttttatcatttccaacatttcttattttttaatctaatgtatttaaaattttagtctgacacacaaaatcacttttaggaatacctgtggaagcaatcgctttaaaacctccttcaacttcagtaaagtttctgaatccccttgcctgaagaatgcttgctgccattgtacttctgtagccgcttccgcaatgcatatagaaatgttctgccggctctatctcacgaatccactcattgatatatgccagaggcttactgtaagcttcatgaatatgttctgcattgtattcattttctcttcttatatcgatgatctttgcttcttttcctttgatttcggtttcaaactgctctgccgaaatacggttgacaaagtcagtttcctttccgctttttttccagctttcaaaacctccatccagaaaacctaaaatatgatcaaatcctactctgctcaaccgcgttaccgcttcttcttcagctcctttttcagctaccagcagaatgggcaggtttacatctgcaattaatgcacctacccaaggagcaaaatcaccatccagtcctatattgacagactgtgggataaagcctctggcaaaatcatggttagttcttacgtctaaaatcaaagcccctgaagcttcagcaatttcctcaaactgttccggaaccagagcatgcaaaccttgcgaaagaactttatcaaaactgctgtatccttttttgttcatcatgacattcatcccgaaataagccggtggaggtaaaagtccgtccgtaacttctttaataaagctctcccggtctttctgatttaaagcataattggttcttttttggtttcccaatgtatctactgtttctttctgcatgtttttaccacaggcagaacctgcgccatgagccggataaacggtaatctcatcttgtaaaggtaaaatcttgttatagagactatcatataaaagcccagccagctcttcctgtgtcatatttgctcctttctgtgccagatccggacgtccaacatccccgaggaataaggtatcaccactgaaaagtgctttctcagctccattttcatcaatcagcagatagcatgtactttcaagggtgtgtccaggcgtgtgaagaaccttaattttgatgtccccgatttcaaatatctgttcatcttctgcaataatagcctcaaaatcaggattggcagtcggtccatagacaattggggcacctgttttatggcttaaatcaagatgtccgctgacgaaatctgcgtgaaaatgggtttcaaaaatatatttcaattctacttcatcttctttcagtctgttgatataaggctgagtttctcttaaaggatcaataatagcagcttctccggctgaggtgatataataagctccctgtgccaggcaacctgtataaatctgttctattttcattgtatttattttttgattttgttatctggtacaaatctcctgctttcttttttcctccacagctacttttgttacataagaggattaaagaaaaatttctctggtaataatataaatacccattatcaggataaaccagccgaatgccggtttcagttttttaccgtcaatcttttttgataattgagaacctacgactattcctgctatggcaatgactgtaatcgaaatcaacagtttccaatctattttcatatgattgacagaagaaaagaatccaatcaaagaattcagggagataatgaccagagaagttcctatcgcaattttcatagggattttcagcagattgaccagtgcaggaatgatcataaatcctcctccagctcccaccaaccctgttaaaacacctactattgagccctgtcctgctgcctggaaaacattattcttatcggttttatgttctgaagtattttttcttatcattttataagaagcaagaatcattaacccggcaaaaaccagcagtaaaaaaatgtttctggtcatggtaaagttctgtattctgaatatttcatcaggaatcaagggaagaaggtacgttctggtcagaaaaatagaaactatggaaggaattccaaagaccattgcaattttaaagttgatcaatccttttttaaaatatgacactgaacctacaaggctgcttatgcctactataaaaagagaatattctgttgccataaaggcgtcgataccaaaaagataaacgaggacaggaacggtgagaatacttcctccacctcctattaaaccgagagaaatgccgataaaaacggctgccatatatcctataatttccattttactattcaaataattctgatgcaaaaatggaaaatcaggatgagggctacagctacttttgttacataaggagattgcttcacctttgattcgcaatgacaggttaaccaccccgtcaaaaattctttgaatttttgacacccctccggaggaggggaatataagttcctttgattgaagtgaagtgaatgttaagaattgagggatttcagaagggtaattttatttcttccgagttttagtttcccgtcttcttccagctgtttgaggagtctggatacgactactcttgcggttcccagctcattggccagctgctcatgggtggtatggatggcttctgaacgggtaagctctgactttttctgcaaaagattcagcagcctttcgtctacttttttaaaggcaatggcattgatgatatccagaagctcttcaaatcttttatggtagagcctgaagatataatccagccattcgggatgttctttgatgaataaagacaccttatccagtggtaagaaaagtatttctgcatcttcctcaatctcagctctcacaatacttttttcattgtgcattccgcccagaaaagacataatacagctctctcctgctttgatatagtacagtaaaatttcacgtccatcttcttctgttctgatgactttcagcattcctttcatcacaataggaatggaacggatggaggcattttcatctaaaataatatctccttcatggtaattttttgttgtaccatactgatagagcttttctaccagctccggagatgatgaaaattcggaagaaagtatggtgtcgtcctgcattttttattctaatttacaccaatttcatcaacaaacaaccatgctttagaatctgctccgggatttcctgccgggataattcctgcattttcaatatttaccttaagatattttgcattctgtgatcctacatttactttgattttgccatgggcagcctgaatttccgatgcctcgatttctttgatcagtttaaaattcctgttatcatcaaaaacaaaaatctttgcggactttgcaaggtgaatccagcttcctttattttcaagagtattgaaataaacttctgaaaaagctgttttctggccaaaatctattgttgccaccacgtcttttccctgaaaaccaagccaggttttacccaattgctttatatttccgataataccgtccactaaagtaaaagcatcaccgaaagaatagttttcactcggctgttgttctaaggttatattctttcccgtagtttttgaaacaataaactcctgtgtagaaacagcactcttcaactgaccatcttcaaaataagctgattttatcgttaaagaattaggaatctgaactgccttctgatacgttttagaattaagcgtaggaacagttccatccaaagtatatctgataccgtttgcattttgtgaggttgacagttcgtaggcaattccgttattggaaggaattacttttccggtaatgttataaatgcttcttgcatagttcactttcatttcatcaagaattttgaactgattaatcaccctgttttcaaattctttatagttttcaggatctgatgttccccatcctacttcagaaagcgccattaatcttggaaagatcatgtactgcacctgtttaaaatccaaaatatattctgtccaaaggttagcctgaacacccatgatatatctggcctgctctgcgtttagctcggaagggacaggattgtaagagtatactttgtctaaaggagtaaaaccgccaaaagcattaggctccgattgaggatcaccctgataatgatcaaaataacagtatgctcccggagtcattacagcaaagtgttttgattttgctgcttcaatacctccgtttacaccagtccagctcattacggctgcattcggtgctaatcctccttctaagatttcgtcccaaccgatgattttccggcctttgctgttcatatatttttcaatacgatgaataaagtaactctgtaagccatgttcatcttttaaattattttttttgatcaattcctggcagtgtgcacattctttccatcgtgttttcggacattcatcaccaccgatatgaatatattgagatgggaaaagctttatcacttcatcaagaacgttttcaagaaaagtaaatgtttcatctttcgggcagaaaacatcatcaaaaacgccccattttgtagccacttcaaaaggtccttttgtacatgccagttcaggatatgcggacagtgccgccaaagcatgtcccggcatttctatttccggaacaacagtaatatgcctgtcctgagcatattttaccacttcttttatctgttcctgagtataataataaggtccgtaaggcgtaccgtcaaatgtgttgtcaacgtaagctccgatcatagactccttacgttttgagccaatctgagtaagctttggatattttttgatttcaattctccatccctgatcatccgttaaatgccagtggaaagtattcagcttgtacatcgcgagatagtcgatatactgcttcacctcatctactgtaaaaaaatgtcggcagacatccagatgcattcctctccaggcaaactttggctggtcttcaatttttaaagcaggaattttcttagtttccttatattgttcaaaaatctgaatcagagtctgcagcgcaaggaaatacccttgtctggtgtaagatttaatatgaatctgtttcggagaaatttctatggaataatattcttttttctgttcagtattgactgaagttgacggcattacagtattgatcagatgaatttcattccctttctggatattctgaaatttaaactgaggacttaaacgtttcttaaaatattccgtctcttcttttggcagattattgcttaatacaagcgtttccggaattacaaattctccctgaagaagctcaagcttttgagggtaaggaattaaattcaatttattttgggcaaaaatcacgtttgaaagcaatataaaaaatactaaaaaagtccgtatcattgaaagtggttaaggtttgagctaagataattatttttcaaaactcccggagtctttttaaaaacaaaattcagatatcttaattgttcgggtttttatgaagcgtacaattttaaattgctaagtgacttctatagaaattgttctattatattctgtatattatggtttgttttttgatcaactttgatgacttaaaaaaattaaaaggcttaaatttgtaaaaaaatatgatgaaaaaaagcatttttgtggcagccggattattattctcaatgtcagcacaggcgcaaattttagatattataaaatctaccgttaaagacaaaaccggtgtggaccttaatgttccggtaaaaaataatggtacggcaactccaaccaagactaccactaccacttctggtaattcttctgccaatattggaaacctcacttctactcagatttcttcaggattaaaagaagctttaagtatgggcgtaaccgatggggttaaaaaactggcagtaaccgatggttttttcaagaatgaagcggtaaaaattttaatgcctgaaaagttaagaaagattgatacaaccttacgttccatcggtatgggcagtcttgcagatgaaggtgttaagctattgaacagagctgctgaagatgccgtaacagaagccgctcctattttcaccaatgcgataacttccatgacgattacagacgcaaaaaatattctgttaggcagtaataatgcagcaacaaattatcttcagggaaaaacacaaacccagcttttcaatgcttttcagcctaaggtaaaagcttcgttaggaaaagtaggtgctgatacactttggaaaaacctgatttcaaaatacaatacatttacagggcagtctgtaacaacagatcttaatgaatatgttactacagaaaccattaacggagtgttcaaaatggtggcagataaggaaagcgggatcagaaatacacctgctatgagaacgacaagtattctgcagaaggtttttggggcacaggatgggagataaatgaggagttagatagtagaggataaactaaccgatacgattttaaatataaaagctgtttcatgatgaaatagctttttttaatttcttttgtcttaaaacaaaagaaacaaaaattcaagacctggatctctccgctaaaaataaatcctgttctctaaaaattctaaacttgcgcgaaatcattatttcttaatcggttctgaatttgtctcgcgcttcggacaggagaattttcttaacgttcacagcatttattttcatcacgctccaatctcctatgtcgtttatttcttaagatttataaaaagtttcggcctcactttgtgaggccgaaacttttttatttttaaacagattaaaactgcatttcaggaatttctccttcaatgatcagatctgcttctgtcgctttgataatatcttctactgagacacccggtgctctttccaccagcttgaatcctgccggagttacatccagaacagctaactcagtaaccacttttttcacacagtttactcctgttaaaggaagcgtacattttttaaggattttactttctcctgctttatttacgtgcatcattgcaacaataatattttctgcagaagctacaagatccatggctcctcccattcctttcaccatttttcccggaattttccagttggcaatatctccgttctctgaaacttccatagcaccaagaatggtaaggtctactttctgaccacggatcatcccgaaactgaatgcggaatcaaaaaaagaacctccttccaatatagtgatagtctgttttccggcattaatgatatcagcatcttcttctccttcgaaagggaaaggccccatccccaacactccgttttcactttggaattctacggaaataccttccggaacatagttggcaaccaaagtaggaatcccaattcccaggtttacataataacgatctttcagttcttttgaaattcttttggcaatttgttcttttgtaagcataataaaaacttagactgcaatttaattattttcacttgaatacaaaagggctttgttgtattcaacaattaacactgttagttaaaataatatctgtaattttgcttcattattttaacagaatgaaaatactttttagatatcttaaaccttatcagtggctgattatcatttctttgtttctggctactgtcaatcaggttttttcgttatttgccccggctattacaggaaatatcctggatcaactggttacccatcctaacttttttgataaagagaaactgcttcccagaaatctgaacgaatatttgtatggaagctccgcttatcatggtgctttttactttttgggattgcttatcggtacggcaatggtaagcagaattgccaaagcttttcaggattatgtggtaagcgttattacacaaaaattcggagcaaaaatatttacagatggcttaaaacactcgatggcgttgccttatcaggaatttgaagatcagagaagtggggaaaccctttctattttaacgaaagtaagggaagacacggtaaaattcattacaaatttcatcaatattttcttcggaattctggtgagtattattttcgtgtccttatatgcaatccgcttacactggtctattatgccggtttatatctgtggaattttctttattgccattgttacgaatttactgagcaaaagaataaaagtcatccagaaaaatattgtgactgaaaccacagctttggccggaagtactacagagagtttaagaaacatcgagattgttaaaagtttaggattaaccaatcaggaagtaatccgtttaaataacaatacctataaaatccttggccttgaactgagaaaggtgaaaagcatccgttctttgagttttatccagggaacaatggtgaattttcttcagcagatgattaccctgacattattgtatttgatttttaaaaatattgtgactccgggtcaatatctgtctctgatgttttatggcttctttattttcgggcctatgcaggagattggaaatatcatcatttcttaccgtgaagcagaggcttctcttcagaattttgaccgtttaatgaaaaaggaagtggaagaaaaaccgcttcacccgaaacagatcggtgctattgaagaactggaattcaagcatgtttctttcaaacatcaatctgctcagtacaaagctttgaataatatttcctttgatgtcaaaaacggagaaaccattgcttttgtaggaccaagcggttccggaaaaagtaccctcgtcaaattactggttggactgtacagaccgcaggaaggaaatattttttataatggtattaatggaaaagaatttgattttgatgagctgagaaatcagattggttttgttacacaggatactcagttgtttgcaggaaccattaaagaaaaccttctctttgttaatccttctgctacagaagaggaactagcaattgctttacagaaatcaagctgtacggcattgctggaaagagcagaaaagggtattgaaaccattatcggcgaaggcggtctgaagctgagtggcggtgaaaagcagagaattgctatcgcaagggctcttctgagaaaacctcatctgttgatctttgatgaagctacttctgcgcttgacagtatcactgaagaagaaatcaccactacgataaaagacatttcaaaagaaaaagaacagattactgtccttattgcccaccgtttaagtacgattatgcatgcagacaaaatctatgttcttgaacgcggacagattgtagaaacgggttcccatgccaatcttattgacgaaaaaggactgtactacgccatgtggagacaacagatcggggaaagaaaaacacttactcctcaagcataaaaaaagcgctgaaactgttttcagcgctttttattttattatttaagcttattctttaggtcttactgttctctgctcaattcttttttcaaatttttctccctggaaaattcgctgaaccataattcccggaatgtgaatttcattgggatctaattgtcccggttctaccagctcttctacttcagcaatagtaatctttgcagcacctgccatcggatggttgaagtttctcgcagaacctttgaaaataaggtttccggcatgatctcctttccatgcttttacgatagagaaatctgcatcataagcgtgctcaaggatatgaggttttcctttgaattcttttacttcttttccttcagctacttcagttccgtaacctgcaggagtgtaaaaagccggaattcccgcctgagcagctctgcatttttcagctaaagttccctgtggagtaagttctacatccagctccccggaaagcatctgtctttcaaattcagcattttctcctacatacgaagagatcattttcttaatctgtcttttgtgaagcagtaagcctaatccgaaatcgtctactcccgcattgtttgaaatgcaagtaagatctttcacatcgctttctaccaaagcattgattgagttttcaggaattccgcaaagtccaaacccaccaagcatcagtgtcattccatctttaattccttcgatggcctcctttgcattttttactcttttatctatcatgaaatattagatttttctgttggctaaatttaataaattttcctgtatatctgatgaatggaaaagcctttggaatttcacattgttttgccaccatataaaatcatagaaatcaaatatttacccataaaaatgaacagatctgttcgttttttgtgggatttttcatcaagatgatttatctttggggctttaaattcagaaatacagcttatttgttgttttcagatatcattttaaacacaattttaatgtagaaattattttatgaaaggcagctattgtcgctttacttctttggtctatacacagatcttttatatcaatcgtcacattaatcatatacaatattaagattacataaaaacatgaaaaaattacttacctcagcattacttgcactggtacttagcgtcaatgtgtgcgcacaggagagaacttatttcgatgaagactgggaaaaaaccactcaggataaaatggaatattaccgtgaaacaacttcaaaaggaaaactaacctttatcaaagatttctataaggatggaaaacttcagatggaaggtctcgcttcggatcctactcccaacagtgaagtctttgagggaaaagtgacctggtatacccctgaaggaaaagtatcaaattttgccacctattccaaaggtcagcagataggtcctgcccagacatatgatgttaaaggccgactgacagaagatgtggtatataaagctgacgggactttttcaggaaaaatgttcagctataaagatgctgaagaaggggttgattttaatatcctggttgattatgaaaactccatacctgtcaaaacaacgatttatgatgatgacattaaaggcatcagaagtgaaaccattaccggtaaggattacaatactgaaacgaagtattacggagaaaaggggaaatatctgggaagcggcactaccggtccaggcgaaaatatggtagttgattattattccaacccgatgaggatttccaggatagagaaatacagaaatgatggcagtgtaaaggaaagcgtatcctatagcaaaagcggaaaagttttacaggagcagaaaatgaataagaaagatggctacaaaaccacttatgatgagtcaggcaaaaaaataggacatcttatttatcagtatgataaggaaagtgatatttacaatccaatggatggtgaagattaccagatttcttattcacagatttcatcgatcgatatgtatgaaaaaggctcgattgtaaacagtaagatctttgatgaaaacgggaaattatcctatgaaaagttcttaaaagatgacatcacgcaggaaattaaatattatgctcctgatggaacattgaaatcaacattaacgtataaagatggtattccttatagtggttcatcttatgaaggctttaatgaaacagtttataagaacggtattatttcgaatatcaaaaacttttttgaagatcatacgctgaattatgagaaaaagctgaatgctaagcaaacaagctatgaaacaactgtatatgacagaaagggctctgttctgtatactttttcacaacctgtgagtgaagacggagaagattattcctttacggcacaaattacacaatatgtaaaaggtaagcctgccaataagtcttctgtaaaagaaggtgttattcaatccggaaaaatcagactaaacacattagatggtgccaaagaacttgaacgtaacggaaaatgggttcttttaagactttataatacggatggaaagcttattcaggaaacgaagacgctggccgatgctcaggatgaaactgcctctgctgaaaaccagacgctgttaagtgaggatgatctgtacaatcagtttgactaattatcacaactataatatcaaaggcggtttcaatttttggaatcgcttttttttatttgtccacaaatgacatagatttttataaacttatgtgaacttattctctgtaagaatatcttcttaattagcttaggtattcaaaccttttgtggcttttgtggtttgttttgaccacagatgacgcagattttcaaagatgattatgggaaattatattttttattgatataaaaagagaccatcatttctgacagtctcttcgctataattgtgttttagtttaccttactgaataatcagctttaaagtaaacagttttcttccgtgtacttttacaaaataaacgcccgcaggaagattttcattcacgagagaaaaacgctggttattgatattttttgatacatacagcagttctcccgaagctgaaaccaattcgattttctcaatcgggtagtcacttttaataaaagtaggctgccccggtttggttgggtttggatataagactacatttttctctgtacttcttgtttcttcagttcccaaagtaggtgaagttacctggaactgtaccctgtttgaaacttcggtataggaatcattggtaaacattaccatatagtaattccctggcgttgcaggtacagctgttccctggatggtttttgttccctgagtcactccgtcaaaataggtgtacgaaacaaaattatcatccggagtctgaacactttgaggataaattcctaaccagtctttaatgattcccggagaatccgtccaggaagcggtaatattttcacctaaagtataaacaggtttgttgatccaaagatctgtaacaatatcccctactttaaagaataccttctccccgattccgttatatccgtcttccagtagatactgagcataataatatccttttggaagtcctgtaaaattaagagttccggatgctgttgttacataactccatttgatagaggctgtagttcccggagtttgtcccattttataaattccaatccagtctttctgtaaattgggcccgtttgtaaaattaatagtaaccgttcctcctacaggataagtatcggcagtagcctgaagctgtactttcggtcctatgtagaaattttttcttggagtgatttccgtatatccgttgttggcaaaaaaacctgcaaaatattggcctttattcggaagaccattagtgaaagttacggttcctgcagtctgtccattcgtataaatatatccttgtgaagtggttgttgccggagtttgtccttttttatagattcctatccagtcctgctgatttccgggacctcctgtgaaagtagctgtgatagcttcattctgagcatattctgttttgtttaaagtaaaggtcgggtttgacactacacttcctgtaatttcaaactgcttcacatcactccactcactccactcaaggtttctgtccctgtaacgtgtttttacgtaataaattccgttcggaatagaattcgctgccaaggttgctttagtgatatctactccatcattcaggtttttggttttatccggagttccgtttccgtcttttccgaaccagttttcaaaatcacggtaaaattctttttcaattacagaaaaattcgaagctttactgatcaggaactgagttgtattcaacagctctccgttggaagaagaaaacgcacttccattcaatgttaaaggtaaagtaatcggacctgaaaaattgtttgtaatcgatggtttcgccggcttaggctgatttttatacctgtggaaagaatctaccagtacattgtttttcttattgtacaccccaccgatagaatagcattcaacatctacctttccggttggaacatctacttccacaatctggtacgtccagtctgtcaacgttttctgaacatcgtcaaaatcctgttcatttgacattccccaatactgatcccacgctgttcctccggaaataatctgatagtttggagtatttttaagctgacctctgtggtatagatgatggtgagctccaacatgcatcaggtatttgttggaagttaccagaagcggcaccgcattttcccttacccatgttgagatgtctcctacatactgctcagcctgatagggtctgtggcttaaagaaataatccagtctacagtcggatcatcattagctgccgtcaagatctgctgaagccaggtctgctgtgctgatcctgtatgttcggaacttaaacttacaaataaaacgttcccggcctgctgagcatagtaattctcatttccggaacttatattcttatatttgatttcgtcaatataaaagtgggcataataagaattcattcctaaagtaccgtaggtttcatggtttcctaccgttgtctgaataggcaggtacggagatagtttgatattctttttaaagtgaacattctcataatgatccagtgttcccacatccacctgatctcccaccataaaagtaagggcaatattatctgacggatcggaagcagccccgaatttttcttttaattttttataagcattcagcgtaagggtgtcatatcttggttctgctttgatctggttgtcacccatgataaggaaacggatctttccattggctgttgcagcctgtcccggcagaggaagtgttctgaaattataaacagcagactcactggttcctgtttttattttataataatactttgtattaggctgcagattggtaatctttgctgtgtgataatagtagttattgttgtatcccgtatctgaaaagatattggtggttccggttaccgtcacgttcagattggttggagaatctccatagattactgttgtttcattattggaagaagttttccaattgacgatcatggaattcggagtgggattttgtaaataaggaaacaaaacctgcccgaaagccatctggaccgcgaaacaaaaaaagaagaaataatgtttcataatcgttttcgttttaaaataacatatagaatttcgaattgtaaatcagtcatttaaaaatcattgttcagattttcatttcgggcaaaagtagagttcatatataaacttttgctgatggtattttaaagaaaccgttaaattttaaacataatcgggaagaaaaaattatagtttttagcacataaattatttggcatatttgaaaactattttgtacatttgcaacctgttattcaacctctgacgaaaaacgtgtaagttgcttagctttaacattttatttattaataatggatttattaaagtacgtacaagacaagtacatcgcgaaaaaagaattccctgaattcaaagcaggtgatacaattactgtgtattacgaaattaaagaaggacaaaaaacaagaactcagttcttcaaaggaacagttatccaactgagaggtactggttctacaaaaactttcactatcagaaaaatgagtggtgatgtaggtgtagaaagagtattccctattaacatgcctgcacttcagaagattgaagttgatagaagaggtagagttagaagagctagaatttactacttcagagaccttagaggtaagaaagcaagaatcaaagacgctgcttacaagaagaaataattcagacaacaatacatacaaaaagaggctgtttacttataaacagtctctttttttgttgaaacatttccttactttctatatggggttccacttccggtttccagaaacttttttaaactgccaaggaattgctgccatccgccggaacagatttcatagcattcaatatccggattcaggccgatatgcgtaagctttacctgagtgatagtatttttcagctcaatttcccagacaattgttgtcccgatccattctgtctgattttttaattcaggaagcgcaatcagtgaatcttctaccaaccagacaatttctgcattatccgttaatttttttatccgcattgttttgtgaatctgatctccgaatcttatggtaaagacgccgtctacctgagaagatgatccttcaaacatttcagtccaccaaagaggaatttcataggtcagggcatgatatactttatctgctgtagcattgacctccattacatgggtgtaattctcaacgctatttgtagtaattgttttcataaaattattgtattagctactacaattttatgtaaattattctgaatcagacttttcataagacaagaaatatgcgaaacctcaattactcattcttcaaaagatactgcaaaggtgttgttcctgtatgctttttgaaaaactctataaaagcactgtctgaggagaagtctaaaatatatgacacttcccctattgaattgccttcagccaaaagttcaatcgatcgctgaagccgccattgctgtctccaatcctggtaagacagcccggtttcttttttaaaaatgcggctgatcgttttttctacagctccggttttttgtgcaagatctttcagcattgatggtacagactgccgtaacgtccattcttcggcaattttcgtaaagcgcttatcctgtggcattttaagttccagtttttcttccggagctttactcatttcatcccagaatacttttaaaagattagtctgatcattactaagggccgaccattcccaaaaacaaatcctttcaataatctcctttaataaaggatttacatacaaaatcttcagatcaggttttatatatttcctggagtagcttacgtcaaaatagattgatctgtaggctacaatattcctgaaattcacccggtgaacttcaaaggccggaatccaaagcattctgaaaggaggaagaattaactgcctgtcagaggtagtcactgtcatacagccggatggtgcatacaacagctgggcttttgttgtatgaaaatgaaacccggaatcatgcattaccatatcagaagctatgctgactacttgttcatgaattgaatctgcatcaaagtcttcattttgtttcagtacagccatgtcctatttttgatattttttgtttttatatcattataaatatacattgattttttggaaactttgcagaaaaaaaatgagaaagacaaacccaatctggctcctgactttacttgtcatgcttccgcagtttgcagaaactatttacagtcccgttttgccgatggtacaagagcattttggaatcaatgaagaatcagcaaccctgaccatcagtttatattttatagcatttgccttgggtgttgcattttggggcgttcagtgtgacaggatcggaagaaaaaaatctttggaatatggtcttatcacctatggagcaggcactctgacggctgttttcgctcctgattttatcactctcctcggtgccaggattatttccgcgttcggaattgccgtaggttccattgtaacccagaccattttaagggatacttttgacaaagaaaatatcagcaaagtattttcctggatcgggatcggtttgtctgtcagtccggtaataggaatggttaccggttcaatattagcctcctttggcggacatcaaagcgtatttattacgctgtgtattttgggtttattttttttactgctttccaggcagaagatttctgaaactcatcattcaaagaaatccgtcaacttaaagactttgatcaatttactgaaacggatgcttcatgaccagagcatcattaagtgttgtttactgatcatgagttttaatgttctgctgttttcttattattcactggctccgtttatatttaaagaaaatcattattcttcttatactttcggatacagcagtatcattctggctggaggcacattcgccggagcaaagttcaaccggtttctgctgctgaaaaatatacaacccgaatatttagtgaaagcgtctacattttcagcatttattgcttcggtatttgtctggattcttatcaataaaggagtctgttttttaatcccttatttttttatagtgatggcattcagcattgccattccgaatattctgagtaccgcactcattaattacaaaaatgaaacgggaactgcaggagccttattaggattaatgtattatatactgataggttcaggactgataagtattggttttatacaaaatctgggcatttcgtgtgtcttcttttcaggaattggagtctgtactttattattctttaaggacaaataaattaatttactgtataaagttatacagtgcctcaaaaaatttcgggtatacttcaatatgaggaagatgtcctacattatcaatctctacaagctttgaaccggcaatttcgcgttgggttttctttcccagttcctgatactgccccattttaggttgaagttctttaggagctctgtcctttcctatcgcggttctgtctctcgtcccaataataagcaatgtaggaactttgatatttttaaattcatagcataccggctggttgtagatcatatccgaagtaagcgctgcatcccaggccacctgaggataatctttatgaagagtccaccctgcaattaagtcaagccagggttggtattcttctttccatttattatcataatagaatttcagctgataatttttataggtttccgctgtgtttttaagctcagactggtaggcctgatcaatggtctgatacgctgcgaaagttttataatcttcaagtcctatcgggttttcgagaatcagcttctgtactttatcaggatacagtaacgtaaatctggtcgccaccattcctcccattgaatgcccgagcactatcgttttatcaatttttaattcattcagaaccgctttggtattttctgccagctgtgaaaaggaaaactgataagcatgaggctttgaagactttccaaatcctatctgatcaggaataattactctgaatcctttagcagaaaggtctttcgctgttctttcccaataagctccattaaagtttttcccatgaagaagcatgattacttttccatttggtttttgtggctgtacatccatataagccattttcaaatcttctccctgagacttgaaattgagaaaatgaacttcataaggatattgataatcagataacattgcatccaaaggtcttatctgcgaaaatataaaaccggacatcgttactgtgaaaacggctattatttttctgaaatatttcatgaagctttattttaaagattaaaattaaaaaaaaccgctccaacgggaacggtttcaattgttatttttagttaaatattattaagacacttctgccattgaaacttctttttctttttttgaaggtaaattcatcaaaacaatagcaaaaagaatcagggcaatccctacccattggatgaaaaatactttttctcccagtaaaacaaaagccatcgttacagaaaccggaagctcaagagatgaaacaatacttcccaaccctaatcctgcattcgggaaaccgatattgaataaaaccggtggaatgattgtcccaaacaaagccagaacaaaaccgtatgtcaggaaaattgaatagttaaacgggtgaatatgttctgtattatctgtaaaatttaagtacaatgattttaacccattaaaatacattggtcctatctgggcaaagaataaaaatgcaaaaaccaccacagagcctcctgccagcatgatgatactctttctgaaaaccggaagatgggtagccagcgtattggaagtaaacatcgttaaagtatatgaagcagctgccatcaatccccagaagacgccatgccagtcaagttctatttccatattaataagattggttgccagaacagttcccagcaatacaataattacagaaactacttttcttgcattaggaagtttccgggtaaggatactttcaactaccacactgaaccagaccgactgcatcagcaatacaatagcaatggaaacattgatgtattgaactgcaatataatagaacagactcgttcctccaagggaagttcccgcaagcagcaacattctgacttctttagaacttggcgccgataatttctgcttcgaggttagggtctgaataaaattaaggatcaaaagtcctgtcaaacctaatacgaattgggaagtagttacttctgaggttgtaaaaccatcatggtaagccattttcacaaaagtggccaacataccgtatatactagctccaatccctacaaataaaacaccttttagtatatttttcttcttcataatttttttaacagcctgcaaaggtacgatatataaattaaatgatattggaagtactgtgataaaggataaataaaaatttcgtccagcaagtattataagaaaccctaattaatgattattcttgggaatttatatactatgtttatggatcaaacagtgattttccttttaacttatgttaaaatttaatttttttgcgttaccctattgcataaaataaacgaaaacaataagttagctatataaaaatttaaaatgaaacagtaattattaccgttagtcggactaacaacaccattgtattgttcagtcagaacaatctaatattttaaaaaactaataccatgagaaaacaattactttccctgtcatctttgctgataggatttttggggtattcccaaaccgatgtctattttaaatatgacgaagcaggcaatcaacgttaccggggtttagatgccaatgctaaacaggctggtgagaatttttcaaaagccgaatctaaaactacttctttattttcatctcaaagcatagatgagaaagcgttttggaaacagatacgtttgtatcctgttccagtcaaagatatacttacaatcgactggacagaggaggtggaaggcattattcaaaccgtttcactgtaccagcacagtacggtgcactggaagtttcagcaagagaatataccaagtctaaaccaacagcttaaaatcaatatgtctggttatgaatggggagtatatgtattacgttttacgttaaaggatggaagggttttcagtaaaaatatcaccaaacgctaattaaccatgaaagcttatcataaaaggatgaaagtcttttcatctattatatcctgtatatttatactaggatttgtaccattgctctcaggacaaaatttccatgatactaaaggcaatattgaagtaaacggagcgggccaattacaattttctttaccagttgccctaccgccgggggtgaaatctgtagctccacaagttaacttagtctacacaagcgggtctaataatggaattgcaggctatggctggaacctttccggtttaacagctatctcaagaaccggaaaaacagtagaaaaagacggagaatctaaaggggcacagctagattattcggattattatagtttcaatgggcaacgtttggttcttaaatcaggagaatatggcaaagatggtgctgaatatgttacagaaaaatattcaaatgtgaagattaaatccgtgggaacagcacaaacggcaactcctcaacctatgtattttcatgtaacatttgaagatggttctcaggcgtggtatggagacattcaggctgatgatcctgagctcaattctttgaacgggcgaacttccattgaatacaatattgtaaaatggaaagatcctcagggaaattatattatttattcatatgattataccacagggcagatgcaaggccgtgtaagcagaatatcttccatagaatggggcggaaatgaaactttaaacaaacctcatttcaacaaaattaactttaactatacggacagaagcctgattgaagatacttatgtagggggatatcgatttgtccagaatcaactgttatctgaaatacaggtaaatacaaacggaaatctttttaaaaggtatactgttaattatattaaaaatggtacaaactatcagcagattgataaaataacagagtacaatgctgataacagtgctgccaatcctataacctttacttatccccttccgacacagccggctttggagttttctaataataatgtagacagcttcgataatgtaagattaactggtgattttaatggtgattcttatcttgatttcattatgaataatggcgttgtgaaactcggaggtctgaatgatacttttactgatgtttctactggaaaagtcttcaattcagatgctaagattgtccatacattactagatgaagaaggacaggtttataacggaaatggaatcgttcagtatgaaagtggtaaaataaccggctatattttcagagacaatacctttgtaaaagtctttgaaaaagcattgtttgatccttctacctgcacttcccaaccaggtggtgtaggatgcagtacaacagtaagtctttttaatgaaggagatattaacggtgacggcatttctgatatatttgtgaccttaaaacaaaggatatgtgagtttgtacaaattcccggctgtactgacatagaccctgttctgtcttctgcgagcaagaatgacggagacggaataatcaagccgccgctctgtcagcaattacaatgtaattcttacgaattaggcaattttattgtagatctgaaaaatgcaaataacccattaggtacatatgttcttgatacaggaattaatcaaaattcctataccaatcaaaagtatctggatgtggatggtgatggaaaagtagatattattgacgtttctaattctacctatactgtatttgaatttattaaaaccgctcctgatcaatacctcaagaagattaaatttttcggtagtctggcagaaacaaaagcctctgaatatcccgtattattcggtgatttcaatggtgatggaaacctcgattttaccataccgaccacggaaacaaaagaaaaagataactggagattctatatgggaactgaaaagggattttcgaatttcttaaaaacagactttttgaagtacagaaagcctgatgattataaaaacagctcgtatcctacttttaatatttacagaaacttttattcggcttctgatattaataaagatggtaaatcagatattatacacatcaactcattcaataaggcaggccaggtaaattcaagcggcatgattattacaagatattttggttataatattgccacttatgcagctaatggtgtcctgaccaacggaactccggatttttctgccgctaatgactttggaggaacaaattatgtaacttttaacgtaggtgaatttactttattttcaccaattacctcgcaggtaaaagtaaataacaattactatgatgtgctcttattctggaaagagaggatgcataaacttaaatctccttcttctgttgcaagattatcacagatacaatcaatcacacaaggaggaatcactacatcagcagattatcttgaaatcattcctaataatagcttaactcctggtttttatcaaaaaattaaaaaagaatattacccttacttttctttaaacagaatggatcaatcttatgctgtatcacaacttagacaagaaggacggaagcaggatttccgatacagaggaatgacaggacatatgcagggcaaaggaatgatggggtatcatcaatctgcccgctcatcatggtatgctgacggatttgaaaacattaaagtgtggtcaggtgcagaaatagatcctctttttgatggtgttcctgtaaaagaatggagtatcaaaacaaatgatgaatcaaaaatattccctgtagatctgtctgaaaacaacacccagcttttaagctttaaatcgacagtataccagacggataaattagtaaacggacaagtaataaccggccctgtttctgatactgacaagccaaatcttgtaacggctactgttgctaaaaataccagaactaaggatttcctgacaggtacattaacaaacacatctattacctatggagaatattatcttccaaagcaaagtgttaccaatgtaaataacggttatgccataaccacttcaaaccttgaatatattcataatttatcaggtagcggatcagattatttttccgggcggcctcaatctaaaacagatattatacaggcctatggggatacccaatcttcaaaagaagaattcacctatgagaataaccttccgaaaactctaaaaaagtggaacaggaatactacaggatatgtgcttgaaagctataattatgatggtttcggtaatattactcagaaggtagtaagcaatagcatcgattcacaaacacgcacagaaacaaatctttatgaacctaaaggaagatttgttgcaaaaaaaacagatcatcttgcactggagactcttattgagtacaacgattgggggcagattacaaagcagacagatccattgggaaatacacttaccaacacctatgatggttggggaaaactgctaacctcctctaccaatctgggaggtacaactacttatctgtacaatagagataataattctaatattactcttacgcaaaatgatcccgatggtaatgtatctaaaaaatacaccaacaggcttggccaggaatacaaaatttctgcaaaggctttcggacaggggcaatttatttctaaggacattcaatatgatgtgttaggaagaaagctcaaagaatctgagccttattttgaggggcaaaacgctacccaatggaataccattgcttatgatgattctgtatttcctatcaccaaagcaacagctactgcatttaacggtaagaagatggaaactaccgtttcaggtctggtaacaaccgtaaaagaacttaacggctatggtagaaccaccacaaaaattcaggatgctttgagcaatgtcgcttctaccactgataaaggaggtacaatacaattctcttataatgcctccgggcagcagatcaaagctcagtatgcagaaaatattgttgttacgaaatatgatgtatggggcagaaaatccgaatttaatgatccttctaacggtctttacaaatacgagtatgatggattcgggcagataaagaaaatcataagcccgaaaggaaccaaagaatatatctataattctttaggccaactgatcactcaaaaagaactttccacaaccgataacgggcaggcaaccaataagacaatttcttttacttacgataataaaggtaagcttatctccaaatcaggtactctaaagggacagttatttatctctaattttacctatgattcctatggaagattgttatcatcttctgaaaacagtaatggcagaagctatatagaaaagggtattacctatgacaataagggcagaatatcctcctatgaaaaggaactgcagtcttcggggataattaccaaagctgagattgaaaacgtatacagtacatggaacggagaattataccaaataaaagataaagttactgggaaaagtctttgggaagttaaggaaacaaatgtcaaaggacagatattaaatgccaaacttggagctgctgatatcaataatacttatgattctgatggtttcttaaccaatgttaaccattcatcagcagtaaaaccaaatattctgcaattatcttattcttttgacgcgataaagaacgagcttaagagcagaatcacaggtggagactttaacattgttgaatcttttgattatgatgataacaacaggctaatcaactggacggaccctgttacgggaataaagccgtcagccatcagaaatgtctatgatattaagggaagaattacccaaaatgatcaggtaggagacatcaaatttgaaaattctgaaaaaatataccaaccgacaggaatgaccttaaatgcagctggtacacagaattacaacggtgatcttatccaaagcataatttataatgagaataacgatcctgtaaaaattaatggagagaaagcccgtataagctttgaatacggattaacaagcatgagacaacgtctcgatattgataagctggttcaaattggaggcggaggtggaagttcagattctaaaacaactggagtttgggatcctaacgcgccattatggcaaagaaccctaactaaattatataacgaagatggcagttttgaggtaatcagggatcaggctaccaaccaggaaaagcatattttatatattgccggcactccttatgagtccaatgtcatctatgttaaagattataatgaaagcaatgcctcttacagattccttcataaagattatataggaagtattcttgcgattagtgatgaaataggtaacaagcttgagcaaagacattttgatgcctggggtaacttaacacatttaaaatcaggaaatgacactactataacagatcaggctctgatccgtacctcagcattatttgttgatcgtggttataccagccatgaacatttaatggatgttggaattgtccatatgaatggcaggttgtatgatcctctgctaagaagatttctaaatgcagatgaaaatatacaggatccttataatactcagaactacaataaatatggctatgtactgaataatccattaatgtataatgatccaagtggggagtttcttcaattcttagccatcccaatcgtaaaagcacttgtttttgctgttgtatcctatactgccacagttttgattaccggtgcgaagtttaatatcctgaatttatattctaccattgtaatgagtctgataagtgccggaataacaacggtgataggagatgtattttccacagcctcagcaaccatcggaaatgaagctttaaaaagtctagtgcatgccggtgtgcagggaacattaagttttatgcagggaggtaatttttttacttcagcagcaagcgcattttttgctagctttgtatcttacggatatgcaaaagctgtaggatctgcagcatatagtggtgtaggtcaggtggcattcggaatgctcgctggtggtgttggctcctctcttacaggaggaaacttctgggaaggagtcaaaattggaggaattgtagctttgtttaaccataccatgcacaaaattactgataacctgaccattgataaagctaccaggaaagagttcagaaaattggtaagagcaaagaactatcagggagcatttgatctggtgaatgcaaaatatgatttagatgcagatattaaaggcaagtataccatgaaatatgaagacagcaacgagttttcaggattgacaggcggagaggcttttgaaaatcaagaagttaccattgccacacatgtctttaaaagctctgtagctgtttttataagggttgttcaccatgaatttatccatgtttaccaaagaggtgtcatgggatttgcaggaaatttaaacatttatgaagttagggaatttcttgcctaccatgatacattatttaatgacaagttgcctaaagcaacgttttcaggcatggaaggatattggaataaggctaagcaattttataaatacatgacggacaatcctgcacttatcaaggcatatcagtctcagtataatgattttgcaaattcaagtttttttaaataaaaattatgtacaagtttctattactattttttgtaagttttgtgtccgcacagcagacctgtaaactatctttttccaatacaccgctttcggaaaatggtgaaataatgtttacagttaaaaatttaaacaatgagaaaatacatgtaccaaagcggtattcaggtatatgggccagacctatagatattcaggtatacagcgatgaaaaaagagaatttcaggatacaaaatacagctttgacggggcaggctgtttagacacaaaaaaatgtttaggacaaatggaatgccttaaaaatggagaatccaaagaatataaggttatcattcttccgggaagaatttcaaaagcttttagggagaaaaaaaagtatagatttaagctggcttttgaaacctatcttttcagcggatgtgctgattataaaacagattggctttattatcagaattaattggtattattaaccataattattccctgggtagaagtgctcagggaatttttatttcactttatctggtaaaacttatatccacaaaaaaagccgctcgaatgagcggctccctatttatatcaatggttcaaagattatttaccttcttccatttttcttttcaactctgctaatgcatcgatgtctccaagagtagatctttcttcgttgttagaagaagaagttacgtttctagaagaagcttcttttacgtttttcttctcttcgtctctgaagatacctgtgtgagatactactactctcttgaattctttgttgaattcgattactttgaattgagcttcttcaccttttttgattttagatccatcttctttctctaataatcttgaagggcagaaagcttctacttcagcatcttcgaattgaacagaagctcctttatcgtgaacttctacagctttaccagcgtggatagttccttcagcatatttagtttcgaatttatcccatgggttttcagtcaattgcttgtgacctagagataatcttctagcctgaatatctaattcaagaactacaacgtctaatttatcacctactgcgcagaactcagatgggtgcttgattttcttagtccaagaaagatcagagatgtagattaatccgtcgataccttcttctaactctacgaatacaccaaagttagtgaagtttcttacagttcctacatgctgagatcctacaggatacttagcttcgatgttttcccatggatctttagacaattgcttgataccaagagaaatttttctttcttctctatctaaagttaatacttcagcttctacttcatcacctacttttacgaaatctccggcagatcttaagtgagtagaccaagacatttcagaaacgtggattaatccttcaacacctggagcgatttctacgaatgcaccatagtcagcaagaactactacttttccttttactttgtctcctactttaaggtcagcagaaagagcatcccaaggatgagcttctaattgcttcatacctaactggattcttgttttctcgtcatcgaaatcaagaattacaacttttacagtctgtccgtcctcaaggatttcagatgggtggttcactctagaccaagaaaggtctgtaatgtggatcaatccatctacaccacctaagtcgatgaatacaccgtaagaagtgatattcttaacagtaccttcaagaacttgtcctttttcaagttgagcgatgatttcttttttctgaccttcgatatctgcttcgatcaatgctttgtgagatacaactacatttttgaactcagggttgattttcacaactttgaactccatagtttttcctacgaactgatcgtaatctttaattggcttaacgtcaatttgagaaccaggtaagaatgcttcgattccgtgaacgtcaacgatcataccacctttagttcttgatttaacaaaaccgttaacgatttcaccagtttcgtgaagttcgtttactttatcccaagctttaagcgttcttgcttttctgtgagataattgtaactgaccagttttgtcttctcttttgtcaaccattacttctacctcgtcacctactttaaggccttggttgtaacggaattcgttaagagagataacaccttcagatttgaagttgatgtcaacgatagcttctttatcagttaatcttacaactttaccaattagaacgtcgttatcgtctaagttgtttaaagatccgttgtagatttcttctaaatcgcttttctcttttctagcatcagcatcaagaccagattcgaaagaatcccagtcaaattgttcaggtgctacgttttggtttaataataattcagctgaatttgtctcttttgacataattctaaaaaatttgtattccttctctttcaacggtcttaatcaatgtgattgaaaaatacggaagttattaatatttaatattttactttctcagacctttaccacaaaaagtgggtgcaaagataagcaatttatttaagataagcaatagatctcaccatctttaaagttcatataactccatgataatcaattgtcatctattcttttttcattaaacagtacagctgattatggaaattcttcacttcgatgccctacgctcagaatgacagtaacgtcaaactataactgatcttcatctcaaaccttcccgttcacaacctaaaaaccctcctactctcaaactctcaaactctcccactcaaaattcaactccgaaattcactacctttgcaccatggaactacaatcaatctatcagaaactgcagattcaggatatgaatcagatgcagaaatctacttataaagcgtctgaaaataatacggatattgttttgctctctcctacaggatcaggaaaaacccttgctttcttatttcctgttctcagaaatctgaaaaaaaatgtacagggcgttcaggctttgatcctggttccggcaagggagcttgctttacagattgaacaggtttttaaagcgatgggaacagattttaaagtttctgtctgctatggcggacatgataaaaaaattgaggtcaataatttaattgaagctccggctgtattgatcggaactcccggaagagttgtttatcatttaagaaataacaattttgatcctaagaccatcaagacattggttcttgatgaatttgataaagcactggagctgggctttcatgatgacatggaatttatttgcaattctttaaaaggactttcacaaagaattctgacgtctgccacaacaatggatgaaattccggcctttacaggattgaaagatgaaaaagtaatcagcttcctgaaagaaaatgacataaaaccggaccttcaactaagaaaggttatgacaattccggaggaaaaactggatacgcttttcaacctggtttgtaaaatcggaaacaagagaaccctgatcttctgcaatcaccgtgatgcagtagaccgtatctctgaacttcttcatcagatgggaatagacagggaaactttccatggcggcatggaacaggacgaaagagaacgtgccctgcttaaattcagaaatgattccgcaaggattcttattacaacggatctggctgcccgcgggcttgacattcctgaagtagaatctattgttcattaccagcttcctccaaaagaagatgccttcatccaccgaaacggacgtaccgctagaatgaatgccaaaggttttgtctacctgatcatgactgaagaagaaaacttcccgttcattaaaaataatacaccagaagaaagtgttgccgggtttactaaagttccacaaaaaacacctttccagaccatttacatcagtgcaggaaaaaaggataaagtaaataaagtggatattgtaggttatttactgaagaagggcgaattacagaaagaagatgtgggaattattgaagtaaaagatactacgtcctatgttgccgtttccagaaataaagtcaatgcacttttaagaaagcttcagaacgaaaaactgaaaggaaagaaagtgaaaatggaaattgcttattaattaaaacatcaaattaatatatacaaaaaatcagatatgaaaattaaaacattcattgcagatgcttttaccgataaactatttaagggaaatcctgccgctgtgtgtattgtaaaagaggctatcccggaagagaatatgattcagattgccaaagaattcggcttttctgaatcggcatttgtcattcaaaaagggcctgctgatttttctatccgttacttttctccggttactgaaattccattatgcgggcatgctacgatggcatctgcgaaagttttgttttcagaatatccgcattttgatacgataacattcaaaacccagtttgggcatattcttgagctgagaaacaataataaccggattgaaatggtgtttcctgtacatgaaaccgaaaaatcccagtttcctgatgacttaaaaagcgcaatcgggataaatgacatcatcaattgcgaatacaataaagaccacaatattctgatggtggaaatagaaaacagtaagcaactggaagatttagacccggattttgccacattaaaaaagatcaaaacaacaatcagcggagttctggtaactgcctcttctgtaagaaccggctatgattttgaatatcgttacttctggccatggtcggggtccaatgaagatccagtgacaggaggagtacagagttttttatgcaaatactggtctttgaaacttgataaaaaagttcttaatgccttccaatgctctgaacgcacaggaagcatggaggttgaattaaaaggcgatcagacaatcataagaagcaatgccataatattccttaccggcgaaattgatcagacaaccaattgattaattactcatactaaagttaaaaaaaactattttactcctttcaccttagtcggaagcgtgtaaacggattttgaagctgtaatgaagagcacatcattattttcccctccaaaagttacattagatgtccagtcttcctgaataggtatatgataaattttctttccgtgattattgaaaatatgaactccgtttcctgttaaatataaatttccatgtttgtccatagtcattccgtctgagcccatttcacaaaagagttttttctcagacagttttccttcacctaaaatatcatacacataagtctttccggcgtcaatatcagaaatgtacaatttctttaatttttcacttcctacaattccattgggctgtgtgaatgtttccagctttgtaacttttcctgttttatccctgtaataaagacttttatgaggaagttcctgtttgaaacctatccagtaatcccttttgtataaaggatctgtaaagtacattcctccaaattcatcattccacacatcattgggaccgttcagtctttttccttcaaaacctttaagcagaacttccacttttttatctttggaaattttccagatctctccctgatcgtctgaacaggtgatcagatacccgtctttgttaaaatgagttccgttggctcttcctgttttatcaagaaattctatcacctgattgcttttccagtcccaataatagatcttatcattaggctgatcggtaaagtaaacatttccatccttatctgctgatggcccttctgtgaaactgaacttatctgaaaccttttccggctgtactccttcataaaacattttactataatttactgattgacagtttaccaatgcgaaaaccaaaccaatcatacctattttaaagatattcttcatacttcatttttaaacccgcaatttacaatatcaataatagctttcaaaatattttctctttctgatacaataaaaaaatgcaatttaaaaatgtcccaattgtactattttttaagtagatcatattagcagcaaaaagatataatgcggagctttgcagtagcaggatcaatcattttttcatagaaatcaatgtgagaaaaaagatcggtcaggatgaaaattgtaccaaaatactttatagcatacaacaatgagcgcagaatccaacaatatcaagtctttggaaattgaaaatgaagatttcagaaattctgtaggaaccatggatgaaaccggaaaaaggaaatgggtttttcccagaaagcctaaaggtaagtacaccaactacaggaattatacaagctatcttcttcttgctttatttttcgggttgccgtttgtaaaaatcaacaataatccctttctgcttattaatgttatcgacaggaaattctttattctcggccagcctttttacctgcaggatttttttatccttgctttaggtgccgtaacttctgtaatttttgtgatgctttttacggtagttttcgggagaatattctgtggctggttgtgtccgcagacccttttcatggaaatggtcttccggaaaatagaatattggattgaaggagacaggaataagcagatgaaacttgacagacaggaatgggacgcagaaaaaatacggaaaagactgaccaaatggtctgtatttctcttgatttcactgatcatttcccaattcatgttcatgtacattgtcggatatgaagaggttttccatattatgagtgaaggacctgccgaacattcactgaagtttgtaacgatgatattctttaccatggctttctattttgtttttgcatggctccgtgaacaggtctgtacgttggtttgtccttacggaagacttcagggcgtattgattgacaagcaaaccattaatgtctattatgattttaaaagaggtgaaggccgcgcaaaatggagaaataatgaagacagaaaagctgcagggaaaggagattgtattgactgtaaccaatgtgttgtagtctgccctacaggaattgatatccgaaacggtcagcagctggaatgcgtgaactgcacggcatgtattgatgcgtgtgatgaagtaatggaaaaagtaggtttgcctaaaggactggtacggtatgctacggaagctgaaattgaaaatcaacacaagttcagatttactccgagaatgaaagcaaacactgtaattcttgctctgttaatcggatttcttggatttttaatgtacgaccgtggttctatggaagccaaattcattaaaccggcaggttctacctttttcgttaaaaatggtaaaatcaccaatacttttatttatactcttctgaataaatcgaatgagaagaaaacccttaccattaaagttatcactccggcaaatgcggaaatcacttattttggttccgaaaaaatcatattgaaaggagaccagatcctgaaaggaaacatcaacatttctttccctgaagacgagattaagttctcaaaacaaaatatggtgattggagtgtttgatgaaaaaggaaaacttgtggattcatttgagacaacttttgaaggaccatttaagttggcactttaggttgcagatagcaggtatagtttacaggaatagtcattgatatttccattattcccctcttctggaggggtggcgaaaattcaaagaatttttgacggggtggttccaataatctctcccctgaactttaaactttaaaccttaaactttaaactgattaagctttatatttcctcataaactgtgtgggagtcattccggagcttttccggaatactcttacaaagtaggaatattcttcatatcccaatctgaaagcaatttccaccaggctttcgtccaggtacatcagcatccttttagcttccagcactactctttccgtaataatatcagtcgctgttttttgaacaacagtctgtgcaatcctgttcagatgtttggatgaaattcccagcaaagatgcgtaataagcgattgatttctgctgtgtaaagttctgctcaatcaggttttcaaaatcctgaaaatgtttaaaataagaaagtccggctgcggaagctaacgtatcaaagtcttttgaaaacaatctggcagcattaatgaaaatctgggacatcaatgacaaaataagaccttctttcataatattttttgcctgatgttctgcgcccagttcctgaaacaaacttacattcttcctaagctcctgggtatccagctgaagttttctcggaaaagatacagatccgaaaaaaggaaagtttcttagtttctgattgacataatgcatttcataaaattcctgggaacaaaagaaaatataaccttcaatatcctccgaaagctcccagctgtgaacctgccccggcgacagaaagaaaagacttccttcagagacttcatatttatgaaaatcaatttcatggactcctgacccttttgtaaagagaacggcagcataaaaatcatgtctgtgaggtttctctatatgacgatgtcccaccaccagatgattcttcatggtattaaagtaaaagtccgaagtatttttacccgtctgaaaaagatcgatatgaagaactgagatcggattcattactatgagtgtaagaatttacaaatttagataaaaagaaccggcatatggtaatccttttatatgacacttcatttactcctataaattcctttaaaaacaaagcctgacagcactttttgcaatatattttggataaaactttaaaaaatttttatctttgaagtttaggagttgtaaaatgaaaataaatttacctgataaactgtattattctataggagaagttgcaaaagcattcgatgtaaacacttcattaatacgctactgggaacaggaattcccgattatcaagcctaaaaaaaacagaaaaggaaaccgatatttcacccctgaagacatcaaaaatcttcaaatgatctaccatttggtaaaagaaaaaggttacacccttgacggcgcccgtgtagctcttaccaccaacagtaaaatttccgaaaccatcaccctgatcgaccggctggagtttgtaaaagctgagcttattaaactgaaagaatctctgggggaaaaggatagtgaataaggtcttcaaaatatagaaaagccgccgcaataaattgcggcggctttttattaattgattgattatggagctattcactgagatggaactgcaaaaaaaattagtcaattcgagatctttattcaggtaaaaattattcatcctcttttttaaaactcactaccagatattctccggttgaacaatattccttacagctatcatctttaaagctttcaggttttttggtgaactcttctatatattttgtgctttcagctgtatcagccggaacgataacaatatggtaattgtcaacaactgtactgtcagcttttttcaaagcctcttccttgtattttaatgcttcactgtatttcatagtactattaattattggtgttgaatagatatggcaaaaaaattacaaaaaccaagccgtttgaaggaaaagatgctacatagaaaaaacatccagaacttttagcttcgattacgaaattatatcacataaaaacgttatactcattatcttataaacaataaaacactttctctatataatctttaaccatttcatcatcagctattgctgtgttttatttttatcaataagtttacttcatgatgagaaaaaactattaccggaaactggcatttatggtcaccttgctgactgttttatttgtctatcaaaaatatacaagccgggaaaaggagccttttcctgaggttacattcattgcagatgcttcagcacctataagcctagcagattttgatcccaatacgttaaacaaagagcaatggaagaaactgggattttcagaacagcaaaccgctaccattcttaagtataaagatatcgtaggcggaaagtttatttcaaaagaacagctgagaaaatgttatgctatttctgaagaaaaattcagtgaacttgcatcttttatcatgcttcctgaaatgacagaaaaaggaaattcaaaaggattcaatacaattgaaaaaaaaggaattatcatttcaggaaagttcaatcctgatcagttttctgctgatgactggctcagaatgggtttcagtgaaagacaggcagaagccattataaagtataaaaattatttaggcggaagctttataagtaaagagaaatttaaagaatgctttattatttctcctgaaaattacagcaaacttgagccctatattctactaccggcaaaaactcctgaaaatttcagaaattttgcgaaaaacaatcctataaaatctaaaatccagtattacacttttgatcctaatcaattaaatctgaacgagtggaaagcgcttggattctcagaaaagcaggcagccaccatcatcacttaccgtgacaggaatctacagggaagctttaagaatcctgaagatctgcaaaaatgttttgtgatttccgctgagaaatttcaggaaatgaaaccttatatcaaacttcaggaaaaacaacaggaaaaaactgatttttcaaaaacagatcttaatacgattactttcaaacagcttatagaattcggactggacgaaagaagcgcgggttcaatcattagtttcagaaataagctgggaggttttatgaataaacagcagattctaagcacttataatattgatcaggatcttgttcaaaagctgatttcaacagcaccgttgaatacgtccaatgtaccaaaatatacactagtagatgcacctgaagtatggcttaaaaatcatccttattttaaatattctgcagacaaaatcatatactaccggatcagcaatccggatgataaaaaaatatggagactgttgaaattaaaacccgaatacgaagaaaaaatgaaattatacataaaataaaactattccaaaataacatcccggaatagttttatcaaggttaaatactgaattttaatgatgcatataactgctggggccgttggttccttcaatcgattcaggcagtattccatatttgttacgcagatctactgttcccagtttttttccggtattaatatcaataatactgatggttccggagtttaaattaggaagatccaacagattattttgtaccgctacaacatcttttcctgatctggttttaaagaaagccatatgatgagctcctttatcagcgtcaaaagttttcaaaagtttcagctgaggaagattgcttatatcaaacacaagcacttttccaggatctgcaaaacttacgtaaagtttattggaatcatcaatatacatttcaagtgtccagcctaacccttgtgtgcttccgtcaaagatcttcgtaaaggcatcatactttttggttgtattattgtatggagctatccagatatctcctccaagcatggttgtagcaagcgcatactgtggaaattttccacgcagcagtaaaacttcaacaggagcagacaaatctgttggtgaatctgctacctgataggtttccttgatttcataagtattcaggtctaataaagtacaggtatttcccatccctgttgtaagatccggatgaatggtagaggttaccatcatcaaccctttttcttcattaactgaaataccatgcggatacatgataaatttgttgggattactctgaacaggtgctttaatcgtcttgataagctgattattgttagcattaaaaaccccgatgctcccatctttcggacctcctgccccgcccatgaaagtcataaaataccttccatcattagtgaaaaataaattttcgcctaccgtattctcaccggtatcaataggggttgcacttatgagttttggctgcccattctgatcttttcccgttcttacttcatagaggtagctgcctcccaaagctgttgtaaacattttttttgcatcaagattgtaataaatatgatgtggcaatacaccaatacccaattcaagcttactgctgatgtttccaaaatttggagcttcaggatcaagctctataacagccattccgtctgatgctccttttaagcttctgtaatcaatgtaaaacgaagtgttatggggatggtcgggattgtgattctcgttcagacaactcgtaaatattgccaacgtaataaacaggaatactgaattaaattttaatttcatgattttatgattatggttgttagtcttataaatataatatatttcctgtgaaaaataaaacatattacactaatatgtgaaaaataatcgctaataaaaaaaataccatccggttataataccgaatagtaagaaattaaaatcgttaaaaaattctgcttttaatcaaaggttttactggaatcagtcagtaaagcgtttagcgtattaagctcatcatcagtcagatctctccactttcctaccggaagatcaagcttgatattcatgatgcggattcgtttcagcttttttacttcatatccgagatattcgcacattcttcggatctgtctgttgagaccctgagtaagaatgattctgaaattcatttcatcaatcttctcaacttcacattttctggtaatggtatcaagaatcggaacaccgtttctcattttttccagaaactttggagtgattggtttatcgacacgaactaaatattctttctcgtgattattacgggctctcagaattttattgacaatatcaccgtcacttgttaaaagaataagtccttcactaggtttatccagtctgccgataggaaaaatccttttcggatggttgatatagtctacaatattattcttttcgcgttttgtatctgtggtacaaacaattcctaccggtttattaaaaacgatatataccggtttttcctgaggttctctgatcggtttcccatctacttctacaagatcttcgtctgaaacttttgttcccagctcaggaatttttccgtttattttgattcttccctcttccaaaagcttatctgctgctcttcttgagcagtatcctacttctgataaatatttattgatacgcgtcttttccattagtcttttccgtagccggtataattttattgctgaaaataatatttttgtaagttaagcctgtaaaaaactagctgtattttaaggcttatgcattcatattcttacaggctttcgaatctgtaatcattatgcaggaactgatctgtagcatcttcaatcgcataatcacctattttggtacgtctcagctgtgtcagataagctcctactcccagttcctgcccgatgtcatgagccaggcttctgatgtaggttccttttgagcatcccaccgtaaaacttacaagaggaaaatctattttgatatctttaatataatgaatggtcgtttttcttgccttcatttcaacttcttcgcctgctctggcaaggttgtaagctctttccccatcaattttaatggctgaataaaccggtggtttctgttcaatttctccgacaaatttctccagaacttcttttacctgttcttcagtaatatgagagatatcctgatgaaggatttcaggcttttcagtatcataggactccgtctgtacaccaatcttgatctctgtccagtattctttaggagcatcctggatctctggaattttctttgtgaactttccacagcagacaatcaaaagtccggttgcacggggatctaaagttccggcatgtccgattttaaattttttaggaagatcaaattcccttttaagtttatatttcattttattgacagcctgaaaggaagtccagtccaagggcttgtccaataaaaaaatgtatcctgatttcagttcttcagcggtcattttttccaatattatttatttcttccacttgtttgaaactaactttatatttattgacaagataaagaagaattactaaaaatatagttattacagctttataataataatgaatataatcagaattatgattaaaaaataaagcaataaaagatttactatttattaataaaactaatacgaggtaaatatttattaattgtattgcaattctttttttgttaatcaagaaaatgaaaattacaattgcaaaaataagaatacttattgcaaaaatattatgttttaaacctacattataagcaaaaggatgaatatttaaaggaataatgataaagccaccgaggataaaaaataacaagcaaagagcattaacaaatttctttttaaataatattttttgcactatttaaagaaataaaagtaaatcaacagggcaattcctacaaaaatacggtaccagccccaaggtttaaatccatatttattaagtactccaatgaatgctttgatcgcaataagagccacgataaatgccactatatttccgatcacaaagatcataatgtgatcctgagaagccatgatcatttcatatcctttctgtgggtgggcagtttcttttccccaggtcttaacaaaaaccgaatataccgttactgccagcatcgtaggcaccgcaaggaagaaagagaattctgcagcagcttttcttgtaaggccctgtgtcattcctccaataatagaagcagcactacggcttgtacccggcatcattgcaagacattgccagaaaccaatggtaacagcttttcttattgtaattcctttttcgtcatcaattttaggattcttaaaccattcatcagcaaatagtaaaactacaccacctaacaccaatactgaagagatcgcaatctgatttccaagaacagcctcaattttatcatcaaataaataccccagtacaagagccggaactacagcaaaagcaagtttgaaatagaactgaatattatttaaatcaaaaaactttttccagtatgctaccactacagataaaatggctccaaactgaatagacacctgaaacatttttaaaaattctgtttcctccaaccccataagattcgctgtaaatcccatatgtgccgttgaagaaatcggaaggtattccgtaagcccttctacgatggcaataataattgctttgattaaatccatattcttttaaaaattaaaaagattaaaagatttaagaattaaaaaacagctcattagcttacatctttcaattcttaaattttttaatccttaaataaaattattatttattttctttttaagattgcgtacacttctattacaaaaccgattacgacaaacagaggcgctatcctgattcttctgatagaaaagatatcgtcattccatgagttcggatcaaattttccatctaccgtattagcatcaggccccatcatcagtagaaatcctacgacaataaatgccagccctatcagcatccatttgaaattctgctgcccgaaatagaaagcgttttcctgtggtacttctgcttcacgtccaaagtctgaagcggaaaatttatttgtttttttgctcattattaagagtaatataaatcgtcaacgtttgattttaagaatctccatgtagcgaaaattgtacttaagacagaaataaaaattcctactccaagcaccaggatgatcaaccagaaatattgattgttgtcctgtacaaaggcagagccaatctggcttgtgaaataataccagactcctccaagagcaagaagacctattacagagccgatagctcctaagataatagcttccacaatgaaaggtttaaggataaatcttcttttcgcccccaccaactgcattgttttaataataaatctcttcgagaatattttcagacggattgagttgttgattaatacaacggccaatatcaggaacaaaattgaaaatcctaggatccattttaagattctgctcaggttattgtacacatccaccatcaaagtgctgtcattcttaacatcaacaattcccggaacggacttgatctctttaatggcttcatcaattttggcaggatctacgaattccggttttaaagcaacttcaatagaagaagggaaaatattttcctcgaacaatgcatcactgtcgattcccatacttttcttggcttcttttgccgccatatctcttgaaatataggttgctttttttacaggagctaataactgtacctttttaaaagtttcttcctcaagttttgcaatttttacagaatctttagcatcatagttttcatcaaaataggcgttcaccaccaattgttctttgatatagtcagaatacttctgggcattgatcagaataagccccattaaccctaacaaaaataacactaaggcaatacttatcactactgtaatattgctggaccgaagccttttcttattaaattcatctacagatttagccattaatattaaaatttttggctaaaatagaaaaaaacttccgaaatttgggacgaaataaagaaaatcattgttaataaaatcataaaaaactttgagtgtaaaagcaaaaaaacatctggggcagcacttcctgacagatgaaaacatcgcaaggaaaatcgtagaaggccttagttttgagaactataataatatcatggaagtgggtcccggaatgggcgttcttactaaatatcttcttgaaaaggaacagaacatctaccttgcagaaatcgatacggaatctatcgaatacctgaaaaacaattatacaaaggttacagaagaaacttttgtcggagatttcctgaagcaggatttcaacttcattaaggaggatcagattgccatcatcggtaatttcccttataatatttcttcccagattttgtttcagattgtggatcattatcagctgattccggaaatggtaggaatgttccagaaagaggtagcggaaagaaccgctgccgttccgagaactaaagaatatggtattctttcagttctggtacaggcctattatgatgtatcctatatgtttacggtacatgagaatgtcttcaatccgccgccaaaggtaaagtcaggagtcatcagacttacaagaaatccgaaggaaggccttgcagggaacgaagttctttttaaacagattgtaaaagcaggattcaatcaaaggagaaaaaagctttccaatgctttaaaaatattaaacattcctgaagctttaaaaggacatgaatttcttgacaaaagagctgaagagcttagtgttgcagattttatacactttgctaatctctggaaagaaaatcagtaaaagatattaaaagcttctaatagagaagctttttttgaatacaatattggcatataatctcttaaaaagcagaaagcctttcaagtacatttgaaaggctttctttatgttgcattatcaattttagtttctgttcttcagcatgatccatcctgaccagttcatctgagcttttgattttggatactcaaactggaacttataccagtatgttgctgtcggaagtctcttacctcctacggttccgtcccagataggattttcttttgagaacctgaacatttctactccgtatctgtcatatacagaacctgtaaagtttttaaagtctccaagagctttaagatccagtacatcattgattccgtcttcgtttggagtaataatattgttgatctgtaaagtaaagaattcaagagatccaacgcagtgtgtgcctactcttcttactaaaacagtatagtttgtattatctaaaaggttgctgaatacgttagaagcctgccatgtaataccaccatcaagagaatattccaaagtacttgatgtattgttcattggcggattttcagcagtgatggttactgttttcttgatgctttcataatttaaagcagtaacaaaaggagtagctgctcccattactttagcttcaaagacttttttacagataccgttatcaacttccacactgtagatcccccattgggttacatcaattttctgtgttgtagcccctgtactccaaaggtatttgaaaccttgtcctgctcctgcatcaagggttacagtatctcctacacacatttcaacatcttttaatggtgaagtgatttccggcgtaacttcaattcttatggttgcagggttcagagatttacatccttttgttccaattgcatatactgtaaatgttgtcgtctgatatagagtaaccgtctgcatattaccagttcccatgaaattgctccacaggtaggtatctcctccttcagcagtaagggttacagattctcccggacagatttttattctggaagcttttactttcgctgtaggcgtaacttctttcagtaatttcaattcaactattttactacagaatcctccgttggaaacaagtacatacagaatctgtccatcattaccattataattcaatggcgtctgaatataattattattctgggcaactgcatccgcctggttttcgtaaaacttaaagatggctcccggtgtcgggcttatcgtggatgtaattgtacttaggtcaaaagtagtaatatccggtgtggtacacagcagcaatgtagcatcctgagcctgaggagttgttcctccgtgaatttctattgatgcttttcccggacatgggttaccaggaacacttacttcaattgtataggtacctggctgtattgctgtaatggtattggtagtggcatttggtaccggtgcaccattataataccattggtaaacaaggttagggtcacttacagaagctgtaattacctgaggtacattatcacatacattgatatctgaaggtaattttgttcctgctgaatctaaaagatctactccaatattaaaagatcctccttcaaggaatactgcagagtcataactgtggtcactgtaatcggcaattaccattttgaagtgatattcctgccctgcgactaccgttgctgttgctgttaaaggaattgttcttccttgaaaatttgtttcaatattcgctgtattgtaccctccaaaatactgttcgtttactgcaccacagctggatccgattgccgggtggatatttgtaatacttaccggtcctgcaccaccaggtagtacagccatattcacataaggtccgcctgaagtaggtctcaataatatagcaaaagcatcagcaaacgtacaagggaatgaaccggtgtattcttcagacgcaatcagataattaaatttaatctgagaggttgtaggaacaaagtcaaattccagaagaacagcatcgttcaacctgttttccactactccgattacctgtgcaagatcagggtctgaacctccaccattaatatcactaagcgtattcccttcaagaccgttccctgcctttcttgcaaatcctgtggaaagaataagaccatccttaaaaggaaaattggtagtagctttatgaaaatatccccatgctctgtcagcatcactggcagcatgattaggagtaatctttacattggttacgttcggagtaagacaagtattggttcctgatgagatcaatacatctttaaccattttatcaatagtgtagctactttcagcatactgcggagcgttcacatcaataaaagcgcctgctcttcttgacagtgctgtactgggttcctttacactctttctgggtaatggggtctgggaaaataaaaaagtcgagatgactaaaaaaaataaacaaagcggtagatatcttctcataatatttttgtttcaacaaatttaatttttttttaaatatctcatatacatatttacattttttacagcaaaaaatcaaaataagatcgttttagagtaaattttcgttaatcaatccctatccggacaaaccataaattgtgtggcagtattgttttaacatatttgccatctatttcaaataattcacgaaacacggtacaagttccctttaaaagcaacaaaatctctcattgctgagagattttgttgcttattttttattttgaaaatatctagtttctgtttttgagaagaatccatcctgagcgctgttccagttttttactggcagggttttcccactgtaccctgtaccaatatgttcctgtaggaagattgattccttttaaagatcccctccagataacatcacccttaccagctttgaatacctccgcaccgtatctgtcaaagatagaagctgcaaaatctttgtaaccgcttattccggagaaatctatagtatcattgatgccatccatattaggtgtaatagcattgctgatgatgaatgtaaaataatccagtgaagtaccgcatttagcccctttcacccttaccattacagaatacatggtattattcaaaactcctgtaaatacatttgatggctgccatgtcaatccaccgtctatagaatattccagaatgccgcctgtaggattacttgccgtaagcgtgagaatatgattatcataaacaatattcgtaaactgtggcaggtcaggattgatcagctgtgcagagaaagttttggaacaaactccattgctgattgtcacagaatacgttccgggaatattagttgttatggtttgcgtggttgccccagtgctccatacataagtatagtttggccctgaaccggcatccagagttcctttatcccctgcacatacaaatacatcttttaaagtagaaacgattgcaggaactacctgaatggtaactttagccggatcaacagaactacatccgtttccacccaatgcatatactgaatattctattgttgctgtaggcgtaacaatctgcgtatttccatttccggtaaggcctacccagttataagtaatacctcccgaagctgttaatgttacagattcaccttcacatatttttaatttagatgctgtaagacctgctattggcggacctacctcaaccgtcacactggccggtgttgcagaaatacatccattagctccaacggcaaatactgtatatactgtagttgtagtaggcgaaaccacctgagtatttccatttccggtaagaccattcccccagttataggttacccccccggatgctgttaatgtcacagattcaccaacgcagatacggggttgtgatgaaaccagtgcagcaaccggctgtactttatcttcctgtacggttactgtagacgtaaaagtacaggtcaggtttcctggttgtgagacattcgtaaccgttaaagtatacgttccgccagcgcttacaacaggggtcagtgtatttcctccggatacaatagttcctccggtagttgtccaggcaatggtagatcctgcaggcactacagatgctgaagcattgatagttatctgaggatttgtacaggtaattgtttgcggagcagcaattgtaagcgtagtctgagctgtgcttaataactgcaatgatactacgtaactacaccctccgttgcttacgagtacgtaaatagtctggcttcctcccggcggtgtataagctgtaggtgttacaataaagtttccgttagcagcaatggcatcagcctgattgacatagtaagtaaaagtaactcctgctgtagtggtgatctgaggctgggcttctataagattataagtcaatcccggctggtaacatttatgtaatgttgcattctgtgctgtaaaaggttctgaaacttcgattgttatactcgcgggattttgagatgcacaaccgttagctcctactgctgttacggtataagtagttgtcacggtaggtgaaacaacctgagtattaccatttcctgtaaggccattaccccagttataggtagccccgcctgaagcggtaagtgtcgtggaatctcctttacagatttttattttgcttgccgtaagaccagtaacaggtggagcgctgtttcctgtcacggttacagttcctactgctgtacagctgatatttcctggctgatatacttttgtaatggttaaggtataagttcccggagcattaataacaggattcagggtagttcctcctgaaacaatatttcctccggtagtggtccagttaaatgttgcacccgcaggataaacggaggctgatgcatccagagtagtctgagagttgttacaggtaagaactgccggcggtgcaatggtaggtaccatctgtggagcttttaccagttgaagttgtgccacttttgcacagaaaccggttgctactctcacatataccgtacctcctgcactcgaataagcggtaggattgggaattgtgtttgcgtttcctgcattagcatctgccaatgtggtatagtatgtaaacacagctcccggagtggtacttattgaagcctgtgctgatgttaaattaaaagttgcatttcccgcagcataacaggctgtcagtgtggcattctgtacggtaggagatgttccgccaactaccgtaatggtagcttctcccggacaggtgttaccctgaataaaaactttaacagtatacacacctggcgctgtcgctgtataacttgcgccggtagcccccggaatcggattggctcccagataccattgatatgttatattggggccctgcacagaagctgtaaaagtctgtggtgtattatcacacatattaacagatgaaggcaactgtactcccgccggatccagaatcttcactccgatatcaaatgatcctgcttcaagaaataccgcagaatcaaaattgggatcctgatagtcagcaaggacaattttaaaatgataagtttcccctggaattaccgttgcatgagcagtcaatggaatagtacgtccattaaagttggtctcgatctgagcattattggtccctccataataggcttcattcttaggtccgcaattttggtactgcggatgaatattggtaacacttacaggtcctgctcctcccgggagcactgcaagattggtataagtaggatcggacgctttttttaacagcaaagcaaaaccgtcggtgatggtacatggaaagtttagctgatattctttagaagcgaataaatatctgaaagtaatttcagtagaagcagctacaaaatcaaattctatagatgttgcattggtaaggttattattactgattcccaaagcgtttgccaggtctacatctcctccagttcccagatcatcacttaaagttccctggaaaacatttcccgctttaccggcatatcctgtggaaaggataatccctttactgaaaggaaagttggtatttgatttattaaaatatccccagcttcggttctgattacttgcagaaaggtttggagatactgttacattacttacacttgagctggtacaggtagttcctcctgatataagaacatcgttgatcagctgggttataggatagccggattccggatagcttggtgcatttacatctataaatacaccggctctcaaagaagcagccttaggttttgcagcaatttctacccttcctttattctgagccagaataaaatttcccatgaaagctaaaaataacgctaaaaataaatttcctctcctcctatttaacattttatattattttaaacaaaaatactattttttttgattgaaattcaagttaacacaatttacattattactaacgcaaatttatttatattagaatatcaactctgtttattttaaaataataaaaaaagactgacaaaattgtcagtctttcagttaatagtttaattattctatatttttaagcaatatccatcctgttttcacagtaagttccttacttgcaggatcttcaaaggttacctgataccagtacgttgaagtaggaagctttttgccctggaagtatccgtcccaatatggtctgattttctctgctttgaagacttctcttccatagcggtcgaaaacctgtccgctgaaatccttatagttgacaactccgctgaaatcaataatatcattaatattatccccgtttggagtgattacatttttcattacgaaggtaaaaaattcaaggaaacctacacagcttgtatatttaactctaaccctgatcgcaatgattttatttttaggcacattgttaaatatatttgaagactgccatgtaactccgttatctactgaatattccagaataccattacttggattacttgctgtaatgatcatggttccggtttcattataatctacttttatgacttcagggattacggctttaatcacttcagttttgaactcttttgaacaaactccgttactgatcgttaccgaatatactcccggagtacctactgtaatgctctgacttgtttcgccagaactccactgataggtatatcccggtcctgaacctgcatcaaggataattttatcaccctgacagatatgacctcctttcagatttgaaacaatagcaggaactacttcaattgtaatacgtgcaggctgaagagatttacacccttgcgctccgattgcatatacagtatacgttgtggtctgagttggacttacagttcttattcctcccgtagtcgcaacagcatcaccccattcataggtcactccgccggttgcagttaataatacagattcaccggcacagatctttaatcttggagccgtcagcacagcggttggtgtttcttctttccttaaggttaaagttgcaatcttactacagaaagctccattggaaaccaacacatataatatttgtccatccgtacctgtataattggtcagattcgtgatatagctgttattttgagcctgtgcatcagcctgattggcatagaaacggaataccgctccctgcgttgtactgatgagaggtttagcagtttccagattaaacgtagtcaatgaaggggtcgtacagagcttaagttcagcattttgtacggtaggacttgttcctccaatgattgtaatggttgcttcactaggacactgatttcccggaaccattacttttaccgtataaactcccgcctgggtagctacatatatagcactggttgctcccggaatggccactccgtctttataccactgataagtcattcccggaatcggggctacctgggctttaagctgttttggtgtattgtcacacatattgatgcttcccggtaaaaccactcctgtttcatctacgatcttaattccaacgtcaaaagatcctccttccaggaatacagctgagtcgtgagtagagtcctttgcatctgccagtaccattttgaaatggtaagtctgccctgggattacctctgcaacagccgttaaaggtgttgttcttccgaaataattaataagcaggtgcgggtttgccaatcctccaaaataagcagcattaataggtccgcaagtaaatccgtttcctgcaggaacgatattggttgcacttacaggaccagcagttccaggtaataccgcaagattggtataagtaggatctcctactttcttcagcaacagtgcaaaagcatcagaataaccgaggcaagggtaatttgaagtatactcatcagaagcgaatatgtagttaaattttacctgattggaattcggaacgaaatcaaattcaagggctaccgcatccgttaagctaacattggctccggtagctgctacaaggtctgcatcactccctgttcctactgattgtcctacagctgctacatagctgttacctgcttcagaagcataccctgtagtgagcacaatcccatctgtaaaggggaaattggttgtccctttatgaaaatatccccagaatctgttgttgttggtcacatcatgattaggagatacggtaacattcgtaacgttggctgttgtacagttggtaccaccattgatcaaaatattctttaccagctgctccggagtatagtttgaaggggtataaggaggtacattcacgtcaatgaatgctcctgccctgaggctggctgcagaaggctttatcttttctgattttctgacaggtctcgtttgagaaaacgcagaaacagaaatcaataaaagagaaaaaaggaaaaaatagttttttagtctataaattaacattttaatttcatttgttcaaatgtagcaaaaataattatatcaaattagcctttaactctagtatttcataaacagacagctaaatccacaacatttttttcttattgttacattttcttcaaatcataaaaaacaaaaaccatatcataaaaaaacagatcaatagtattgatctgtttatgttttaacggttattcttccgtctgtttatcatcttttttcagctgatcaatttcattctgcaactgggatataatatctttcaaagcttttatttcgttcttgtttgagcttacattacttttcagcattacatttttcgctctttcattgtgatcttcttcatcttcttcctcattgatctcctcaatatcttcctgaatgtcttcgatatcttcattaatctcttcaatgtcttcactgatttcttcgatatcctcgctgatctcttcaatatcttcctgaatatcttcaatatcttcgctgatctcttcaatatcctcctggatatcttcaattttctcatgactcttgttcacggacatctgaatgaagattgccagataaatagcttccagagaaagtactgtcgtaagaatgagaagcattttatcaaaattgacaatattcaacatcggaagcacaaacgaagttataaacagtaatgtatgtacaatcagggactggatagaccctatccatgatgtaatcttatctgctattttttcaagaacttctgttttttcgttatattttttcatcgttatatgttttacaacagttcctttgttactcctaatccaaacaatgcaaaatcatattttgccggatctttctcatcaaattttctgatggcaatatccagttcttctaccgttttccagtcgttctgggttctggaaaccaatcccagctttctggaaatatttccggtatgtacatccagaggaatggaaaggtttttctgatctatattttcccagattccaaaatctacaccacgtttatctttgcgtaccatccatctcaaaaacataataatccttttggcggaagaatttttataaggtgagctgatgtgtttatggcttctgtgcttttctgtttctaaaaatccgcttctgaacctttctatggcatgcaaaaagttattctctgtttcttttatttcaaataagctttccaggctttcattttctttataaatcctgttgaactgtctgatgaaataggaaaagtcctgtccgttgaaagttctgtgaatgcttttatccagaatactttccagatctttttctgaataattcatcacaaaatcatagggagaattccccataatatcaagcattttgtccgcagaattaatgatcgactttctgtttccccaggagatcgtagctgccagaaaacctgcaatttcaatatcctgctttaaagaaaaacgatgtggaatctgtatcgggtcattttcaataaaatcgggagcgttatactgatctgccttttcattgagaaaatctcttagttcttcaaatttcagcatattcatttaaatctttacactttccaatgcttttggcaggaatgtgttgggaaaaatttctcttgcttcatcggtaaatacggtaagatctccgtatctgttggaaaagtgtcctaaaatcaactttccaacctgagctttctgagcaattgtagctgcttccaaagctgtagtgtggcctgtataatccgccatttccttcaggtcgtgtaaaaaagtggattcatgatataaaactgttacatttttgataatcggaattacactttcaagatagcgggtatcactacagaatgcataggatactgatggagccggatcaacagtcagaatctcatttttaagaacgtaaccgtcactcagtacaaagtccttccctgctttgatattatgataatcgcaggtttcaatttcgctgtatttagcaatctctttcatattgagatgcctgtctttcggtttttctttaaaaaggtagccgttacagtaaatcctgtgatccaaagggatagtatatacttctatcctgttgtcttcatatattttttcagaataatctttatccagctcatggtaaaccacttcaaaaccgcgatgggtttctgtaatctgaaaaatggtttccagcatctttttaattcctttcggaccataaacgtgcaatgggttttctcttcccaaaagacggaaagaagcaataagccccggcagtccgaaacagtggtcgccatgaagatgggaaataaagatatgattgatttttgaaaatctcgctttcgcttttctcagctgcacctgcgtaccttctccacaatcgataagaaagagtctttcctccatttccagcagctgtgccgtgggtgatgtgttgatggttggaatcgctgaattaaagcctaatattgttaaataagtactcaaatcaataatttatggtaacaaatgtacaacagaaaaaccaaatggacgttttgccctgatatttaaacttaatcagtcacttttaaaaaatccataaataaatccaatgcctgtttacggtggctgattttatttttgtctgcaggatccatttctgcaaaggttctttcatatccttcaggaacaaaaatcggatcatatccgaatcctttaaatcctttgttttctgtgagtaaatttccatgaaccctgccctcaaaatattgagccccgttttcatcatagtagcaaagaactgtcacaaaataagctttcctgttttcaattccctgcatttcttccaatactttttcgatattttttgcaaagtcatgatctccggcataacgggcagagaaaatcccgggtcttccatccaaagactctacaaccagaccgctgtcatcccccagacttggaatgcctgttttttcaaagcaatatttggccttgatcagggcattggcatggaaagaatctccatcttccacaatttcttcgtgaatattataatcggtaagacttttcacaacgcagccacttcccaggatctgctggatttcttcttttttatgttcgttgtgggtagctactaataattccatttctatattcattttcaattttactttttaatcaggttacctacatttcggcataatgcactttatactttttcataaaaagataatagaataaagaaaaaagtacaattccaacagctaatacaagccattctgaaatatgaaggacctttgcaaaactctcatctttaccgtaaagcaccaataaagacagggttaaattattaaatgcatgcagcagtatcggcaacagcaaagattttgttttatgatacaccagtcccagcacacagcccagcattactgcactgatgaactgccatggatttccgtgaacaaccccaaaaataatggaggcgtacaaaatggctctccagggtttcactcccttattgatcaatcctttctgaataattccccggaatataatttcttcaaaaaccggagccataatcaccgtcatgataatcatcacaaccggattatcagttaattgactcatcagctgggtaaaatattcataaaaatccccgaaaaatggtcccgttgtaggaatctgggcagcaacaaactcagaaataaacatcatcccggtcatcattggaaagatcagaagataggtagaaaaattaaccgatgataaattgaagttaagcttcttttgcgtggtacgtcttacgataagaaaatcaaaaaaggcaattgcagtaaggaatcccacggaatttgccaccatcagaaaccagtctttcagttcaatattttccctgaaaacaactttccaaaaagtgctgaataaagaaacagccattgttcctacgaataatccaatcaccaaaacaacaccgccaatccatgtaaaagtaaacttcggatatttgctattttccatcctttctctgtaaaagtttatgagaaacaaagataatttttttgactgccacaggcaactaaaaaaggactttcttatgtatttgatgatgttataaagtccatttgtaaaccgtttccaaactcttctacccgcctacgctctatagtgatcaacattgtcttcatttaaatttgaaaacctcataaaaaatcacgatttttgcaacttcaaaatacgatatgtcagacttaatcaaagaaatacaaaaaagaaagaccttcgggatcatttcccacccggatgccggaaaaacaacccttacagaaaagttacttcttttcgggggtgctattcaggaagcgggtgcggtaaaatccaacaaaataaaaaaaggagccacctccgacttcatggaaattgaaagacagagaggaatctcagtagcaacttccgtattggcttttgaatacagagaccataaaatcaacattctcgatacgccgggtcacaaagactttgctgaggatacctacagaacattaactgccgtagattccgtaatcgttgttattgacgttgcaaaaggggttgaggaacagactgaaaaactggttcaggtttgcagaatgagaaacattccgatgcttgttttcattaataaacttgaccgtgagggtaaagatgccttcgatctgttagacgaagtagaacagaaattaggattaacagtttgtccgctttctctgccaattggtatgggaagtgatttccagggaatttataacatctgggaaaacaatattcagttattcctcgaagagaaaaaacagaaggttggtgattccattaagtttgatgatatcaatgatacttctattgacgaggttatcggtgaaaaagcggctagtactttaagagaagagcttgacctgatccagtctgtatatcctgaattcaatcgtgatgattatatgaggggtgatcttcagcctgtatttttcggttcggctttgaataactttggtgtacgtgaattattagatgctttcattgatatcgctccgatgccacagccgaaagaaagtgatacccgtctggtaaaaccggaagaaaacactttcacaggattcgttttcaaaatccatgcgaatatggatcctaagcacagagacagacttgctttcgtaaagattgtttccgggacttttaaaagaaatgaaaattatttactggtaagagaaggtaaaaaaatgaagttctcctctcctaacgcattctttgcagataaaaaagaagtggtggaagaaagtttccctggtgatattgttggtttgcatgatacgggaagtttcagaatcggagatacactgacaggtggagaaaaattaaacttcaaaggtattccaagcttctctcctgaacatttccgttatatcaacaataatgatccgttaaaagccaagcagctggcaaaaggtattgatcagttgatggatgaaggagttgcccagctgtttacccttgaaatgaatggcagaaagatcatcggaacagtaggagcacttcagtatgaagttattcaataccgtcttgaacatgaatatggcgcgaaatgtacttatgaaccattatccatgcataaagcatgctgggtagaagctgatgaaaaatctgaagagttcaaggaatttgcaagattaaagcagagattcctggcaagagacaaatacaatcaactggtattccttgctgactcatctttcaccattcacatgacgcaggagaagttcccgaatgtgaaactgcacttcatcagtgagtttaaagatattaaataaaggtaaaatcgcgaaaaggcgaaattgtttaaatatagatccgcagagaatttctgcggattttttataatatatcatatgaaaccaccccggcaaaaattcttcgaatttttgccacccctccggaggatgggaatttttagattttccaacttatatttggtaaaatgacaaagtgtacggataaaactcagcgttccatatcttattccgaaggaatctaatccatgacaataaagctctgtgattaaatgattccttcgagaacataaatactgttcttacaacattaaaacgcagaaaacattttgtaaatcttttgtaaaacaaatacaaaacactgaaaatacaacagttataactttaccagcataatacagtctatttacaactgttacaagaacttcacttctaattttacttcatcaaaaaaataatcttatgaaaaagttcatattacttgttgctgtatcaggcactttcattatgtgtaaaaaaggcgaagctgcccaggataagatcaatgaagcaatccacacagcagacagcgctgcgacagtggctacggaaactgttgacaatgtcagcaaaacagcagataaggttctcgattctgcgagtattaaaataaaagattttgaaaataccaaaaatgacatccagcaaaaaatagagaacacctccaaaatggtagattctttatctgagaaaatagctgcaacaaaactggaatcaaaagttgaaaaaacagattctgcagaaaaaaaatctgaaaaaattgctgtaaaagctcctgctccgaaggttattaaagaaaccaaaatcatttacaaagaaaagcccaaaaatgacagctatgaattgaatatggccaaagataaaatggtaaaagcagggtatcttgatataaaagcagagaatgcagaaacggtgaaggaaatcatcagggatgaagcctataaaaacaacgcttacatcaaaaatgaaaatctttcttatgtggaatccgcaagtcctggcggggaaaatcaaaaagtttacagccttgatattaaagttcctatgcagtactttgatggcttaataaatgctatcagcagcaatatcggggatattgaaacaaaagatattcaggtttcgggaagccagtatgcagatcataccatctgtacgatcaatgtaactatcagcaatcagcccaaagtggaaaaagaacctgagacctttggtggcaaatcgttagctgccattgaatcaggctggaatgttattacttccatattcctgtttatcctgcctttatggcctttgtttcttattgccggcactggatattatttctataaaaaaaagaataaaaacaccgctgacaatgactctcattagatttttaatttttttttaatgagatttggaactgatgttcgattcttatgtttaattttatcaaatattcaacggaagtattgtttattagaaaaattactgctaactttaagtatagtcaaagtaaatgaatcttcgatacagacgaagttctcaataaaaacggaaattttaatttcatatattaatattttgtgatttggtgtaaaagtaaggctctcaatctgagagccttatttgtttttatttcatgttcactactttatctacgataaattttgtgtttcctctccacggaagagcgccgttgtactctttgtaatgcagatcaaaggttttaccgctattggtttccagttgtttgaaaacttcaggatcatctacagaaaactcaaactcatagcttgtaatggttcctgttttccctcttccaaaaccttcctgaatcagttttccttcataggttttgaagatatagcctttcttcatggcataattcaggtagccggattttactccttccccaaaaacgaaataatacttataccatacaaatactcccagtaacagcagtacgacaccgagggtgatccacaaagattttttcatagtagtgtgtttataaaatgttattttgcgatgcttcttgagatcacgattttctggatttcagaagttccttcatagatctgagtgattttcgcatctctcattaatctttctacgtgatattcttttacgtatccgtatccaccgtgaatctgtactgcctcaatagtagtatccattgctacctgagaagcgtatagttttgccattgctccgctttcagaaatatcttttcctgcatctttttcacaagctgctttgaaacacaacattcttgcagcagtgatctgagtagccatatcagccagtttgaatgcgatcgcctggtggttgatgatttcagttttgaaagcttttcttgttttagcatattttaatgccagttcgtaagctcctgaagcaatacctaaagcctgggaagcaataccaattcttcctccgttcagtacagccatcgcaaagttgaatccgaatccgtcttcaccgattctgttctctttcggaacttttacgttattaaagatcaaagaatgcgtatcacttcctctgattcctaatttatcttcttttggtccaacctcaaaaccttcccatcctctttctacgatgaaagcattgatccctttatgctttttctcaggatctgtctgcgcaattacaatataatagctagctgtaccaccgtttgtgatccagtttttgataccatttaaaagatagtaatctcctttgtcttcagcagttgttttctgagaagttgcgtcagaacctgcttccggctcagataatgcaaatgctccgattacctgtccgctcgccagtggagtaagatattttactttttgctcttcagaagcaaatttttcaagaccggcacaaaccaatgaattgtttacagacattacaacagctgcagaagcgtccacttttgcaatttcctccatggcaagcacgtaagaaacgctgtccatacctgcacctccgtattttggatctaccatcattcctaaaagtcccatttctcccattttcttcacctgctctgcagggaatttctggtcacggtctctttcaatcactccaggtaaaagttcgttctgtgcaaagtctcttgctgcctgctgaatcatcagctgttcttccgataaattaaagtccataaaaaaaataattagatagccgtaaatttacactttttaagcaaatctgaaaaaataaattaaaagcaggaaaatggcacagaaaaagcaattttggagaggtttaaagatctgagatctatgtttcgggattcaaaagaataagatttcagatttaaacagaaataatacaggaattgtggagttatataaaagaccaattgaagagattaaccttttattcaggctttcaaagctgcttttgatatcaattgttatggcaagcatttaagtaatttctaattattggcttcagatgttttcaattaaaaaaaatgcttatatttaaatttctttataaattacgtaaaaaatcatgacgatcaagagattattcgatattccacactacgctttggagaaatatcctaaaacggatatgttcgtaacaaagtatcatggtgaatggaaaaaaacttctacgcaggagtttattaatgagggaaataagatatcaagagggttgttgaaactgggcataaaacctggtgacaagatcgctttgattactacaaattcccgcactgaatgggcaattatggatttcgggatttctcagatcggtgtcgtttcagtaccggtttatccaagtatttctccggaagattatgaattcatcttcaacaatgcagaaattcagtactgttttgtttctgataaggagctattgaataaggtcatgaaagtaaaacacaacattccgagtttacagggaatttttacttttgataacatcagcggcgcggccaactggagagagattctggatctgggtcaggatgaatctacacaaattgaagtggatgatctttccaatgcaatcaatactgaagatctggcgacgatcatttatacttccggaaccaccggaagaccgaaaggggtaatgcttactcacaataatattgtttccaacatactgggagctattccgaggattcccaaaaagagaagtttcgattacaaagaagcgagagcattaagtttccttccgatctgtcatatttttgaaagaatgctgttctatctttatcagtacaacggtttttccctttattttgcggaaagcattgagaaaatgggtgaaaacgtaaaagaagtaaagccgcattacatgactgtagtaccaagactggtagaaaaagtatatgataaaatttacaatacaggatcttctgccggaggcctgaaatcaaaaatattcttctgggcactgaatttaatcagtaaaaagaaaaccatttcaaagccatccggacttcaggaaatcattgctgataaactggtattttccaaatggagagaaggtttaggtggcgaaatcgtgactttggtttctgggtctgcagccttatctacaagactcaacctaattttccagaatgcaggaattcctattctggaaggttatggtttaacagaaacttctcctgtaatttctgtaaacagctttgataagatgaaggtaggaaccgtaggagttccattggataatctgaaagtaaaaatacaggaagacggtgaaattaccgttaaagggccatctgtattcaaaggatatttccagaatgaagaaatgaccagagaagccttcacagaggatgggtacttcaaaaccggagatatcggacatatagacagtgacggatttttacagatcaccgaccgtaagaaggaaatgttcaaaacttccggtggaaaatatattgctccccagactattgaaaatttagcaaaagcttctaaattcattgagcagattatggtagtgggtgatggtgaaaaaatgccatgtgctttggtacaacctgatttcgaatttgcaaaaagctgggcgatgagaaacaatctgaacattggctctacaccggaagagattgcgaaaagccctgaactgaagcaaagaattgaaaaggaaatagaaggcatcaacgaacaccttggaaactgggagaaaatcaaaaaaattgagcttactcctgaagtatggagcattgaaagcggattgcttactccaacattaaaactgaaaagaaaagcagtaaaagagaagtttattgctttgtacaataagatgtatgatcaccatgattaaatacgatcaaccgcctcattttgaggcggtttttttataggttttggctaaagccaatggagagatcttatttttgattaaacggactaaagcccgttcctattgattcccatcattccgttttttaatcaattaaaacactatccctgtcattcagtaggaatccatgttatgttgaaagaagagccgggattctacggaatgacaaagactttgattaaattgtactgctatgtttagatcagttcagataaaaaaagctgcttcatttctgaaacagcttttgtatgttataaaatcaataattagaatttaattacagatttcattttttcgttttcttccattaccaactcgtcatcaacaagaattttcccagagtgctcatcaataatgattttctttctctgagcaatttccatctgcttttgtggaggaattgtgaagaaagatccttttggagctcctctttccaatcctactacagcaagaccgttgatagagtttgttctgattctgttgtaagaagccagtaatctctcatcaattttagctgcgaattctttagactgctcgattaaatactcttcttctttctgagtttcagagatcagcccatccaattcttctttcttgaatttcaagtggcttttcagatcgtcgatcttagcattcagttcgcttaaagtttcgtttttgtgagcaattttagctccgaattctttaattcttttttcagcaagctgaatttccagatcctggaattctatttctttccctaatgcttcaaactctttattgtttcttacattatcctgctgagatttgtatttctcaattaaagttttagcatggttaatcacttcatgctttgttttgatctgatcttcctgatctttgatatctgcatgaaatttttcagctcttttttcaagaccttcaatctcgatttcaagatcttcaacttcaattggcaattctcctctagtatttcggatttcatccaatcttgaatcaatgatctgtaaatcgtataaagctcttaatttttcttcaactgaaatatcgttggtttttgccatatttaaatgaaataatttactgggtttgttttttcaatagattttgaaattgcaaatgtactaaatttttgtgataaaatttcaaataattgttgagtaacaaattgttcagattcataatgtcctatatcacagatcagcattttagactctgccagaaaataatcatggtatttaagatctccggtaaggtaagcatcacattttttggcggctgcagatcgtatcccactggctcctgaaccacccaggacccctactcttttgatttttttattgttgaaagccgaatgttttatgacttcaagtccaaacttttctttcacaaacccaagaaaatccttttcatccatttcttcttccaggtctccatacattcccagtccggcatgatgatttttattatccagactgtaaatctgatgagctacttcctcataagggtgtgcagctttcatcgctcctacaatctgtccctgtttaaagtcttcaaaaattacagaaaccatgtcttcatcagcattttcacgaattccctgctgtcctgaaaatggattggatccttctaccggtctgaatgttccgttgccattcactgtaaaactgcattcgtcataaaatccaatgcttcctgcacctgctgaaaacatagcttcttttactttttctgaatattctttgggaacaaagaccgtcagctgttttaaattattttcctttggctgaagaattttcatattctttagtcccagctggctgcatattccatgatttaccccaaagaaatcattatcaaatgcagtatgaacggcatagatcgctactttattttcaatagcctttaatacggctctttccacatagttttttcccgtcagggattttaatcctgaaaatataattggatgaaaacatacaatcagattacagtttctcgcaacagcctcatctactacattctccagcgcatcatggcataccagaatccctgatacatctcggtcataaacaccacacaacaatcctacattatcaaaatcttctgcctgcctgatacttatttcctcttcaatctttgcgattacagtttttaatttcattactttatattttacagttacagcgaagatattaattttactaaaaatccggaaaaatttctgcagcaataaaaaaaccggctttcacgaccggtttcattaatataaaaaagaataaaaaaggctgttaatctttgaaaagtgatactcttgtaaaggattctattactacaccgcagtttatatcagactccataaaaagctgatagccttttccgggatccagactcgcagggtctgcaatagtatagaaataaaaggtaagaatgttacctgctccattggaaccgcttggaaccaactggatagagttaatttcaaaaccggaatcaggatttttaaaggtggcctttacagatcctgaagaattagatccgggagtaattgttgcaattaccctccatacgtggacctgaccgttaatttcattttccctccatttccctgtagccgagacataaatattgcttgtaactccaggaaatggaacagttgtttccggccagcttgtagtagggcttggagcaaagaccagcggtgtggcataaagtacctgttgtcttgggccatagccacttcctgatgcacttaaactgaatgagggttttacatttgcgtttccagaatttattttaacgacaccgtcgttaccagcctgagaagatgtgggaacaaaaagctgtctccagagggtaccatcccagtactggaaattattcgttgtcgtattaaaaatgagggttcctgcagtaaggttagcattaacaacacctgcaggaggtactgtggaagcattattatcagccaggtaagtatcccggtcagtgtctgtaagacgaggaatgagaattcctttttggtttgagactatatccagtactgcggcaccgtttggcgtagtagtattaatcccaacctgagcatacgtaaaactgcttatcaaaaacagcataaacaaggttaaaatttttctcatgatataaagcttttgtagattaaaattacaaacttggtctataaaaatgttaaaaaaaaaatttttatatgtcatattttattcgtattttactaaatataacacattgaaaaacatgtaattaagtgtaaataattcactttttaatgatagaaaattcattaacatttgcagaattcttttaacaatcatatatttaccctatactttacagaaattactaacttcgctgtgaaataaccctatagaaatggaaagagaacataatcttgttcctgaggacaaactttggaaaagatacctttaccggataatttaccgctccgatacaaagcttggaaaactcttcgacatcatattattgtctttaattcttgtaagtactgctattattatgatggaaagcgtacctaaacttgataaaagatttcattatactttcctgatccttgaatgggtaatctctattttcttcaccctggagtattctatgcggattgctgtagtaaaaaataaacgcaattatatattcagtttttttggaatcatagactttcttgctcttgtgcctttttacctcagctttttctttccggtcaccaaatatttcctgatcttcagaatgctgagaatgctgaggatattcaggattttcaatttacttgatttcatgaatgacggctacttaattgtgagggcattaaagaacagttccaggaaaatctacatattccttctgttcttaatcattttctccgttattgtaggctcgcttatgtttatggtggaaggtggaagagaaggctttgaaaccataccgcaatccatctactgggcagtggttactgtaactactgtaggatatggtgatgtatctcctattacgcctttaggaaagttttttgcggttgttctgatgctggcaggttattctattattgcagttcctaccggtattgtaacagcggagatgagaaacaaaagacagaacctggaaatggtatgtgaacggtgtggtaatgatgacattgatgatgatgcaaggtattgcaagaaatgtggcaagaaattagcttaacatttgatataagtaaaatttattcaccaaataccacaaaatcatggaaccgaaaaagaaaaacagaccgaatagcctagtacttattctttttgcactggtagtgctgatgatcgtcatttattttatcttagtaatgttcttccctactgtttttgatcttatgaataagggagacatacagccggtgcccaacaaatgataagtaataagttatgaggtaataattgatcataaatgatcatcaagataaaataaaagatgagtgaaatgtttcactcatcttttattgatcaatttaacttaaatcatcatcaataaaaaatgacgggtcatatgatccgccattttctttttatttaaatgattaattactttttaatcgctttaatggtctgcttggtaccgtctttcatttccagagttactaagtaaacaccttgcattagatccctcaaatggattgcagattcagggttcgcaatagttttcaccagtcttcctgtagtatctgttaccaatatatttttaacattcttgctatcagaaatatttaaaacatctgtaaacggattaggataaacctggatcgtattcttcgctacagcaacttcagatgttgcaaggttggcgttgttaatactaatatcatcgatatacagataatactggtcagaatctgaatatgcattaaatccaaagaaatatacgcctgttacaggaactgtaaatgtcacagattctgtatgagcaactccatcattgattgaaggataatctgctacagaacctgtcatcgctgctgcatccggtgaagttccgtaggctactttcaatttttcaacataggttgatgagttattaccatacttatagctgatcgtatactgtactcctgctgttaaattcagtccttgtgtaaaaaaccaggtattggcagcgctggaagagttataatgatacttcaatacattagtcgtgaatccctggctgtcagaaggtggatctgacgtttcccaattatttcctgttcccacattaacattcacggtacaacctggaagcgccggaatagtaacattttcaaaatctacagtataaggaagaccggtacttgaacataatgtcgtaaatgaagccgactcactccatacacttttactggtagcactacatgcagatctaacccatacataataagcagtagaagctgttaagctcggaatattataggtagtcgcagtaattcctgtgaaattaggtgtagttgtggatgtaggtgctgtattggttgtactataataaatatcatatccgttcgcaggtaccggagttgctcctgtccaggaaactgtagctccagccgcacttagattggaaatgactagtgcgctaggttcactacaagccggtgctacatctatattgatatcatccacatataatttattcatattagcatcagaataagcctggaatccaaaataataaacacctgtagaggtcggtgtgaagtttacaaaggtactggtagctgcactggtgacaatattcgggtgatctgctaatgtattagtcattgctgcacctgtagccgaagttccgtaagctacttttaacttttcagcgtacactactccttctgcatttgcatatttatatttgattctgtaggtaactcctgcggtaaggtttattccatttgtgaagaaccaggtatcggcactattggcataatcatatgaatactgaagtacatttcccgtaaatccttgagcatcaaggtcacctgtttcccacatattccctgagccgtcattaaccactgaggtacaattcggcagatcaggaggtgttatactttcaaaattcagagtatatggcactcctacagcaacgcaggatgtcataaatgtagccatttgggaccatgcacttttatctgtagcagtacatacagaacgtacccatacataataagtagttgccggtgtaagtgaaggcaggttggtacttaatcctgtgcttgatcctgaagctaccgtagaagcagttggatatgtgctggaaactgaatagtaatattcatatccaacacctggtgcagaagatggtgccgtccatgctatctgagctgaattagctgtaactgaagatgccgttaaagcagtaggggccaaacaggttggagccgatccaattaccactgtataatcatgggcttcaccatagcctcctgtattacaagggataggttgactggaataacgatctcctaccctcattctgtaagtaccaggagtaacggtagaaggaattgttataagtccggaagtaatattttctcctcctacaagagtactgcttgcagacgcagcaagctcaggagctgcatcatcaaaagttccgtcattattaaaatctatccagatgcgtacattctgattactgtaattgtgcttaacgctaaaatcataacttaaacctgcattcaggttgattgtcatagaagtgtaatctccgtatgcattcgtggagcatcccgtattcgaatgatcaaatccggcagccggaattttaaaagaatctatcatgtcccctccatcacagccactggcaaactgtggtgtacagtaactctgtgctgaggataaaaagccggttattaagaaaccaacaagtaaaaaatttctcatataaaaacagtattagttgatcaaatctagtgaaaatcagcaacaaaaaaaataatttatttataatataataacaaatgcaaattttccttcaacaaaagacaattccacccataaaaaaagactgctcaaattgagcagtccttttttttcatatcatttaaaagtcacttatcttttaattgctttaatggtttgcttagatccgtctttcatattcaaaacaaccagatataatccttctttcagatctctcaactgaagttcagaagaaggtttttcaatggttttcactactcttccggcagcatcaaccacagaagcagattttaccttagaagcatctgaaatattcagaacatctacaaatggattagggtaagctttgatttcattatttttcttttcaacctcagctgttgccaaccctgaacatccttgtgtaacagaaatactgtagttaccgattctggaagctgcatatcctgtaagcaatacataataagtagtacctgcaactccggtaaatgttaatgtaggagcattataaagagttactgcacaaccagtatcagcatatcctacccctgagctgttactgaaacatgtaagtgatccgcaagtaccggtatacaccctcagataagcatcatattgtgtaccgcaagcatcaatagtaataggaccgttttcagtagctgtaactgtataccaaacacctttataagaagcagtacttccagtacttccacatgttgaagcaggaagtgtttcatcgccagccaaagcattaactccctgaacagttccgttacaagctattgcaacagctgtatcacaagtatcattagccacagctgaaggagtagttacagcaatctgaaaattagacgttgtagtagctgtacttgaagttgagaatactcttacataataagtctgtcctacagtaagattttgtaacagtacattggaatttccatagtcgccggcaaaacaagtaacagcagttaaagaaccacaagttccggaataaacctgtgtagttgttgcattatcagaatacagcacatgtacaaggtgcgttgctgcagttgctgtaaaagaataccaaacatcatcattgatacccgatgtgctgcacgtaggagcagttacacctgaacttgaagtagcacttacagtagaaccgttcaatgcgtttacaaaagcatctgtactgctcactgtaagagatgttgcattggtacaatcatcatttacaggtggaggtggaggcgttccgatacagatattaaaactattggcatacaaagtagaaccatttgtattggaattgtatattcttacataataagtctgtcctggagtaagaccggaaagcggtgtatttactgttgttccgcatttaatgcttgttaacgcaccacatgtcccactgaacacctgtgtatacacactcgtagatgtagatgttccaacagcggtaacatttgaaagcattaccatatggtcagtacctgtagctgtaaatgagtaccacacatcatcgtccgctgttcctgtacatgggcttaccgccaatcctgaattagttgcactcagagttgttccggataccggtgaagcgcatgttagtgttgggctaacggatagtgcaacagcacctgaacactcatcattagcaggagctgcaggaagtgttcccatacagatattaaaggagtttgcatagaaacttgcgcctgaattagcatcataagtatatactctcacataataagtctgacccggagtaaggccagttaagttcgtaaagtttgtatttgaactgatacatgcagtacttaccagagttccgcaggcaccactaaatacctgagcatacaatgatgttgtagaaacattccctacagaaactatatttttcagctggaaagtatgacctgttgacgttgcggtaaatttataccaaacatcatcgtcagctgttcccgaacaagtacccagagaaactcctgaacttgttccccccaatgtagttcctgctgttacactaccacaacccatatcaggattaattgtgatcgcaactgcattagtacaatcatcattagccggcggtggcggtggtgtacttacacagatattgaaacttgcgttagccgttacagtagatgagtaagtatatactctgatatagtaagtctgacctggagtaaggccggtaacaatatttgtatcaggatccgaacacagtatacttgtcatagtagcacagtttcctgacaatacctggaaatacatatctgaaacacctgttgtacttccggtagaagctacattagacaatgctatcacatggcttgtagcagttgctgtgaatttaaaccaaacatcatcgtttggtgtaccggaacaagtaccagcagccatagattcggtggctcccaaagtattacccggagttgttgctgaacaagtcaaagaaggattcactgttaaatttacagctccggaacagtcatcatttgcaggagctgaaacagtagtagtaaacgttctttcagtacaacctgcagacacaacgccaccattataagctgtaacagtataataatattgcgttgtcgggctcaactgctgtgcagcggtaagcgtatatgtagtcacatttcctacatcaaaattatttaaaatattggatgaacccgcagaagttccgatacttagtctatatcctaaagcaccactcacagcagaccatgaaaaaggagttcgcaaaggcagaccggtttgcgccgcagtgggagcatttacagaagggcattctaatgttgacgttgtagtaaaagacctctcagtacatgcagcagaaattcctgtagaattagaagcatatactgtataataatattgagtgttaaaactcaaagaattcgttaaagtataggaggtaacatttcctacatcctgcatgttcatcacattggttgctccaggtgttgttccgatgctgatcttataagatgaagcagaacttgcagaagcccaagtgatggttggcaatacagaaacatttgttgctgcagctgcaggagcagaaacaaccggacaaacaggagcaacgggagcaagccccagcagatttgtcacagattttgttgttgttcttgttccgctaggaggtgaagaaggatccgggtttgttgaatcacttctgtaatacagggtagaattggaagcgcctgagaaagtatagaatctattggcagatgcagtatagtccggtgtattctcatcaacagcaatcaataaattatctgtattgttataagcaaaaggagttgtaaagtttacagtcacctcacctgcggaagcacttactgttccggaaaaaacctgagtcaaacctgaaacagaaacccagtctgtagttcccgaaaaagaggttttagtagtatgaccaatatatacaacccaatctacagattttgaaatatccgcattattgggaaggtaaaatttcaacccggtaatgttcccggctgcattggcattgatttcacttttcgtaaaaatctgctgtgtatagctgtaaccgtagttgacatcaattggcgcaactccgctctgactggttccactacccagcattatctgggcatttgtaatggaagctattaaaaataaacttaatagtagtaatttcttcataaaatagtaataataaaagttagggcggtaaatgtataaatattaatttaatttttaaaaaaaataccaaaaaatatcataaaattttaaataaaaacaaataaaaagagtataaaaataaaataaaatcaaacgtttatttaattttaatatttatttcgcaatatgttgaaaaacacaaaacaattgataatcaattatttaattactacacagcaaatatagacttcagaaaatttttctaattaacacaaaaacacattaattttttttcataaatactctcaatatgtaaacaaaaaaagagtgacctaagccactcttatacatcaatatgttattttttttatattctaattcaaataaaactcatatttattcaataactgaatttctttgatcaggtctccgttcagatcaaccgagtgcttcatagactgcacttcaatatgggaatcatcttcaaggtttttaataaaaaatttcagcttttgatttcctttattccgatccagaactgttctgaaaaaatcaagatcttcaggccttacatccattacatccattacaagcgatatactttttgcaaatctttcgaatgcttcctgaagctctataacatcaactacattaacgaagactcttccgtctttcacctgggcaaattttattttaaatataacaaatctctgaacctccagcttttctttcagcctcatataatctctgtcccccaatctgaatgaatatgacccggaatagtcttccagcgtaacaaaagcgactttctcaccacttctgaaaccatcctgaactctgtattccgtaattagaccggctacagtatactcttttcctccgccaccgttttctctttctttctgaagggttttccagtctttctttttctcttcaaacaattcctcctgcttgttggcaaaggcctgttccttataagcatccacttcatcgagattcaggaacaggaaatttccttttggttctgcttttttggtcacttcttctataacttcctcttcacctgccactacatcatctgaaacaatttccgtaagatccacagcatcgtccagggcatcctgctccaaaacaggtgcttcatctgtaactaccttgtcttcttcatttttctcaagaaccgctttcttggaaagctgcccctgcataaactgaaactgatatttaaattcatccagcggatgtgcagaaaggtagaaaccaataatctctttttctttattgagcttatgcatatttggccattcgggacatggtgcaagtttaggctgttcaatctgaacttcttccgcaaaatctgcaaataacgagtgttccatctcatttttactttcctggaagctttgtccgtatctgatcagtctttccaggtttgttttcccggccatatcaatatcaaaatactgacctctgtggaatgaatccagctcgtcaaatgcaccggcaagcaccaaactctccgctaccctcttgttcatctgggaaggtaaaattctttcaaaaaaatcgtaaatatttttgaatcttccgttttccctttctctggtgatcgcctcgctcggcccttcacctattcccttaatcgctcctagcccgaaacggatctgccctttttcgtttactgagaatttatattgagattcattaacatcgggacctaatacatctactcccatacttttacaatcctccataaacatagtaattgaatccgtattgttaatgttgttactcatcacactcgccatatattctgccgggtaattggcttttaaataagcggtctgataagcgataaaagcataacatgttgagtgagacttattgaaggcatattccgcaaaggctttccagtcattccagattttttccagtctctcctcattcagattgtttttgcgacctccttcaataaatttcggatacatcttattcagaacgtcaatctgctttttacccattgcttttcttagcgtatcggcctcacctttggtaaaattggccagcttctgggacaaaagcattacctgctcctgataaacggtaattccgtatgtttcttttaaatattcctccgtttccggtaagtcataaacgatttcttcaattccatgctttctgttgataaagtttggaatatacttaatagggcctgggcgatacaaggcattcatagcgataagatcggcaaaaaccgttggtttaagctctcgcatgtatttttgcatcccgggactttcatactggaaaatccctactgttcttccttctttaaataactgataggttttggcatcatcaagcggaataagatcgggatcaatatcaactccatgccttgctttcaccagttttaaagcgtctttaatgatcgtcagtgttctaagccccaggaagtccatcttcagaagacctgcactttctgctaccgagttatcaaactgagacacgaggatatcagcatcttttgcagcaatcgtcacaggaaccaggttgctcacatcttccggtgtgatgatcaccccacaggcatgaattccggtatttctgatacagccttccatctttttagcactggccagaactccgtgccgcgaatcatccggactctccagaacatatctcatttcatcaacgagcatctgctcttccggctttaatttatcatattttgctaaagcttttgcaatgttcattccgggtgtggaaggaatcagcttggcaatattattcgtatccggaatcggaacatccagtactcttccggcatctttaatggcagacttccctccaagtacagaataggtaatgatctgtgctacctggctctgtccgtatttttcaattacccatttgataaccctgtctcttccttcgtcatcaaagtcaatatcaatatcgggcatggataccctttccgggttcaggaacctctcaaaaaggaggtcgtatttaatagggtcaacattggtaattccgatacagtaagctactgcagaccctgcagcagaaccccttcccggaccaacccaaactcccattttacgggcttcattacagaaatcctgtacaataaggaagtatcccggataaccggtattagcgattacttcaagctcaaagtcaagacgctctttgatttcatctgagatttcatccataagccctgagtcaacatacctttttttcgccccttcataagtaagatgtgtcaaataagccatctctcctcttttccctccgtctacctcatcttctgcatggataaattcttcgggaatatcaaacttcggcagcagtacgtctctctttaaggtataaggtttaaatttcgccgtaaattcttcataagcatcaaatgcatcaggataagctaaaaaagcttcttttatttcatgtgaactcttgatataatattcacctgtagccagtccccttcttttaccaaacccttttcctataggtgttgtgagtttttcaccatctttgatacagcttacaatatcctggatattggcatcatctttattggtgtaaaaagtctcgttctgagctaaaattttgacattatatttatccgccagatataacagcacttcattcaaatgctcttcttcaggaagtttatgattttgaatctgtacataaaaatcatcttcaaaagtatctttccaccatttgaaaagctcctctcctttctgttcaccggtattcaagatcgcatcaggaatatcccccataattccggaagttaaagcaataactccttctttatattgggcaatcagttcacggcttacccttggaactccaaaatagaatcctttaagaaaaccaatactggaaagctttgccagatttttatacccgttaaaatcttttgccagaagcaccacctgcgttctcctgtcaggatcgtcttttgtaaactgcttttgctcgtaacggtctgaaatataaaattcacaacccacaacaggaataagcggttctgaaacaggttcttcttcattaaattcagttccgttttcttctgcttcctgttttttggcaagatattctttatgttttttcgctctgtctgcattagccccttccactgctgaaacaaacttaaaagctcccatcatatttccaagatccaccattccgacagccggaaagttttcatcagaagcttttttaatcagatcattgatgcttgaagtagctgtaagtgtggagaaaacactatggttatcaaaattgaaatatttacctaaatcaatttcatcaatgcttccaaaatcctgctgctttttcttattatgaaaatcagcaacctgccttctgataacaatattgaagggcttgatcggatccgggtaaagactcttgaaataggccagctggtcttccgaaatctttaatgtttctgcaggaactactccaattcttaccatttcgaagaaagctctggccgttgcatttacgtcggcagcagcattatgggcctcatcaaacttacttccgtaaagtttttcataaagctcttcaagtttcgggggtttaaatcttcctccacgtcctccgccaagctgacagaagtcggtacccaaaatcatggtatctgctttgggcttttcctggagattgtcttttagattttttctgtaaaattctgctcctacaatattatagtcgaattctacattatgtccggaaactactcttactttttccaaaactttggagaattcttctagaatctcctgaagatctcgtccttcctcattggcaattttcgtagtaatcccgtgaattctggctgcattgaagggaatatcatacccttcaggttttattatataatcctggttttcaatcaagtttccgttatcatcgtgcaactgccaggcaatttgtaccattcttggccagttatcagagtctgaaagcggagcgttgaaattttttggtaaaccggttgtttctgtgtcaaaaattaaatacatataatgctctaacttttttataaaagagaatgtaaagttacttcattttttcgaattattggttggtactaaaacacaacaagtcaacaacattaaaacaacaaaacaactccgctttattaaaaaataattaattacaataatcataaaataaatatcaaaaaataagattaaaaaattagaattatccaccaaaaagcactatataataaatatttatcatatatttgatgaaataaaattttaatatttctatatctaaaaatgaagaaacatctacttctcatcagcactttggcaataagtttagtaagtgcacaaaacaacgacgcgttaaaaagagagtttgacagacaaaacaaagagaacaatgaaaaatttgactcttatgtttcgaaaaggttcggtagcgacagaagccctgaaacacaaaaaataattcaggatatgagagaaaatttggcaggatttagtggaaatgttccaaacttttaccaatcagaagatcaaaatcaaattttaaataacaatgtagatgcattaactactgccggaggtgtaaacgggctaaccggggcttttaaaggagaaggaattctgtatactatttttgatggaggaaggatttttgaaactcatacagcttttaataatacaccaggcagaattaccaataaagaggcggcaaccaatgcttatagtgcccattctacaggggtagcaagtattatcggggctaaaccatctcctctaacagctactagcaatggagtatcaatctcaggagatgcaatgggaattgccctgaattctacaatggattcttacagatttgcaactacaacattgccgggcaacacaaccacaagcactgtattcagtaaaattttactggctcagcctaaaatttcaaatcattcttatggtgtaaatgcggcctgggattacaaaactactgctaatgggtatccggccaatgcctggtattggggaggaaattatattgccggaactaattacgatttaatggggacctattatacaagtgatcagtcttatgatgccatcgtgtataataatcctacgtataccattgtaaaatcagccggaaactacttcgggttcggaccaggatattcaggcagtaccactacagcatattattataatggttccggatattcaacttatgccgcaggtacagccccacctgctaactgttcacaaggctacgactgcataggttacggatcattagctaaaaacattattgtagtgggagcaaccgatcctattacaactaacaataaaagatatactgccgctactgatgtagtaaaatccgattatagcagtgcaggacctagagatgatggaggtatcaagcccgatatttctgctccgggtaccgatgtctggatggcttctacagcagaaaacactacaggaagtataatgtggcagattaatagcggaacctcaatggcagcccctcaggtggccgggattatcggactttggatgcagatatataaatccttattcaacaatgcggaactcattgcttctgcttcaaaaacgctgatggtacattcagctcttgaagcaggaactgtagggccggatccatggtatggctggggatatatcaatgccaaaaaaggagctgaacttctggtaggaaaatccaacaacacgataatttttaataatgaaacattaaataacggcgctgttaatactaaaaccgtaaaagcatccgggtctgaaccattaaaagtaaccatatcctggattgatccggagtatacaaatattacgaaccaatgggataatttatataataacagagtttcaaggttaatcaatgatttggatgttaaaattattaatacagcaaacaatacagtatatcttccatggaaactggatgcaaacaatcctatggcgccggcaacaaaaggtgacaatacagtagacaacgtagaacaggttgtgatcgataatccaacaccaggagctgtttacaaaattgagatttctcacaaaggtaccttaaaaaataatgcttccccaagtgttactgcccctcaaaactactccatcattgtaacagggtttaccgaagtacttggaactaaagaagccggctttactacagatgggattgcagtagccccaactgttgcaaaagatttcactaatatattaaaagcacctaaaaagtctgctttcaacgtctatgatcttacaggtaaaaaattacaaagtggtactatcaataacgatacagaaccaatagatttatctgcctacacaaaaggaatttacatcattgaaataaaaacaggcaaagatgttatttctaaaaaagtgatcaaggaataacctatatacacaaagatttttcacaaaatactaacagttgttagtattttgtttttttatgtatatttgcttcctatggaaaatgcacttcacgaaaaagtttctcaggatatattactcaaagcgtataatcatatgatgcttgccaaggcaatggctgatatttacgaagaaaacagaaacgtatgcaaatacgttcacagtacttcgagaggtcacgaagctattcagcttgcaacagcttatcagttaaaaaaagaggattgggtttctccttattacagagatgaaagtattcttctgggcattggctttgagccttaccaattaatgcttcaactactggctaaggctgatgaccctttttcgggaggaagatcctactattcacatccctcaagcagagatgagaacaaaccaaagatcattcatcagagttctgcaaccggaatgcagactatacctacaacgggagtagcacagggaataaaatatattcaggacttcaaccttcagaattttgaaaataatcctgttgttgtctgcagtcttggagataattctgttaccgaaggtgaagtaagtgaggcattacagtttgctgctttgcaccagcttcctatcatctttcttgttcaggataatgaatggggaatttctgtaacaaaggaagaagccagaacatgtgatgcttatgattttgtagcaggatttacaggactaagcagaatgagagtggacggtactgatttcgtggaaagtttcgaggctatgaaaaaagctgtagactttgtaagaacagaaagaaaacctttggtggtttgtgcaaaaacagtactgattggacaccacacttccggagtaagaagagaattttatagggatgaagaagatttaaccaaacacagagccaaagatccgggagaaatccttagaaaatatttactggaatcaggtgctgatgaagatcttttaaagcaaatcactaaaaaggcacgtcttgaagcagaagaagctttcgaaaaagccaaaaatgcagaagatccgaagcctgaaaccgttatgcagcatgtttttgcccctactcctatcacggaagaaacagggacacgtgagcctgcgaacggtgaaaaaattgtaatggttgacgccgctatccacgccattcaggaattaatgtggaaacatcctgaagcccttctttacggtcaggacgtaggagaaagaataggtggagttttccgtgaaacggttacattaggaaaaaaattcggaagcaaaagagtattcaacacagcaattcaggaagcctatattatcggatccacaactggtatgagtgctgttggattaaaaccaatcgttgaagttcagtttgctgactatatttatccgggcataaaccagttaattacagaaatttcaaaatcaaattatttaagcggcgggaaatttccggtaagcaatattatccgtgttcctatcggagcatatggcggtggtggaccttatcacagtggaagtgttgaaagtattcttgccaatatcaaaggaatcaaaatagcatacccaagcaatgcagcggactttaaaggtttgttaaaagcggcctattacgatccgaatcctgtagtgatgcttgagcacaaaggattatactggagtaaagttccgggaaccgaagatgcaaaaactatagaacctgccgaagactatatacttccgttcggaaaaggtaaagtaatcattgaggctgataaaactgaaactgaaaagggcagaaccgtattggtagttacttatggtatgggagtgtactgggctaaagaagccgttaagaatttcaacggaagagttgaagtaattgatttaagaactttaattcctcttgatgaagaacttgttttcgaaagagtgaaagcacacggaaaatgcatcgttctgactgaagaacaacttaataactcatttgcagaagcatttgcacaccgtatttctaaaaactgcttcaaatatcttgatgctcctgtagaaacaatgggatcattggatgttcctgcagtacccatcaatcttgtactggaaaaagaaatgcttccgaatgcagagaagctttccaagaagatcgaagaaatgctgaaatattaaaaataaaaaactctaaaaatattttagagtttttttattttatttcttaattattttctttattatcattcccttttctgttttaacttttaagagataaaccccatttattaaactgtttaaatctaacgaaatttgaggtgtattagcttgctttttattcaaaactaaaattccgcttacatcatatatttcaatgtctttaatttcattatctttcgtggacattagattaacttcagaaacaacaggattaggataaataataagcgatagagccttttgatcttttatattactaattgtttcattaattcctaatgtaattggattaacatccattacatataattcattaccataaaaattaaaattattcgaatcattaaatggagcattcaaaaatattttattatttacttttgaaatagaattaattattttgctgtttactgttatattattagattgaatagatattgggcttactggtccgctaccattagtaacccatatttcattttctgaatacgttttattaagaaaaaacaaattaccattgatacaaacattattataaggtatataattatttggtaaaaatgtagaattacctagagatggactagtgtatacattactaaactgcccattattatatacccacatactattgtatccattgtaatttggagcactcatataataaattttattatcacaatgtgttataaaacttccactatgtgaagctacaggataagctccattagcaaattcgttacttgaaattttataagtaccattaattgttccatcagaaacatatggggcatgttttgttaaatccgtagtattttcagcacaagcaaaaaaatacaatttcccttctttaacatctacattactattgaaacctggattggaataatgaggattactgaaggatttcaacatcaacgttccatttgcagatccatcagaaacccaaagctccgttttgcttgtccaataatctatttgattattcactagaaagaaaaacttattatcagtatatcctaaaattgaagaaaaacttttgtttccaacaaaattataaaatacctgagtaccattctgagtaccatctgtagacatcaacactcttttgtttaaggtataatcaaaagcagcataatatgatttattatttataatagcatatttattttggaaacttggaagggcatttaaattataagtcccgttttcagtaccatcagaaacccaaagtttagcagagaaattattttcacttactttaaataaaaacttgtttgtattccctactctggcaaaggatggataatcataagaatttgaaccatcttttcccattgggttaacattcttaatcattgttgtacccacacttgtcccatcactgccacataatgctataggcgcccctcctattgaacatggaaaatagattttattattcagctgtatactgggaacatagtcgctaaccggccaaccatagaaacctgcattaacatcattttttattctatatgttccagtagctgtcccatctgaaatcattgggcctaaaccatattcatctgttccaaaataaaaaagtttattattgaactcctgtggagataataaagaagatccagtagtagaatttgcattttcatataaatctgaaagtccattgctaaaattaaacttaaaaatttcctgcccatactttttattacctgcattaataataaaattattgtctggtgtatctgtaatctccattttaaaaccagaatcataatcgaataataaattctgaataggctttaatgaagttccattaaatgctatgaaattattattgttattattggaatatgtgttaaaaatcaaataattactttcgccgaaattcgaatttgatttttctacaatagatgcagtctcaagttcaggaaatacatccgtaagcttaatcaatgtactaccatcataaaataattttgtatataagttatttcctaataaacagttaaagtaaatattatttttaaaaaagtaaatattattgacattttgaagatttggatataaattagaagtaaccatatgggttcctatgcttgtcccatctgatttccacaaagaattattgttaaaaaagaccaaagaattattctgtaaaaataaatcttcatttccgctaatcattccaggaagatttaaaacatctacaatggagttgttgttaggatcataataagataaggacaggacattattcttcctttttataaaataaacgaaaccattaaaaccaaccatttttccttcaacagtaaaatcgtcttgtataccgctaaaaacaatagaagtatttgatattgttccatctgacttccataatttcctttgagaagaagaattataattggtaaagtacagaatattgtttacgtttacgtaattattagttccactgttaaaattattacttatcgtattggcaatttcagttcctaaagaagtttcatcagaaacccataactcattccttgttggtgatccgaactgatgaaagatatcaaaaataagcttaccattaatctttgtaaatgctgtaatactaaaatctgacgttgaaaaatttacattaggaaattctttaatcatttttgtaccagcatccgttccatctgttttccagagacttaattttgagttcttttttataaaaaaataggcattatgatcaattacagaaatatgtaaagctttcgtcgcatcatacgtatatgtataatcttcattgacatagtttttatatgctgaacttattttgattaacaatctgctattttcattacccgagccttttattgtaatcccaaatttagtattgaaaatcaatttatcagaagtaataaaattcatttgagagggcttactatcagcactaaaattagtttccaatagattagctgttgcttgtaaattctgtcctagaagatcaccattttttagtaggcttaataacagaacaaaagaagcaattttagatattttcatagttaaaaatttttgcaaagataattatttcaaccttttttatattgttatataagtgtaatacctccaaataccgagacgctttctcataagatcgaagaaatgctgaaacattaaatatatgaaacctctgatttttcagaggtttttttattaattttaataaacagaacggatacctcattttggtattcattttgtttatatgcacacctaatttcatacgttttatgatcacaaccaaatacgtcaattataagcaggtcctcaatttatcaggttttcacctcatcctgatttctatctggtgtactctgatcgctgtactgttctatttcttcaactggcaatggatgacaattccatgggttccagttgccctgattggtaccgcagaagcattccttgtaggtttcaaaaacaaccaggcgtacgacagactttgggaagccagaaaaatctggggaggaattgtaaattcaagccgctcatttgcttctatggtttacgcttttgatactaaaaatgaagaaatcggtgtatttgatcttgaagatcgtaaaagaaaaattgtttaccgtcatattgcctggttgtatacttttcgtgagcagcttctggttccaacggaatgggagcatatcagcacagaaaataaattcggcaatattaatctgagaagaaacagattgatcaaagcaggatttccggattacggaagagctcccattttcttacataaatacctttcagaagaagaatatgatcttaaaaatgattataaaaacttcgctacctacctgattgcccaacaggcaaaagatatcaacgagctgaaaaatatgagtgctatcacagattttaaccagactcagctgcagaacagtctgaatgaattctataatttccaggggcaggcagaaagaatcaagaaatttccttcaccaagacaatttgccagtacagcctttgtttttaatatcctgtttattatgcttcttccgctgggattggtaaacgaattcgcaaagcttggcgactggggaatctggacctcaattcctttctgtatcatcatcggatggatctacatcataatggaattagtaggagattattctgaaaatccttttgcaggattaatgtttgacgttcctatgctttctatctgcagaaccattgaaattgatcttcttcaactaggcggagaaacagaacttccagaccctatttcttccaaaaacggagttttggtataatttctttttccgaaaatcattgtaaaaaacttcagaatatatttcagatttcattgttatttcataacttagagagttgaaaacatcagctgaaatctgtccaaaattgagctactgttctatttcggacagattttaacttataattttctccactaataattgatcctttctttttaacaatgagatccaagcaagtactgcaggttatgacaatgctgtgtcttatcctattctgtcctgaaataaagtcacaggctgccttcaataaagaattacccaaagagtttaatgaaaaattcaccaaagaaatcaacgacagtattccttctctggggtcattcattgtttctcagaatgacaggataatttatgagcaatactctcacggagccggtaaagagactgttttcagtataaaatctgtcaccaaaagtattgtttctgttcttgcgggaattgctaaggataaaaacttacttcccaatctcaatacgccggttttaaagattcttccggaatacaatgtatcaaggagcagttttaaaaacatttccaatatcgaagggaaagtgattcacgattcaataagaaatacattaacattaaaaaatctgctgaccatgcagggaggttttgactgggttgaaaattccaaaatctcgacagcaatgtcattttccggtgatcctgtaaagtttgtgctggatcttccttttgaggaatatccgggaactgtattcaattacaacagcggtgaatctcacctttttggagctgcactcgcaaaaattgtaaagaccaacctcaagcaattcgcaacagaaaatcttttcagagcattaaaaatgaatattccccgatgggatacagattccatgaacagaaaccttgcaggctccgaactttttatgaagcctgaagatatgttgaaatttggtttaatggtcctgaacaacggaaaattgggaggcaggcagattgtatcccagaagtggatccaggaatctacagccgaacaggtaaaactgaattcctgggacgtaatgccggatgccaacggatatggctattactggtggcgaagaaaaaccaacggacatcaggcttttgtagcaacgggttatggcggacagcttatctgtgttatcccggatttaaaaatggttatcgtaacaacgtgttttttaaatgacgaaaacagaggcagaaccgagattaaaaggctccattattttatcgataaaatgaccaaagaagttttataacaacaaatcttacattcagttgagatacggtaatctataatacgattgctgttgtattttttacttcagaaatcataaatgaactgtgtgtacttgcaatgtgctgaagtgttgtaagtttcgtcagcataaaactgcggtaatcttcaatgtccttcactcctattttaaggatgtaatcataatctccgcttacatgaaaacattctgtaacttcctcaagatccattacttctttttcaaactgaagtacaaattcttttttgtgctggcttaattttacgtggcacagcacaataaaatttttcttaactttactcttgtccagcaaggctacatattttgaaataacgcccgcattttcaagctttttgacacgctcataaattgctgtaacagacaatccaagcttaccggacagttctttggtggtttgtttgcagtcttcctgtaaaaaatacaggagtttcttgtcagtttcgtcaagttccatagatatttttttggtaaaaatttaacaatcccgaagatactaaataatttttctaaacaaataatattttacagttttattttctataaattcaaatctatgttgtaataattaacaaattaatgcaaattgagaccataaaataaaaacgatatttatggaaaactttaacgccgccaatgagatccaggatcttcagtattttggtgaattcggaggagtgaatccttctatctctgacagctctacttacacattcctttctgcaaagaccatgtttgatacctttgaaggaaacgctgaaggatgttatctgtattccagacattcatccccgatgaacctttacctggctcaggctcttgccaagatggaaaatacggaatcggccaacgttacagcatcaggaatgggagccatcacttctgttttgatgcagctttgcaaaagcggagaccatattatttcaagcagaaccatctacggaggaacctatgcttttcttaaaaatttctttccgcagtttaatgtagcgactacttttgttgatatcagcaactttgaatctatagaaaatgccatcacacccaatactaaagttatttactgtgaaagtgtgagcaatccgcttcttgaagtggcagaccttagaaaactttctgaaatctgtaaaaaacacaatctgaaactgattgtagacaacaccttctcccctctttcgatttctcctacgctattcggggcagatgttgtgatccacagcctgacaaaattcattaacggaagcagtgatacagtaggaggtgtatattgtgcaacacaagctttcattgatgatactaaaaatgtgaattcaggagcatgtatgcttcttgggcctacaatggatagtttgagatcttcaagcattctgaaaaacctgagaacattacatatccggatcaaacaacatagccataatgccatgtatcttgcggaaagattcgaaaaagacggattaaaggtttcttacccgggattgccatcccataaaaaccatgaattgatgaaaagcatgattcatgaagaatacggatacggaggattactgacgttggatgccggaactacagaaaaagcaaacgaactgatggaactgatgcagacagaaaacctgggttatcttgcagtaagcttagggttctacaagaccttattctcatgctcaggaaaatctacctcctctgaaatccctgaagaagaaagagcttccataggcatttctgacgggctgatcagattctccatcggtcttgaccacgatatcaaaagaacttaccagaaaatgaaggaatgtatgttgaaagtaggagttcttaaccaccatgaaaacatttccatatcctaaatttattgtaaaaggctgtttcgtttttgaaacagccttttttatttatcaatccacctttagatttggaataacaaatgttaaatataatctattatagcttttggctaaagccgttgtaagaatttatttattataaatgggctgaagcccattcctattgaattttattggcaactattaccgatgttatttcttataataatgatgcggaaaggcatcctcaggtttcattctgaaaacattgagcagtatccaggactttaagaaaccgtatccgtaagaaaacatctgaatataagtggaaataaccgccattccggcaatactgatatttttagtcagtaataaggcatgaaacaacacaaggaaagtatacaaaccataaaaagcaaggatgatccctctatgcatgatgaaatactccagaaatcccattacatatcccaacataaataatgtaggaaatgcaaaagatattttcacataattcgggtgtctttgattaagaataggccttgcacagccaaactgatagacctgtttggagaattttccaaaatcgactctgcgtttatgataaacagcaatatcatcaaaaaaagcagtggtaaatccattttcccaaagcgtcatcgaaaggtccggatcctcaccaattctcatttcagaaaatccgtctacttttttaaagacttcctttttcacgcccatattaaaacttcggggctgaaatttggaaaccgatttcttacttcccctgattccacctgttgtaaacaccgatgtcatagaataggaaatggctttctgcatcagattaaatcctttatgcgctttatctgcccctccaaaagcatcacagggaatggtcaggatatcgtttttaatgtgctctatataatctttttcaacgatgacatcactgtctacaaacaccagccattcatttgctgctctggctgccccatagtttcgtgttaatcccggtcctgaattatcctttctgaaatatttaatatccagaattccatcaaaatttttaatggtaggtttcagatcgatgagagaaccatcatctacaataatgatctcaaactccttatccgtctgctgggtaagggaggtcagcaactcaaaaagctcgtcttttcggttataaatagcaacaacaatggaaatagtgggtttcaaattgaaaatttttcaaaattacttattcgccggacaaactacaaacagtttaacagcttattcagagaaattaacgatactgagttttattcaccttattacatggaagttacaaatgaaattctggaccaagttatttggaattttgaacaaaacgaatcccggcaatccatcctaattttgctatagaaatttaaaccaataaaaaaatggaatctattatcagcacattgcagcagcctattcaatcaggttttaatgctttttcaacagctcaggaagttattcaaggaattgatcttaccggaaagacagtgatcattaccggtggctacgcaggaatcggccttgaaacaacaaaagtacttacttcagccggagcccatgttattattcctgcaagggatattgaaaaggcaggaaaaaaccttacaggaattgaaaatattgaactggaaaaaatggatctgatggatcccgcatccatcgatgcttttacagaacgatttacagcatcaggccgaagtctggatattcttattaataatgcaggaatcatgtgggtaccccttcgcagggacagcagaggtatagagtctcagttggcaacgaattatcttggacagttccatcttaccgcaaagctatggcccgcactgaaaaaatcaaataatgcaagagttatctgtgtttcttcttatggacatcagatggcaccgtttgattttgaagatcccaattttgagaaaagagagtatgacactctttccggatacggacaatccaaaacggcctgtaatttatttgctgtagcattggatgaaagaggtaaagaacaccacatcagagcctattctcttcatccgggttctgtatatggtactgatctgggaagagaagaacccatcgaactttttaaacagcttgggacacacgatgaaaacggtaatatcaaaccggaagtgcaagacagattaaaaactattcctcagggtgctgccactacagtctggtgcgctgtaagtccgttacttcaagaaatcggaggtgtttactgtgaaaactgtgatatagcagaaatagacagaggacaaatagaacacagatttgatgaaccggcaactattcgtggagtacagccctattctattgataaggaaaatgcagaacggttatggaaattaagtgaagagatgcttggattccggtttgataccaagtaattgtttttaaatacatttgtaataaaaaacttttgataatggatttccagatacaatatctcacaccggatatcaagctttccagttatgatgacaagctcttcaaaacagaaacagtttttgaataccatatgttggtctggttcatatcaggagaaacaaaaattattcaggcagataaaacctatgttttcaaagcaggagatattttcctgattccaagaaatcatcttgcgaccattatcaactatccgaaagacgggcttccacataaagctgtagtgatgcatcttacgacagagcgtctcagagatttttacagttctgttgatgatcaaaagaaaaacagccagcgggaatccagtatccacagtttcagcagccatcctcttctgaagagctgtcttacctcactcattccttattttgaaattgaagggccatttcccgaaaatattgcttatttaaaaatcactgaagcaattagtattttaagagaaattgatccggatatagatgctgtacttgctgattttaatgaacctggaaaaatggaccttattaattttatggaaaagaattatatgttcaatatgcccctggaacgatttgggtatctcacaggaagaagcttatctacgttcaaccgggatttcagaaaaatatttcagacaacgccacaacggtggcttacccaaaagcgtcttgagctggcctattatcatttgtcagaaaaaaacaaaaaaccttctgatgtatttctggaggtaggttttgaagatctttcccacttttcacatgcttttaaaaaacagtatgggtttgctccttcattggtccgataaaaacaaaaaggttgtacctatcagtacaacctttatcatttaaaatatcttctgataaaataataattattctggttctttttggatatattgatattttgaaggtttgacaccaacagtttcttcaaacactttgacaaaggtagaatgatacctgaaacccgcctcagtatatatttctttcattctttttttattatcctgtaactccctttttacatgttcaatcctataccagttaataaaattattaaatgtttttccttttttatttaaagcagcagacgcataagatctatttgttcctacaatctttgctaagtcttccaatctgaaatcgggattggtatatgatttttccatctctatatgtttgaccatgctctcatagattctgtttaactttatatcataaacactttcctgagaatcagattccaactcatcataaaaaaccacctcttcaggttcattaatttcatttttttcatttattctatgttctatatactcctcattatgtaaatagaattgatatataataatgatgattaccattataaaaaaaatgatatctatatagtttaaaataaataattgatcttttgataatattttaaaagctaaactcatagtatccgagagtccaaaaatattggaaataaaaggagccaggattatagaggcaactgtgaagattgaaacattaatggtctttttaatattatgcagaaacaaactgcctaaaggaaaagctgcaccccatattatattaatgggcattacttcccaaaatatcatgttgctaataaaatatatagctatgtaaggatataaagctatctgaataagatgtacaaaatcaaaattttctttataattccagactacgataaaaatgtaaagagagaacactgaaataatgaaatggtgaattacaggcatgataagcccccatgtatggtacagaatacaaaagctcaaagaaataataagcatcacgaagataaaacttaaagtgattttctttttcgatttattgtagttcattgatgatatttattttctaaatcgcaaaaatagagattattttattttagtgtttattttagataaaaacaataaaaaacataatcgtcaattttatttattggtaaaaaaaataacattatcgtcaataaataaaaatacaaaatattgaatatcaaaaaattaagttaaacccaaataaatatactcaatcttcatcgtatattacttctttacattttcttatatcatatttgctgtatagtatcacacaactgttgttcttaattcttaagcaaaaataatattaaggacctctatactattgaatgaaaccagatctttcaaaaaactttaaaatttcataacgcaaagaaaaaaaatggatttcaaagaaatacatataggaaaattattacagaaaaaagtcagggaggagaagattgaggtctcaagaatatgcaacttcttcaacctttcagaaaaagacattgataacatgtatgaaagtgtatcattagatatcaatatcatccttaaatggtgtaaattattacaatatgattttttcaggctgtattctcagcatctgatcttatatgcccctaaggggaacaaaaaactgaacaatttgaaaagttcactgccgagcttcagaaagaatatttatacaactgaaattatagatttcattctgacagaaattaaaaagggagaaaaaaccaaacaggaaatagtaactgaatataaaatcccaaaagcaactctacacaaatggatacaaaaatatcaaaagtaaataaaacgattcctgactataaaagaatttatacggatatgatccaaaaaagatatccgcataaaaaagaagaatgcagaactattttagaaaaaaataagttaactacattagatatactcaagctgaacgatataatttcagatgctcataattctgtggcttgcaaatcaaatcaaaaacacaagtcttatgactcagaaacaattataaaaatattagagtaccagaaaaaaaataagatcgccaattaccaaacagctatttactttaatatgagcaggaatactattacaaaatggaaaaaaaaatatgctgtctagaatcagccattaatcaagacctccacaacaaaagcattttatgtaaaatcccaaataaaaacatattcaaaataattacccatttatcattttagaactccatatcactaacattcatagtatgctccagaaaatcaataaagtattttggtaaattctcatagaagaacagcattcttacggatataggcaagatctgcacagttaacaaaaacacatagaattattcatttaaattaaatacaaacatgaaaaaaaaattatttttattgggatttggaattatctcaagctatttgttaagccaaaatggaggtgttggaataggaaccacttctccggatgcatctgcaatacttgatataaattcaacaaataaaggggttttggcaccccgaatcgccttgacctctactacagatacgactaccataccttctcccgcaaccggattgttggtatataatacaggaactgccggactttcttttgcaggatatgtattttggaacggttctgaatggagaagccttaacaattcttctcttacaattggcacaataggaaatcttctttgtagtaatgctaccctttctccggagacttatacccaaaatgttccctattcaggaacattgactattccttatactggaggaaacggtggtacttatccctcgcaaatcatctcttcaaatgggcttacagctacactgcagtcaggaaacctggctacgggaacaggaaatcttatttataatgtatcaggtactccaacagtttcaagccctacagtaactaattttaccattaatgccggaggtaaaacatgtactgcttctgtcggaataaaaaatacaataggagtaggttcagaaatttattggtatggtaccgctcctgcaaatgtaggaagcggcggattgaatgctaccacaacagttcctcaaaactatatgagttattatgctccggatatgcccgttatagaaggtgtgagacttgatatttattttattgatgatgttacagcgagtggcaccgtttccgaaatgatccgtttagtaaatgtttccggagccaatgtaaaagttaacttttcgttactgtcaagtttcaatagttttggtgcctctaatgtatggttaggaaatggacagtttattaatctcgataatggaaattataatggagatgggttaaatatgacgaccagcagcacgcctcaaagtcttcctgatacaaccatattagaatttcaaaatgaaattacaacagttcacttaacgatcaatggacattggtacagagctgagtttttcactgtgattgataataataatacgaccgctactaatgatgatattagaagagcaggaatagtaataaaaagattaaaataaacaacacataaactaaaattaagcagaataacagcttagagatctgatttttctttaacgaaaaagcacagtcgttcactaatgaatgaccgtgctttttataatttattataaaagctaaaatccagagaatcccaatagtattgtaattactttttctgtaaaatattctgattttttgtttctttctttttagatattatattgtgattcagagcctctcttttaggttttgaatgtgatgattttgattcagaactaaaaagaccgaatatattcaaaactaaatcaaatatttcaaaaaaattccaggacattattttattttagttatttccttccagcttatggaccttcttcgttccttcgtacatttcgtactgtaaaaatcttgtttccagctttccgttgaaaagtttgatttttctggaaggacgtaatccgattttcttcactgcctccaagtcagaagagatgagccatgccaatgtattcggataatttgttttaaaggtatctccgatttttttatagaaatcatcatcattaatggaaattctctcatcgtacggtggattgaataccattaataacgggaaaagctcttttttggaatcaaagaagttttgttttttaatctcaataacatcttccatttccgctgcttctacgttcattcttgcagcattcagcattcttgcatcaatgtcgtatcctacaatttttccatcaaattgttttactctgttaattctgaattctttgatctttgtaaacagatcggcatcataattattccagttctgaaacccgaatctctttctgaagatctgagccggaagatccatcgcaatcatcgcagcttcaatcagcaatgttcccgaaccacacatcggatcaagaaaatttccttttccgtcccagccagccagctgaagcattccgcttgccagcacttcattgataggtgcttctccctgctctcttctgtatcctcttttaaacaaaggatctcctgaagaatccatggaaatcatcaccagctccctgtcaatatgaagatggaatttaatatctggatttctcgtttccacattcgggcgtcttttgaatttttcctgaaaataatccacaatggcatccttcatttttaaggtcacaaactgtgaatgcttaaaggtctcagaatttacggttgcatcaatagagaaagactggtcaacatccataaaattctcccattcaaatttgaataatctgtcatagaactgatgctgattaaaagctttaaattcatgaatcggcaccaatattttcaatgccgttcttgcagaataattgattttataaagaaagccaagatccccttcacaatttaccgctctgttcttgatttcaacatttcttccccctaattttttgatttcttctgccagaatctgttccaatccgaagaatgtttttatctgtatttttatattttctgtatccatacgtataaattaaaagatttaaagctttaaaaattaaaagattagctattcaatttcttgtccaattgaatttttcaatctcttaatgttgtaaaatactttgcttttaaccgcacaaatttaactatttttgcgttatggaatggtttgaatcttggtttgataccccttattatcatttgctttatagcaacagagactatactgaagctgaaaacttcattacaaagctcactgcggatcttcagcttccgcctcagtcgaaaatcatagatcttgcctgcggtaaaggaagacattcggttttcctcaacaaattagggtatgatgttttgggattggacctttcaagacaaagtattgaatctgataaacagtatgaaaatcaaaccctgctttttgaagttcatgatatgagaaacccgattgatgcagatcctatggatgcagtattcaatctgtttacgagttttgggtattttgacaatgaaaacgacgacaaaaaggtatttcagtcggtttacaatgttttaaaacccggaggatattttgtactggattatctgaatgaagaatttgtaagaaatacgttggttcctgaaaccacgattacccgtggggatattgaattcagaattcttaagaagattgaagggagacacgtcatcaaagatatccgttttgaagcggatggtaaaccctttcatttctttgaaaaagtaaagctgcataccctggaagccattcacgcatatgcttcagaatgtggctttgaaagaataaaaatctggggagattatcagctgaatgaatttaaaaaagaaaattccccgcgatgcatcaatttatttaagaaaaaataatgacaacagtatttttactgattttaagtgtcgtaacaggagtttttctgggaaaacactttggtaagaaagagaaactggccaaaaatcttctgatattaagtgccggttttctgatcacgatttgtctcaacgaagtcttcccacaggtttatacctcatccggaagcagtaaccttgggatatttgtcatcgcaggagtacttcttcagatgattctggaggctcttaccaaaggttttgagcacggacacttccatcatcatagtgagcataatatcctccctgttgctttaatggtgggattattcattcacgcctttattgaaggaattccgcttgccaatgaagagcatgagatgtcaccctacctttggggaattgtatttcacaatcttcccatatcatttattctgggagcatttttatttaacagaaaaggagaatcaaaagcctcctcatcttatccttccattctcattgtagccttatttgccctggcttctccaatgggaatgttattaggtaattatttcaatccggatcttcagccctattttctggctattgtaggaggaatttttcttcatatctcatccgtgatcatttttgaaagcaataaaaatcacaatatagactgggtaaaaatagggttggttgttttaggtgtttcacttgcattgatgatgcatctttttcatcagcatcccactgctcattctcattaaaaataaaaaaactccggaatatccggagctttattatatagagcttatgtaaagcttagaatttccatcctaatgtcaggaagaaattatttctgttgtttttcacatcgcttactgcgtacgaatcactttcgaagattttacttgaagaataataagatgaatcaaaattatcgcccatatatcctctcataaaaggattggtatatttggatgagatgttctgataagatgcatcaatatagaatgacttgaaatcatatccgataccgaatgaaagcgtgtttctgtcacttagcatcagattgctgtaagactggtcacccacagtaccggcatcattaaatctgctgatggtaagcgcatcaaacggacttgactggtaagaataaccacctctcaacctgaactgctgtaccctgtactcagcccctactcttacttctgaaaggttcttataattatctttgaagaagtcgttcaattctctttctgcacctccgtatactttgtaatcaggttttgtaagtcctagcgtatagtctacgtttaatgagaaatttttacttgctacaaaagctgcactcacagtcgctttaagcggtgaagtaaactttctgttttcagcacccatatcatctccgtaaaccggatcgttgtagaaataataatttctgtctattgtccagaatgtcggcgtttcaagggatgcacccactctgaaattaggacttaactttccgattacccctaaagaagcagaaaaacctgacgatctttctgaatagggagtatcctgcttactgaagccttctgttgaattattagtcagatttcggtaaaataagctgtcatactgatccagtgaggcattgaagaaattgaacccagctcctaaatataaattatgattataattggccccaaccccaaagctcatctttgacaagttcccatatctttcatatatatgacccgccaatgcagcatctttggtgatatcatctttatcaaaagcatacacaatattattatttcccggtgactggattacattgtccagcgtctggttagagaaattaataccaatattgataaatttccatccggtttctgtcatcaaaggaaaagcaatgattcctccggcatttccaagatcacctttcgtcttgctataatctatggtagctcccgctaaagaactgctatttttatttcctaaaatagataaagttcctgaaacctctcctgaaatagctacccctaaacctgcagggtttgtaagcaaagaatttgcatcaccacccagcgcaccattagctccagccattgcattaaacttagctgatcccaccataggagtacttgagtaaacttctacagtatttcttatcacagaaacatcctgagcctgcgcataaaatgcagcagaaatactcattaatactaaagatttttttaacattattttttatatagtttattagtttgaacaattatctgaagcctcctctgcctccgccgccggatctcattccgcctccgcctgaagaaccacctctgaagcctccgcctccgccattgaaaccgccgctggatctgaaacctccggaatcattagacctgaaacctccgttattgtatcttggctgcgactgctgataattataattaggtcttgtttgtggtgcagaattacggaatccaccgttagattgagtatttctgaatcctcctgaacttccgtttctgaagcctccggaattacctctgaagccaccatttgaattagagtctctgaatccgccattattggtatttctgaatcctccatttccattagtatttctaaatcctgagttagctgtattggttctgtaaactgcattagctacccctgtattctggaatcctcctccactgataccacttcttctgtaaacaggtctgttgtaatagccaccaccccagtagcctcctccgtacccccaatatgggtttccgtagtatccgccccagaatggatcataatatcctccccaataaggagagtatccccagtatggacttccccatccgaaagagcctccccagccccagccgaatgatccgccccatccccaggaaaggcttgcaccccagccccagccgcggttccagccccagccccaatatgggctatagccaccataccatccccaaggagatccccatccccatgagttgtcatagtagtttgtctgagaacccgcataaagtccccagtcggaatctgtagcagtggtattccaatttggattggtaccgctccagtcattatatctgttctcctgctcacggctattcgcctgggcattctgaattacgttggaatcctgatagtagtcataatattctcccactctgttcccgctatcattaatgataactccttcaggtagcgtatccttattggggtcgtaatacaccccgtctgtctcgctataccctcccatctgagcaccacaagacacaagtaataatccgcctgatatcgccagaatccctttggatcttagcagaccaagcaaatttttatgtatatttcttttcatgataacgtaaaaatttttaatttaaattatatttgcaatctgtaccaaaaatgtaccaaaataccggtaaaaaaatctatcaaaaatagatttttatttttagataacaataatgtacaaaagttaaaaaaattaaaaaaaataatggcaaaattaacctcaagaagcgaagattacagcaaatggtataatgagctggttgtaaaagctgatttagctgaaaactcaggcgtgcgtggatgtatggtgatcaaaccgtatggctatgcgatctgggaaaaaatgcgtgatgaaatggataagaaattcaaggaaacaggtcacgttaacgcatacttcccgctttttgtgcccaagagcttgtttgaggcagaggaaaagaatgcagaaggttttgcaaaagaatgcgctgttgttacccactacagattaaagaccgatccggacaacccatccaagctgattgtggacccggatgcgaaactggaagaagaacttatcgttcgtcctacttcagaagctattatctggaatacatacaagaactggattcagtcttacagagacttaccaatactgatcaaccaatgggctaatgttgtacgttgggaaatgagaacacgtcttttcctgagaactgctgaattcttatggcaggaaggacacactgctcatgcgacaaaggaggaagctgttgaagaagcagaaaaaatgaataaagtttacgcagattttgcagaaaacttcatggccattcctgttattcagggattaaaaactccttctgaaagatttgcaggagctgatgaaacttactgtattgaagcattaatgcaggatggaaaagctttacaagccggaacttctcacttcctgggtcagaattttgcaaaagcatttgatgtaaaattcaccaacaaagaaggaaaaattgagcatgcatgggcaacatcttggggaacttcaacccgtctgatgggtgctttgatcatgacacactctgatgatttcggattggtactgcctcctactcttgcgccaattcaggtagtaatcgttcctatcttcaaaggggaagagcaattggagcaaatcagcgaagtggctttggatattcaggctaaactgagagcaaaaggaatttctgtgaaatttgacaatgatactcagaacaaaccaggctggaaattcgcagaatatgagttgaagggagttcctgtaagaattgccatgggaccaagagacctggagaacaaatcagtggaaattgcaagaagggataacctgactaaagaagtccgttctattgaaggtcttgattcttatattgaagatctattgaaaactattcagcaggatatttacaataaagcatttgagttcagaaaaaataatatcacaaaagtggatacttatgaagaattcaagaaagttctggaagagaaaggtggatttatctacgctcactgggatggtactgctgaagaagaggaacagatcaaagaagaaaccaaggcaacgatcagatgtattcctttggatgatgatatagaagaaggtatttcattgatctcaggaaaaccgtctaaaagacgtgtattattcgcaaaagcttattaataattttaatgattttaaaaaaaatcattaatttttaaagaaatattcaaaaaaaagtgacatttggacggatttttgtttaaatttatatcaacattaatccaaaaaaatttattattatgtctttaaatgtcattgatttaattaaaggacaattaggtcccgctttggtttcacaggctgcatcgcagtttggagaaagtgaatccggtatttctaaagcaattggcggattattacctgctgtagtgggtggattagccaataatgcagataagcctggcgttgtggatgctattacacaggcctcttcaagtggaattttggggaatctattaggcggagcgtctaataaccctattatttcgaacttgctatcttcaatatttggagataaaataagcggactggtaaattccattgccagtttttcaggagtgagtaacaccactgcaggttctttattaaacctggtgactggagctacagtaggtactgttggaaaatacgcagccgacaataatctgggggcttcgggtatttccagcttactgaatgatcagaaaggcattgtttcttctctgctgcctgcgggactttctttggcatcctttggattaggagctgaaaattggtttggccaggcaaaagaaaccgtttcttcggtaacttctacagctaaagataacatcgctgaaagtgttgctacagcaagagaaaatgtttcagaaggagctagagaagtaagagaaagatttgaaaataacaacaataataatcaaggcggaggttcaatctggaaatggttgcttccgcttttattattaatagctgctgcttatttcttatggaaacagtgtgagaaaaagcagaccacgacaaccactaccactacgtctgattcaacagcaaccagttcaactactgatacagctgctgctacaggaacagcaacgcccgcaccggcaaccgctaaaactgatgaaaacattgaccttaacggggtaatgctaaaaggttacaaaggcggaatggaagaccagatgatttcattcctgaaatccggaggttacaaaaatgcagctgatgattctgcgttgaaagataagtggtacgacttcgatcatgttaatttcaaaatgggaagttctaccgagcttgaagctggatcacaaggacaattggacaacctggtagctatccttaaggctttccctgatgcaaaaatcaaaatcggaggatacacagacaaaacaggaaatgaagcttccaacgttaaactttcccaggcaagagctgattatatcaaatctgctttagctaaggcaggtgttggaggtcaggtacttggtgctgaaggctacggaagtaaatttgctaaagtagatgcaaaagcttctgatgctgaaagagctgctgacagaaaaatgtctgtaagatttgccaagtaatctttagactcaataaaaattagatcccgggaactagttcccgggatttttttatcttatgatttttctgtttacatatatttaattaaatttgttagtcatttctaacatttatgaatttgaatttaagaagcgcctggcgaaaagataaaacagaccattccttatcagaggtctattcatcgatcaaagtacctaaaaatgcaactttctggagaaaataccttgcctttgcaggacctgggctaatgattgccgtaggttatatggatccgggaaactgggctacagatattgcaggaggggctcagtttgggtatacactactttcagtaatccttatctccaatatttttgcagtggttttacaacatttgtctgtaaaactgggtgtggttgccgaaagagaccttgcacaagcctgcagggatcacttcagcccaaccaccaatttcatactctgggtattctgtgaaatagccattgctgcctgcgatctcgctgaagtcatcggatcagcgattgccttaaatctgctattccatattcctctgacctggggtattgtcatcacaactgtagatgtgttaattatccttttgcttcaggcgaaaggcttccgttggattgagagtattgtaggcggacttatattcattattctggcctgtttcatgtatgaaattgttatttccaagcctgcgtttaatgaaatcctgggagggttggttccacaaaaagaaattattcagaatcctgctatgctttatattgcaatcgggattttaggagctaccgtaatgccccacaacctgtatctgcacagcagcattgtacagaccagagattatacccgtgatactgaagggaaaaaagaagccataaagtttgccactatagacagtacagtttcactaatgctggccttcttcatcaatgcagccattcttattcttgcagccgctacatttcatacaaccgggaacgaacatgttgctgatattcatgatgcctacaaaatgctgacacccattttaggagcttctatggcaagtattgcatttgctattgctttgctggcttccggacaaaactcaacattaacaggaacgcttgccggtcagattgtgatggaaggatttctgaatatcagattaaagccatggcttcgaagattgatcacaagacttattgctgtaattcccgcacttattgtcgctatactttatggcgaacagggaacaacagagttattggttttaagccaggtaattctatctatgcagctgagctttgcagtggttccattggtaatgttcaccaacgataaagccaaaatgggtgaatttgtaaataaaccctttcttaaaatctgtgtatggattatttccatcattattattgttttaaatctgtatctgctctaccagacgtttacagggaaataaaaatataactatagctttttaaattggctattgggcattgttaggtgaatggtcaatggtcaatttttgctttgcaaagtcaatttttaatgctgaacaattactaattcacaagcgaagcggattgacatcttaatcatcgcagatgaatcgtcaatggtcaattattgctacgcaaagtcaatttttagcgatgagcaataaccaattcacaagcgaagcggattgacatcttaatcatcgcaggtgaatggtcaatgggcaatttttgctttgcaaagtcaatttttaacgatgagcaataaccaattcacaagcgaagcggattggcatcttaatcattgcaggtgaatcgtcaatggtcaattttttctttgcaaagtcaatttttaatgatgagcaataaccaattcacaagcgaaacgaattgacatcttaatcatcgcagatgaatcgtcaatggtcaatttatgctttgcaaagtcaatttttaacgatgagcaataaccaattcacaagcgaaacggattgacatcttaatcatcgcagatgaatcgtcaatggtcaattattgctacgcaaagtcaatttttaacgatgagcaataaccaattcacaagtgaaacggattgacgcatgcaccattcaccggctgctcatttttctgccttaatgtccagattttatatttggcaggctctttgtcaaacaatctgtaaataaatattgaattatggaaaaccaggatattaacgaagaaagcatcaataatcaggaagaaaacaatgttcagaatgacgcaacatctcaggacaatgtgacagctgctccttctgcggaggaacttttggcagaagaaaaagaccgttacatcagattgtatgctgaatttgaaaactataaaaaaagaacgagcaaagagaagatggaattcttccagtatgccaaccaggagatgatggtttcaatgttaggcgttttggatgattttgaaagagcattaaaagaaatcgctaaaaacggaaatccggctgatcttcagggtgtagaactgatctatcagaaattcaagaataaacttactgaaaaaggcttaaaaacaatggaagtaaaggctggtgacagctttgatgttgatttccatgaagcgattacccaaatccctgctccatcagaagatttgaaaggaaagatcgtagatgttattgaaacaggatatacgttgaatgataaggtaatccgttttgcaaaagtagtaacaggaaattaaaattcataaatgataaatggtgagtgataattgatgaatgttttcacttattagctttacaatatcttttatcatttatcaacaatcaattataaaattgtcatgtcaaaaagagattattacgaggttcttgagatcagcaaatctgcatcaggcgacgaaataaaaaaagcataccgtaaaatggccattaaatatcacccggacaaaaacccgggagataaagaggcagaagaaaaatttaaagaagctgctgaggcttatgaagttctgagcgatgatcagaaacgtgccagatacgaccagttcggacatgccggaatgggtggcaatggtggtttcggaggcggaggcttcggaggcggaatgaacatggaagatattttcagtcagtttggagatattttcggtggcggtttcggaggatttggtggtggcggtggccgtcagcaggtgaaaggttctaatttaagaatcaggatcaagctgaatcttgaggaaatggtaaacggaactcaaaaaaccattaaagttaaaaagatgaagatggcagaaggtgccacttcaaaaacatgtcctacctgtaacggttccggtgttcagataaaagtaatgaatacgatgtttggccagatgcagacacagactacctgcggtacatgtcagggaatcggaaaagttgccgataaaattcctgccggtgccaatgcacagggtcttgttaaggatgaagaggaaattacaatcaacattcctgcaggagcaagagacggtatccagcttaatgtaagaggaaaagggaatgatgctccgtttggaggaactccgggagatttattggtaatcattgaagaggaagtagatcaaaccatcaagagagaaggagacaatcttcaccaggaactttatgtttcatttgctgaagctgctctgggaaccaaaaaggaaatccctacagtaggcggaaaagtaaaaattactgttgatccgggaacacagtctggaaagatcttaagattggcaggaaaaggacttccaagcatcgacagctatggtaaaggagacatgttcatccacatcaatgtatggacaccgcagaagcttaccaaagagcagaaagatttctttgagaaacagatgtccagcggagaaatggttgcagaaccatccggaaaggaaaagactttttttgataaagtaaaagatttattcaattaatatagaaaaagagacttttacaagtctcttttttgttttaaagaataaaaaatcctgcactctttcgggtacaggattttttggttatttaattctaattctgttcttatttttttgtcaccagggaataaattgattttcctaaagtaaatactgctactgcagcaatccctcctacaagaccgaaagtaaactctttcagcatagccggccaggttggaagcaattcatgcagataatggatattgtgggcaaaaatacctcctgaaaccagtatcagagcaaccgtacctacaattcccagaagtttaataattacaggcaatgcttttaccaataaatgtccgatcttggaaaagaatcctttatcatgacttttcttgatcaggctgaaaccggcatcatccattctcacgatcagtgctacaattccgtataccccaactgttgccaaaaacgatacaaatgttactgttatgatttgcgtaagaagtgggtgctcctgctgaataacagttcccagtgcaataattacaatctcaatggaaaggataaaatctgttctgatggctgagtttattttcgctttttcagaggcttcgaaattttcttcttcatcactttctttgataacttcatgtccttttttggaacggtgaaacaggaattctataatcttttccactccttcaaaagcaagatagattcctcctaaaatcagaatcatttcaatagccggcttatagagccagttgagcagaaaagcgatgggaagaataatcagtttattgataaatgatcctttggtaatagcccacagcacaggaagttctcttgaagaaagaaagcctgtggctttttctgcatttacggccaggtcatctcctaaaattcccgctgtcttttgcgtagcaatcttactggtaaccgctacatcatccatcaatgctgcaatatcgtctaaaattgcaaaaaagcctgatgccatattttaataattttttaatctttgttaagttcagcaaaaataaatatttaattccgtttttgaattcataatctgacaataattttaaaaattataagactgattaaacaatgcttagctttcaatattttatatctttgtttaaaatctatccgatggatgaaaactgggaaacccaattacaaagtatatggctaaaacttggaacgataagtgatgaagagtttattcagcaaattgaaaatcatgtagaattgcttaccattacggattatcaggctattgctgattttgaaagagcctgtgcttttgactccaccggacatgaaaagaaagcagagcctttgtacagatcagcattagacaagggattaaccggcttacgaagaaggagagcaagaatccagctggcaagcaccttaagaaataacggaaaaacagaggaaagcatccgtattttaagggaagaaaaagtcaattattctgatgagctgaatgatgccgtagattcttttttagcactatctctttcttcagcgggaatgtatgaggaagctttatcgctaaccctaaaggcaatttcacatcatttaccacgatacagccagtctgtttaccgttatgcaaatgctctgtataaagaattaccataatatttctttatttgattctatgaaaaaacttattcgcaggtatcatttttttgtgatgggatgtattggtttcgtgctgcagtcctgcaatacgaaattcagagtctgggtaggccccggaggccagcagaaaatttacaatctcaaatacggtgagcataaaaggcagaaaatggatgtctttcttcccaaaaattatgctgaagatactcctgtcgtgcttatcgttcatggcggggcatggactttaggaaaaaaagagcatatgatccagattcagaagatgctttttgaaaacaggattccgagcatcaatatgaactatagactggtttctgcaaagaaaaaaatcacttacaagcagcagcttgaggatattggccaggtgattgaaaaatttaattcacttgcagataaagctgagcttcaacccgacaattatattcttctgggagagagtgccggcgggcatctggcacttctttacggataccagcatcccgaacagatcaaaaaaatcatttcactgagtggcccaacagattttttcagttcgcaatatcttaaatctttttattcaaaatatacctctcctactatccagaaagtggtaggtaccaaatttgaccgcagcaatgtttctgaagcctttaaggaagccagccctattgcgaacattactaatgtccctacgttgttatttcagggaaataatgatattctggtcaatcagcatcagggaattgctatggattcggcgctcacccggatgaatgttccccacaaatttgtctttatgaaaggagcaggccacgcacccagattcttcagcaaaaggaaaagagacagtattatttatcctaatatcctggaatggattaaaaagtaaagatgtcttacagaatttatttgattattaaacgcaaaggataataattacaacgcattattgtaaggaagcgaagaagtcgtgactttgtcactgacgaagctaacgaatatatatccatacgcttagaaagaatcaattcattgattcctacctttttctttcttaaaataatactcaatacaaattaatctttgcgttttaaaaattcattacaagcaataaaaaaagccatctcatgattgagacggctctatatttttaattgcattgtttatttattcaaagtcctgatcttcgtatttggataaatcttcttttttcccgaaaacaaacttgatgattaccggaagtgtagttaccagtacaatcacgataataatatattccagtttttcttttaagttgattccaaactgctccataaagagcttatccaggtaatgtcctgcaaagatcagaataaacgaccataatacagcaccgataatattatctcttaaaaactcttttttatccatcttcacgataccggctacaataggggtaaatgttcttacaacaggtaaaaaccttgccataataactgccagtgctccatgtttttcaaagaaatcatgtgcctgataaagatatttctttttgaaaagcattgaatccggtcttttatacaaagccgggccggcttttcttccgaaataataccctacttcatttccaataatggctgcaagggatactcctgaagccagaagtgtagtatccaggaaatcgcttcctgtagagccaaaagtctctttgatgatttcaacggcataaattcctgaaacgaataaaagtgaatctcccggcaggaaaaatcctacaaaaagccctgtttcagcaaatacgataaacaaaataagccaaaaccctcccattttaatataaaactcagggtttaataaatccttccagctattgaaatcttccataaatatcgatgaacaacaaaaataggtctaaaatgtctgaaacaaaaattaattataagattttaactaaaattcaaacatgatttttataagtcgaggtcatcatcggaaactgccgtcccatcggccatcaggaatgctttcaggaaaggagtgatattaccgttcataacagcatccacgtctgacgtttcatgacctgagcgtacatcttttaccagcttgtaaggatgcatgacgtagtttctgatctggcttccccactcgatcttcattttattggcctcaatctcgtttctggctttcatacgttcttccagttccatttcgtaaagtcttgaacgaaggagctgcattgctttttctttattctgaagctgggaacgggattctgagttttcgatgataataccggttggtgcgtgacgaagacgtacagcggtttccaccttgttgacgttctgccctccggctccggaagctctcatggtctcaaaactgatatcggcagggttgatattgatctcaatggtatcatccactaaaggataaacatacacggaaacaaagcttgtatggcgtttcgcattactgtcaaagggtgagattcttaccagtctgtgcacgccgttttctcctttcagatatccgaaagcatattccccttcaatttcaagggttacagttttcactcctgccacatcaccttcctggaagttcagctcacggattttatacccctgcttttctgcccacatcgtatacattctcatcagcatagatgcccagtcacaactttctgttcctcctgctcctgctgtaatctgaagaacggcagaaagctcatccccttcattggaaagcatatttttgaattcaaggtcttcaattttctccaccaactgcggaaatgtttcatccagttctttttcagaatccggatcctctttggcaaagtcagccaacacctgcagatcttcaaactgtgtctgaatctcatcatagctttctacccattttttcttggaacgaagctgttttaaaaatgcttcagccgtttttggattgtcccaaaattcaggtgctgcagttttttcgtcatcattggcaatttcaatcttctttttctcaatctgaagatatctgtgtaaatcttcaattctggattgaacttcttttatctggtcgttgttaatcacgaatttttctttttgcaaaaataaggaattcttttagagtggagaggtacgcgcttaaagttcccggtttaaagttttgggttcggaatccgtgtttttaggattcgggattcgatggataaataactattcttttacgatttcagcttcaaagcttcttctaaggtattcttttgattttttactttctgttttgaagcctgccattgttaagatataaacaaaaagtaacatcagcagaggcatgaaaaattctacagacatttttttctctgttgaaccgatcataatgaatatccctactgcaatggagcaccagaatagtaaaaatacaagtacaaatgcatgtagcgacatggtcacctgtatttgggttccattattttcattttgaattttaccatttatctgaggaagaaaagagtttctgtattgtatcactctgcttatttcaaagctattattatccacagatccttcataatcttttatataattttttcccaaaccaaattttttaggttctacaaaaccagaaagtcttgtaaaaacttcctgttcagataaatttgtcctgtaggtaatacgttcaaaaggtaaatatttcatttgtatttaaatcatttttgctatctcctctccaattttaggggctaaagcaactcccattcctgaaagccttacggcacaaaactgtctttccgaaatctgttttacaatgggtgttttttccaggcccattgccattattcctgaccagcggagtgcaattttaaagtctttatgaggaagaacaacttctcttaaaaagttttccaggtgattctgcagaaatactgtcgtttcaaaagcgatagtttcttcggttttaaaatcctgatttctcccaccgcccagcaatattctgttgcctaagttcctgaagtaataatacccttcatcataatgaaaggttccttttagttttaatccgtctataggttctgtcaaaaggacctgtccacgggctggaacgatattttctttttccagaaactttgaagtgaaagcattggtacaataaatcactttaccagcttttacggacacatcgccggagagatagacctcagcatcttctgttctttcttcaatcttcaggacttctgttccgaataaaaactccactttcagttcatggcatttttccagcagcttttgtaacagtttcccagaatgaagacttccttcacaagggttttcgatgagaaattcagatttcccaagtccgaattcttttattttattctgtttcagactgtatgttttatccagtcctgttattgttttcagtttttcattaacactgtcgatatgggttaaaggctcttcattatttataatttcatagtctccttcaagttcaaaatcaatctcatcatttttaaaataatgtcggattttctgaagcccttcaaatctcattttaataagcttcagtgtttgttcccatcccattttctcagaatcagcaatgatttcggtaaggcttccaaaacaggcaaaaccggcatttcttgtcgaagcacctaacggaatagcgtttctttccacgattaagacagatttttcaggatattcctctttgacagctattgcagtccatagcccggaaaatccggcacctatgatgataatatctctttttctgtagaatgtatccagttcccagatgctgttcatgaataataagtaatgagtgatgagtattttttgtaaaaccttaaactttaaaccttaaacattgaacgattaccctttatctcccccgtcattatgctgaaacccgatggctctttgtggttcttccactactctgtaggtttccagttcatttttcaatgcctgaattctgaactgaaaatcatcaaaattattgataatggcatcagccaggaatcttgctacctgatcaagatattcttcagtaagcttggatcctgcatctcttaatgctccgtttaagagattctggtcgatcttcagtttttcgtttctggttttctggtaaaggtttttaatccttttctttaagctttgggtaaagtcgatcagcatggtattgctgaaggccttcatttttgaagagatgtcatgccagaaaggaattttatccgctttgttattcttaagaattttatacaataaagaatcttcctcaagtcctctggtcatcgcataaagaataatttctgaacgctcagaagcattaggaggaaaaacagggatcagcacatcaaatcttccaggtgccagaatttcttcatcaatttctgccacagaattagctgagcccaccatcagaactccttctttttcaaatttgctgatgtaatgcagaatgagttcctgcgcttcaaggttacaggaagcaatatctgtctctgcttttcgctgcatcataatttcatcaaaatcatccatgaaaagaagcattttattttccttcatcatgctcagcagaaaatcactgaaattgatttcattgccatcaatcaatgaagttcccagataatgttttttaacttctttaaactgatatccgatgatttcagcaattttgttggcccagaatatcttaccgctaccgggaggtccgtagaggataattcctgcaggcttgttgattccccagtctttgatctgttgtgggttaaggaacggttccaaaacgctggacgtataaaaaaacagatctctgtatcctatgaaatctctttgctgcagactggttttatgcccgaaataatcatacacaaactgatagtttcctcccagtttgttatcaattccataacttgatacagaagatttgaaaaaaccgttgtcgaaaatattgagattattgtctttaattaccttttcaaccttatcttttggctgtttgatcacttctgcaatctgctccagggttttatttttatcgagatctttttcgtataaccttagaaaatctacattttcacgggcaaacttttcaaaatctttctttacctcaaaagtagtacttatgcagtctaccagttcaagatcaaaatcctggataaactgtttaatggcttctgcagaaacctgtaattcttctgcgagttcaattagcttcataactgttcattaattctatcaaatttaatgcatttacccttaaattaatattgatttttgttaattctgtaacattctctaatttatatagactactactatgtaaaacaaattacatggaaaagattttatcagtaaaaaatttgacgaagaaattcaaaagagttgtggtcaacaatatttcttttgatgtcgaaagaggtaatgtttatggacttctgggacctaatggaagtggaaagtccacaactttcggtatgctgctttcaaccatcaaccctaccagcggcgactggttctggtttggaaaaaagggaacagatccggacaccttaaaaaagatcggggctattattgagcagcctaacttttatccttatttaagtgcggaaaccaatctcaagattgttgcagaaattaaaaacactccttattcaaggattgatgaagttctgaaaatcgttaatctgtacgaaagaagaaaagatgctttcaaaactttttctttggggatgaaacagcgtctggccattgcttctgccatgcttaacaatccggaagtattgattttagatgaacctaccaacgggttggatcctgaagggatcatacagatcagagaaatcatcagcgatattgccaaacaaggcatcaccattattattgcaagccatcttctggatgaaattgaaaaaatctgcagccacgtaattgtattaaaagaaggaaattccatttactgcggaagagtggatgaaatgacctccaataatggatatttcgaattaaaagcagacaacaacacttcccttttaaatgctttgaatgaacttcaatggttttcctccatcaatcaggaaggtgatcttatcaaagctcagatccgtgacgatgcttcaatttcagcttcagcaatgaatcagaagctggcagagaagggaatttatctttcccatctgacgaagaaaaagctgtcccttgaatctcaattccttgaacttgtaaaaaacacgaattaatcatgataaaattattaaaactggaatactacaaaaacctgaattataagccattcaaagttttcacgatactttatttcgctattcttattgctttgcttttcatcggattggttgactttgatgtttttggagggactgttaacttaaaggagcagggaatttataatttcccggaaatctggaatttcactacatggattgttgccttattgaaaatcttcctgggactgattattgttttctctatttcacaggagttcagcaacagaatgttcaaacagaatacaattgacggactgagcagaaaggaattcatcacttcaaaattgctgacaataagtattttcaccattgtttcaacagctattgtattgggaattactttgttcctggggtatcaatactcaaatacaacggaatctgcaaaggtttttgctgaaattttctttatcggaaattactttgtcaagctatttactttcttctgcttcttaatgttcctgtccattttactgagaaaatcaatttttgtatttcttgcactttttgtattctggattggtgaagggattttaaccgctgttgaagtattctcaaaagtaaaaggaatgcaaggtccacaaagaaatgagattcttcagaatgacttttttataacacatcttctgccattggaaagtatgtctaaccttattccaaatccgatgatgagattgaatatggccaaagtgatgggtgtaaaatatgatttccattaccctacagaaagtcttattgcctgtctggtgtggtgtggtatttttatattcggatcttactggattctgagaaaaagagattggtagttttcagtgctgaagattaaaagatttaatgattaaaatatttaaagataattaatgactataactagtcctaaataaaaaggctgccatccggcagcctttctttcacattactttttatctaacaacgggagatattttccgtatcctttactttccatttctgcttttggaataaatttcagagaagcactgttgatacagtaacgaagtcctcctttatcttgcgggccatctgtaaaaacgtgtcctaaatgggcatcaccggttttacttcttacctctactcttgtcatcccgtgggagcggtccattttttcttcaatcagactttttgtaattggttttgaaaagcttggccatccacatccggattcaaatttatctgtagaaacaaacaacggttctcctgttgtgatatctacataaattccttcacgtgtttcattccagtattcgttctggaaaggcctttctgtaccgttttcctgagtgacattatattgttcagcggtcagtttctcctttaaaacttttttatcctgtttttgataggctggctttggaagcgggttggctttttttgccatttcaaaaagtcccggttcaatgtggcaatatccgccagggtttttgtccagataatcctgatgatagtcttctgctctatagaaatttttcaacggaatggtctctaccaatattggtttgctatagttttttgccagcttctgaacttcgtcttttactactgcttcatctgatttattggtgaaatagattccggttctgtactggtttcctctgtcatttccctgctgatctttactggtaggatcgatcgttttaaaatacagatcaatcaacagtttcagatctacctgttccggatcgtattttacttttacggtttctgcaaaacctgttgtatgactcacgacttcttcataggtaggattttgagtattcccgttggcgtaccccacttctgttcctacaacaccacgaatctgttgaaaaaaatgttctgttccccagaaacatccacctgcaaaataaatctctctaacgtttttactatccataattttctcattttctttttttacttccgccacattgggctttgctttcctgaaaagcccggatccagcagcaaatactgcgatacccagaatgattccgagtacaattaatatatttttcatttttacctttttattcattatttattattttgaacgatcatgaatccaaatcctaaaagcataagatcttttacaataaagaaatccgtcacaggcactccgtccactatcttccacattcccggagtagtaaacaggtagcttaatgttgtcaggaaaataacaatcattcctattcccgcatacttcttcagtacagcaaatttcgcactaaatatcaggagtaaggcaatgataatttctatcgctccgataagatttgacactgcctggacgcttatgattttatatacgaaaaaagttaagaaatggttttctaccaaaggttttattgcggatgcttctgtgggggtaaatttgaagataccgatccaaagcaaaataagagctgctccgaaaagggagatgtaatacccggtttgggctaattgatttttagatttctgtactgttccgaccatgtttttaagattttaattaatactttatcgttttcaaaagtatagtcggagcttttttacaatcctgacagaatttttatcagaaatttaacttattgatcattttattcttaaaatcctgaatttcagaatcattaatttcagtttctttcttagaaaaagtctttttaaaagctttatccagaagagccagcttttcattgtacatcctgcaccatttgcagatcatcaggtgcatgctaagcatcctgttttctttggcagaaatagatcgggcattccttttttccatcagtaaagtagcttcactgcacggtaaaaataatatatgtagtattctttttatcattattccttatgattttgaaaaccagttaaactccaggcattctctgagctgcatacggcttctttgcaaaatcttccaaagattagtcgtggaaacattcaattcctgacttacttccggtgcttttttttcttcaatataatacattttcagcaggattttccatctggagggtaattcttcaatacattcctccaatattttattaaaatccgcactgtctaaaagttcatccccttcaccggatacattccagtcagtcagaacatcattatgcttccatgagccggtttcatcaaaaaaatgatcaagcctgacattgggttcggatttatattttttccggtaaaaatctgccactttcctgttcaggatcgccatcagccaggtcgatgcctgacttttcccttcgaaagaatcataagctgagtaggccgcaagaaaaacttcctgaacaacatcctgtgcatcttctttattcgaaagcacatacagcgcccgcttcaaaagcggccctgaatattgctctatccagtttttcaattcttcatcttttgtcataggaaggatttctgtattttctcagatcacaacgaaggtagtaagttaaacggatattccaaaattagattattattgattgttattgccacaaaccttataggtttacgatacatccgttaacccaacccttcaccattcaaaacatagcataaaattattacaaatcgcttaaaaatagtaaatttgcatcttatcaaaatttgatactaagaaaagcaaaagcaatactatgacatcacaagagatacgtcaaaaatttttagattattttaaaagtaaggagcacttaatcgttccttcagctcctattgtgctgaaagacgaccctacccttatgttttccaactccggaatgacgcagttcaaggattttttccttggctacaaaacccctaccgcccctagaattgccgatacacaaaagtgtctgagagtttcagggaagcacaatgatctggatgatgtaggtagagatacttaccaccacaccatgtttgaaatgttgggaaactggtctttcggggattacttcaaaaaagaggctattgcttttgcctgggaattactgactgaagtatacggaattccaaaagaaaatttatacgttaccatttttgaaggtgatgcttcagaaaatctggacagagaccaggatgcttatgatttctggaaatctcatatttcagaagatagaatcatcaacggaaataaaaaagataacttctgggaaatgggtgaaagcggaccgtgcggaccgtgttcggaaatccatatcgacctgagaactcctgaagaaaaagcagcagttccgggaatttcccttgtaaataaggatcacccgcaggttgtggaagtatggaacctggttttcatggagttcaacagaaaggcagataaatctttagaaaagcttcctgctcagcacgtagatacgggaatgggctttgagcgtctttgtatggcacttcagggaaaatcttccaactatgatacagatgttttcactccgcttattgctaaggttgaggagctttcaggtaaaaaatacacaggaatcttagaagatgaaaaagatatcgccatccgtgttgtggtagaccacatcagagcggtttcttttgctattgctgacggacagttgccctccaacggaggtgccggttatgtaatcagaagaattttaagaagagggatttcctattcttaccgattcctggatatgaaagaacctttcctttacaaacttgttgctgttctgcaggaacagatgggaccattcttccctgaaattgaaaagcagggaaaactggttgctgaggtgattaaaagtgaagaagattcattcttaaaaaccattgagaacggtttgatcagagttgaaaagctgattcagcagacgattaccagtaaccagaaagtattaccaagcgaagaagtgtttgaactgtatgatacctatggtttccctgatgatttgacaagaattattgctgaagaaaaagggttaaccattgatgaagcaggtttcaaggcagaaatggagaaacaaaaacttcgttcgaaagccgattctgctcagaaagtgtatgactgggttactttagaggaaagagaagaaaactttgtgggatatgaccagattgaatctgaaacctatattacaagatacagaaaggtagaaaataaagacggggaattttaccaggtggtactaagcagttctcctttctaccctgaaggaggtggacaggttggagataaaggtgttcttgaaaacgctgctgaaagcttccaggtactggaaactaaaaaggaaaatggtcttatcatttctttaatcaatggtcttccaaaagatgcaggtgctttattctatgctaaagtaaacgcttcagaaagaaaaaattctcaggctaatcactctgtgactcaccttttgcatgaagctttaagagatgttttaggaactcacgtggagcagaaaggttcttacgtcggtccggattatcttcgtttcgacttctctcactttaataaaatgactgaagaagaaattgctttaattgaagaaaaagtaaaccataagatcaaggaaagcattgctttacaggaattcagaagtattccgattcaggaagcactggacaaaggggcaatggcattatttggcgaaaaatatggtgacaatgtgagaatgatccagtttggaagctcaaaagaactttgcgggggaactcacgtaaaaaataccagcgaaatcggtcatttcaaaatcacttctgaaggttctgcagcagcaggaatcagaagaattgaagccatttcaggagataaatctgaagaatacttcaaaaaccttgaaaagcaaatcactgagctttcccagttattaaagtctaaagatgtagtaagatccattgaaaagctgatcgaagaaaacacttcattgaaagccgaggtagatgctcttaaaaaggaaaaagcaaaaggagaaatcggggaatggaaaaatgcttatgagcagaaaggcaacaagcagcttcttgtgaagaaaacttctctggatgcaggttctgtgaaagacatcgtattccagctgaagagagaaatcccgtcttcagtaacgattatcctttctgatgcagacggaaaaccaatgattacagttggagtttctgatgatcttgctgcagattaccaggctggcgctatcgtaaaggatcttgcaaaagaaatccagggcggcggcggaggaaatccgggctttgcaactgcgggtggtaaaaaccttgaaggtttagaaaacgcttaccaaaaagctttgaatatttaaaatagaaacctctattataaattttaactccggctgtctcaaaattgagagagccggagttgtttttaccctatctctcctattatattcttaacgcaaagttcttcgtatagaacgtcgtatggaagggagcaaagaagaaaatcaatttcattgattctgactaagcgtgagtaataattatacttccatcagataaagcaaatttcccataaacatctgtgtcatcagtgaaatccgtgggagattaaaataaaataatttaggaaaaggttacacaagcgggatatatgttttatttaacactaaggaccgcaaagaaacatttatttatcttaagtattttcgtttgctaagacgttacactcagctatgaaataattgtatttttttgctaaatgggatgcctttgcgaacgagaaaagcaggaaataaaaactttgcgtacactacgttataatatagtattcttattacgaatattttcatcaaagtctctctatttatatccgttctaattattgactttaccttaacaaatcatcacctaatcttaaactatttgttttatcttcttaaaactcagttaacaccagacctttagttttgccataatcgaaattcaaaaaatgaaattatgaaaattaacaaaactattggagctcttctctttgcttcccttgtatttcaaggttgcaatgatgacaacaacagtaactctgacacgcctgtcaatgacaaaatcaaaattgaaaatttttctaaagaacctgctttcgtttttgggatgcctggttttgaaaatttaaatataaccacacttatttccagttccgatgtgcttccgggttcaccggatttcgttttcggaggacagccggacggaatgggacttatgaaagatcctaattctgacggttacctgatgatcactaatcacgagatcaagcaatctgtatcaagagtatacttagacaaaacttttaagcctgtaaaaggagaatatatcttaaacggaaccggaggaatgacaagattgtgttctgcaacactggcaactccggaaattcatggtttcagtgcgttccttaccgcaggtgaatcaggtgaagaaagtatggtgcatgctttaaacccattggcaccggtatctcaggcagctgataaaacaagagtaaaacctgcattaggaaaggcttctatggaaaatgcagttccgcttcctaaagatgtttctaacggaaaaacttatattattattggtgaagatcagtcttattcatcttcccatcagtctgcaggacagctgatcatgtatgtagccgatacacagggagatctggataatggtaagctgtattctttaaggagaacaaacagcaactatacagaaacggatatgacgaagggaaacagctacgacgtagagtttgttgaaattcctaacgccaaaaatcttacaggagctcagatcaaccaaaaaaatattgacaataacgcgatccgtttttcaagagttgaagatgtagattacagaaaaggggctggaaaaggaagagaaatttactttactgcaacaggagaatcttctgatggtattaatccaaaggctggattaaccatgtggggaagagtgtacaagcttgttctgaattccaataatatgcttacaggaaaattagaagtagttgctgaaggagattcaaatcctggaaataatctgatcaatcctgacaacttatgtgttactgaaaactttgtttacatccaggaagacggagattcttactacaaaaatgccaaccatgactcttatatctggcagctgaatattgctaccaaacaatataagccgtggctgaatatgaagcataatagaaataacactgcatggcagactgcttacaaccagtccggagatcttcagaagttcggttcgtgggaattcggagcaatggttgatatttcagacatcatcggagttccgaatacattctctgtgaatattcactctcatacttggcagcttgataaattcaaaaatcctgacggttccggaatcaatgccaataaagaaggcggacagattgtcatcatcagaaacgtagaaaaatagtttcaaattcttcatatcaaattcaattaaagtatcaatagaaaatctctgttgatactttttcatccttatgaatagactttcaaaatacccgatactcctcttcctgtactctgcagcagcattttttaccctttcctattgtaaaaatgataagcagcagccagtatatgaagatcttggttctgtaaaaagaacgattctcaaaaccaatactgattttgaaaaacagatcaacgagctgaaaacccttgtttccaaagattccgatgaaaaacttcttcagcagaaattccaggatatcagaaaaatctataaaaaaatagaatgggcagtagaatatttccttccccactctgcaaggttcatcaatggtcccgcccttccggaaatagaaatggacgagcatacagagatagaacctgaaggacttcaggttttagaagaaatgttttatccttatgataaaagaaacaaagaggaagtgatcagaatgctcaacaagctcgttaataaaagcaacactataagcactaacttccaggtaattaccatcagtaaagaccaggtttttgatgcgttaaggcaggagactttcagaatttcaagcttagggatttcaggttttgacacccctgtttcaggaacgtttttacaggaaatgccttcttctcttcagggagttaaggaaacgcttaaacaaatttccactgaacgttcaaaagacaaagcattaaaaagtatcgaagctgaaatcaattcagccattgaggttctgaaaaaaaatacagataaaaatacgtttgactatgtcagttttatccctgaccatctgaataaaatcacggccttaatgcttgaatttaaagatcaggagaaaatcccggatgttgaagtaacaaccgctttaaacaaaaatgcagctacgttctttgctaaaaatgcttttaaccccaacgccttcactcccggaaaagaatatgcctattctgaagaaaaagcagcgctggggcatcagctttttaatgataaaattctatccaacaataataaccggagctgtgcgacatgtcatattcctgaaaaggcttttactgacggacttgccaaagcaatgtcccttgaaaattcggaactggccagaaataccccttctcttaactatgcgggatatcagcatggtcagttttgggatatgagaaaggatgatctggaaggacagagctctgatgtgatctccaataaagaagaaatgcatggtgatctgaatgttattcttgccaggatcaatcaggataaaaactaccagacagcattcaaaaatatttatcattcacaaaaaacagaggtttggcagcttcagaatgtattggcgagctatatccggtctctggcgaaattcaattctgattttgatgaatatatgagaggaaataaatcagcaatcacggatgaccaaaagcggggctttaatctttttgcaggaaaagcgcaatgtgcaatatgtcatttccttcctttattcaacggtacggttcctcctaacttcaagaaaacggaacaggaagttcttggagcagcagtaaacggagaaaacaagacttttgaccatgatccgggaagaggtaaatttcatgagacagtttcctcattacagcattcattcaaaacaccaacccttcgaaatatcagcaaaacagcgccttatatgcacaatggcggttataaaacgttaaaagaagtcatgaacttttataataaaggcggaggaaaaggttttggatttaaagtagacaaccagacactttctgaagcgcctctgcagcttacggatcaggagatcaatgatattattgaatttatgaaggctcttgatgacaaataaaacacaattctaaaacacaaaccgcgaaaaacaattaaaactctctgaatcaattgctcagggagtttttttattggtaatctcaggaaaatacagagagactatctaaatcatttttttatttggcttaatccctggaaagtccataaaaacattagattaaatcaatgttatactctgttaaaaacttttctaccacaataaatattattaattttgacctagtttttttacatgaaaaggggtttactgttaatattttttctgatctgctttttggggtattcacaaacaaaaattaaggttgtggatgacgccagtcaaaagcctgtctttaaagctaaagtatcctgtgacaatatgcttatcgggtatactaatgaacaaggtattctggaatttaaaacaggatgcaaaaacattgatattgaagcggactcttatcagaaagaaagccttactgtagagagcagcatggaagtttccctgctgaaaaaaacatccagaaccaccaatattgaagcggtggtgattgaagataaaagtgatcccagagctttggaaattctaaaaaaagtaaacaagctctggaaagaaaactctccgaaaagcttaggttcttattcttacaaatcctatgaaaaaatttcccttgatattgatgaggacagtctttcccagtttaaccagtatttcaatgatctaaacatttttaagaaaaaaagggaaaaagactcgctgaataatattaccgcaagcaaaattttttcaaaaagcaagctgtttctctgggaaagggcacaggagtttttatattccaaaaaatatggtgaaaaaatcaatattctggacaacagaatttccggtctgaagcagcctatctacgaaatgatcgcccttcagcagagcaacagggatgttgtccccgaacaggtaaagccggaaaacagagggctatacagattctttctttctgataccgttacgctggacggaagaaaaaactttgtgatccgcttccgtgaagtgaattataaaaaaccagacagaaagcgaaaatataacggtgccatctacgtggatactgaaacgtacggaatcaaaaaaattgaaaacttcagtaaaaataaaaacgagggaatcattaccagcacctgggtattttacaataacaaatggttccttgcccacgaaaaagccaagctgaaaatgggtaaaatggctatggatgacaaagtgcatgcagatgacaagaaagacaaaaaaagctttggcacctacgctttcctcacttcaaaatattttgatttcgaatctcctattgaagaagatcccaaggatttcaaaggctacactttctcggtaaaaaatattgacggacaatcactggaccgctacagaaccgaagctcttactgaaagggaacagaacacttataaaactattgacagcttaggtaaaaaatataaaatagacaataaagcacagattttgtcaggattattgaacggacagatcagagtgggttccgtagattttgcggtggatgaaattgtgaattacaactcttatgaaggattcagattaggtttaaaagccaagcttaatgagaactttgatcctcatttttcaccggattattattttgcctatggggtaaaagacagaagatggaaatacggaatgggactggacatgaaaaccacactggagaaaaactcttttttcagatttgaggtttacgatgatgtaactgcctccggagagttcaacagaaagctatggaatttcaagatgagaatgatgaacttcgggaataatttgaataacgacagatattttcattttaagggagctacattatcttatctgaatgatgtcaccaacggccttactcttgctcttgccgtaagaagaaataccgaagaagcagaattcgattatcagttcagggacagaggcacttcatacagaaacttcaataccctttttaccctgaagtattctccgaattcaaccaatattatgacgcctcagggaaaatctctgatcgatcagaagtatcctgaactgtacttcaattatgagcagagctacaaattactacagggagattttaattattcccgttttgatgccctctttgttcataatttcaaaacacctatcggaactaccggtttcagactgtatggaggagttgttctgggaggagcaccaatctggaaaaactttacaatgaacggacttgcttctccgggaaaagactttaattttaacctcacttcttaccttgggtttgccaccctggagggaggaaaatattataatgataaattcgtagcctattatttcacgcacaaactgccatggtatttaaaaagcttcggacacaatatttccagctttgattttgtcctgagaggaactatcggagatatgaaacatccggaataccaccagtttaagttcagaaagctggatcacctttatcaggaagtcggtgtggaatggagcaatttcctttccagctatttcaatcttggtgtattctacagagtgggttattatgcaacccctaatttcaaggaaaattttgccatccagtttaagctgaagtttctggaattttaataatcccgatctttacagcagaaattatacattatacattatacattatacattatacattatacattatacagaaatatcatgcagaaaatcgagatcaaagcagaacagttttttgaattattaaaattaaaagacactccgatgtgggagattttctcacagatgattgatggcaatgaaaaagaaattatttttttagataatgaagaaaagattctttttaattatattttaccttctacacaagagaagctggaagaagacaggaaagaattttcaaagcagttttcagagaaattagctaactttaattaaaagtttgtatgaataaaagttatgttttctgcctgttaagcattttcctgtttacccttggaagtgctcagacttataaaaaaccattggtttccgccatcaaagaatctgatcttcgcaccgatatgtatcagttggctgcagaccagttctggggccgtgaagcaggaactctggacgaattaaaagtttccatgtggcttgctgacaaggccaaagaagcaggaatgaaacctgccggagataacggaacatttttccagttttttgatatgtacagacatcaggttatccctcaaagcagccttaaaatcggagataccaacctgaagctatggaaagactttctggtagcagaacctgtgaatgcttctctggatgctgaaatagtgtatgccggaaatgcagaacctgaagatcttgcaaaattgaatatcaaaggaaaagttcttgcggtaaatgcttcagacaaaaatatttctaaggacatgacccttttcgtaagaagatatcccggatttgtaagaaataaatattacaataaagctgctgaactgggagcgaaagccattatttttatcaccgatgatatttccgaacaaagctgggtggaggtactgcctcaaatgacaagaggaagctacggcgtagaaggattaagagagaaaataacgaataatattcctgttttatggatcaaaagagaaaatgcaggctgggtaaaaaacagtcctaaagcttctctaaatctgatcactgaaacctacaaatatccttcagtaaatattatcgggaaaatagaaggtacggatccggtccttaaaaatgaatatgttttgctaagcggacatcaggatcatgacggcatcagacatcctgtaaagaatgataccatctataacggtgctgacgataatgcaagtacatgtgttgctatgcttgcaatggcaagagcttataaaaagcagccaggaaaaagaagcatcctgtttgttttccatggagctgaagagagaggattattaggatcgagatggcacgcagcccaccctgttgttccgaaagagaaaattgtagccgttctgaatggtgatatgatcggaagaaatgacaataatgaagcggctttattaggaggcaatgctcctcacaaaaattctgaagagctcgtgaaaatggctgaagaagccaataatgaaagtacaaaattcaaatacctgaaagattgggattctccgagtcatgctgaatatttctatttcagaagtgaccatcttccgtatgctaaaatcgggattccggcgatatttttcaccagtgtgctacacgaccagtaccacactccgcaggatgaatctgaaaatatcaattataaaaagctttataaaatgactgagtggatgtacagaacctcctggaaagttgctaatgaaacggaacggccaaaagtaattgcgaatttttcactggaaagatagttgatagggaaaaaattgaacccttaagaagaattcagattttaaggaagttaagattcaaattcatttgaatgaaccattttgcttactgaatatcaaaagatattttcttcattattcttttgtcttgaaacaaaagaatcaaaaattcaagacttagaaacttccgctaaaaatgaaatctgttctctaaaaactctaaactcgtgcagaaacagtctatattgagaatcacagattgccccgcactcaaacaatagagtttttttaacgttcacagaattcattttcttaacgcttcagtttcttatgtcatttgacattgtcaaaaaaacaaaagcttcacggattgtgaagctttttcatttcatcattgtgtttttagaatctgattgaatgcgaaataatttatatcgaaagatattttcttcattattcttaaaaacttaattatccttaatggtttaaaaattctttctaattaatatacttcttttgtcttgaaacaaaagaatcaaaaattcaagactcagaaacttccgctaaaaatgaaatctgttcactaaaaactctaaactcgtgcggaaacagtctatattgagaatcacagattgtcccgcactcaaacaatagagtttttttaacgttcacagaattcattttcttaacgcttcagtttcttatgtcatttgacattgtcaaaaaaacaaaagcttcacggattgtgaagctttttcatttcatcattgtgtttttagaatctgattgaatgcgaaataatttatatcgaaagatattttcttcattattcttaaaaacttaattatccttaatggtttaaaaattctttctaattaatatacttcttttgtcttgaaataaaagaatcaaaaattcaagactcagaaacttccgctaaaaatgaaatctgttctctaaaaactctaaactcgtgcggaaacagtctatattgagaatcacagattgtcccacactcaaacaatggagttttttaaacgttcacagaattcattttcttaacgctgcagtttcttatgtcatttggcattgtcaaaaaaaacaaaagcttcacagattgtgaagctttttcatttcatcgttgtgtttttagaatctgattgagtgcgaaataatttaatattgaatatgattttttaaataagcaggttcatcagcgcaggatcattgttcagatagttgacaaagaaatcatattccttcattttacccatcaaaggaggaaaatctctgttttttttcaacgcaattcccaccactgcaattcctttttcttttgaatttttttgggtgtattcaaaataggtaatatcatcgtccggtcccagcacatccattacaaaagtttttaatgctccggggcgctgtggaaaccttacaaggaaataatgctttaaccctgcgtgcagcaaagccttttccttgatttcttccatacgcgtgatatcattgttgcttccgctgataatacacactacatttttaccttttatctcttccttatatttgtccagtgccgctactgaaagcgctccggccggctctaccacgatagcgtctttattatataatgacaatatggtttcacagactaatccttcgtcaaccgtagccatatcatgcaggatatttttacaacgttcgaaagtaatttctcccacctgctgtacagctgcaccgtctacaaaacggctgatcttttcaagaagaacgggttttcccttttccagggcttttttcatacttgcagccgctgaaggttctaccccaataatttttgtttggggagacaaatactgaaatacagtacagactcctgctgccagtccaccgccacctatcggcacaaaaagatagtcaaccataccttccgcctgttccaggatttccaaagctgttgtagcctgtccttcaataatcgccgggtcatcaaaaggatgaataaatacgctgtcattctctttgcaaaacctcatcgcagcgtctttagattcatcgaatgtgtctccgaataaaataacatcaatgtattctccaccgaacatctttacctgttcgagcttttgtccgggtgttggcaaaggcataaaaatcgttcctttcactttcatggtatggcatgcaaaggccactccctgcgcatggtttccggcactggcacatacgactcctctggacagttcttcctgtgacatggttgccattttattgtatgccccccttattttataggatcttactctttgcaggtcttcccttttaaagctgatgtttgcctcataaatggctgacaaattattattgacagccaaaggtgtttttaccactacatcttttaatcgttcctccgctttatagacatgctctaaaacggaggaacttacttcctctttcatcatccttaagtaattaattgttttcgggtctcaggctgcgcacagtcttaccggctttccacatttcgctttctctcagctcagtaagttctgcttccagtttttcacgataatccggtttactgttgctgtcaatcgagcgttgtgcctcatttcctttagctacattgtcatacagctcttcaaacaaaggcgaagtagcatccctgaaacgcttccaccagtctaaagcacctctttgagcggttgtgctgcagttggcatacatccagtccattccgttttctgccactaaaggcattaatgactgcgtcaattcttctacggtttcgttaaaagcttccgaaggactgtgtccattttttctcaatacatcatactgagcggcaaatattccctgtacggcacccatcagtgttccacgctcgccggcaagatcactgtatacttcttttttaaagtcggtttcaaacagatacccgcttcctattgcaattcccaatgcggttactctttctctggcttttcctgtagcatcctgatatacggcaaaactgctgttcagacctctgtcctgcagaaacattcttctcaatgatgttcctgaaccttttggtgctaccagaaaaacatctacatcggctggaggaacaattcctgtacgctcattgaatgtaatcccgaaaccatgtgaaaaatacagcgcttttcctggggtaagatgctgttttacttttggccagtattcaatctgtgcggcatcactcagaagatagcagataatggtacctttttccagagcctcttcgatttcaaataatgtctctcccggtacaaatccgtccgctactgctttatcccatgatttggagctttttctctgccctacaatgacattaattccgttatctttctggttcaacgcctgtcctggtccctgtactccatatccaataactgccacgacttcgttttttaatacttcctgagctttttccaacggaaattcttctcttgttactacattctcctctactcctccaaaattcaattttgccattttttttgattttatttattactgattatgatgtttaatttctgagcttagctcgcatgttctactgccgtcaggtaaggatttctatgataatgcacttccagaacatccacctgtttttccatctgtctgctgattttctgaacagaatcttctgtttccctgatcacgatgacaaacttttttactttttccatttccgaagggcctacattaaaggtcaccatagaaattctccttcttgaaaaaatagcattgatgcggctgatcaatcctaaataatcttcggtatacgctgtaatcgtatattctttatgatctgttttcatctttttattttttaaactttattattgagtacaatctccgaaacacttttcccctggggaatcatcggaaatacattgtgttcttttcctgtcatcacttcaagaaggaaagcgccttcatgatcaagcatttcacggagggcccatttcagatcttctctttcagaaaccctgtttccctggatattgtatccttttgctacctgaacaaaatcaggactctgaatatctactgaagaatatctttcttcgtgaaacaattcctgccactgtcttaccattcccagatagcaattattaagaattaaaatttttacctccggatgatactgcataatggttcccagctcctgaatattcatctgtgctcctccatcacccatcactgcaataacaggccggccggtttccgcataggatgctcctattgcagcgggaagacagaaccccatggttcccaagcctccacttgtcacattggttctggaatgtttgaagtgagagtatcggcatgttgccatctgatgctgtcctacgtctgtcacaattatagcttcaccttgtgtcatttcattcagataacggatcacttctcccatggtaatctctccttcatcgggataaagctctgtatgaatcagattgatgctttccacttcgtggcattttttaaatctttcatgccaggcatgatgttctctttttacaatcctttccgtaagaaggggaagggtatgtttgcagttcccaagaaccgggacatcaacttttacgtttttattgatctctgctttatcaatatccagatgaataatttttgcctgttttgcgtactgatccaatcttcctgttacacggtcgtcgaaacgcattcctacagcaatcaaaacatcacattcgttggttaatatattcgggccatagtttccatgcattcctaccattcctacagcctgcggatgattggtaggtatggcactcattcctaaaacagtccatgctacaggaactcctgatttttcagcaaattctaaaaattctttttctgcttttcccagcataattccctgtcctgcaataataaatggcctttcagcctcatttattaacgatattgccttttcaatactttcaaaacatggttcgggatccggtttatagcttctcaatgaatggcatggagtatatcctttataatcaacagactgaagctgggcatttttagtcacatcaatcaatacaggaccgggacgacctgacttagcaatgtaaaatgcttttgccagtacttcgggaagctcattggcatcagtaacctgataattccatttggtaacaggacttgtaacgttcattacgtctatttcctgaaaggcatcggttccgagaagatgttcaaaaacctgtcctgtaatacagaccaaaggagtgttatccagcagcgcatctgctaatcctgttacaagattggttgctccgggaccgctggttgccagcactacccctacttctcctgatactcttgccagcccctgtgccgcatgtactgctgcctgttcatggcgtacaagaatatgtttcagtgtttccttataatcgtaaagggcatcataaataggaataatagctccacccggatatccgaaaacggtttttacaccttcctgcagaaatgcttcgagaatgatccggcttccggtaagttgtatttctgttgataaattcaggttttccatatacttttattgagtgatttcgtccgttacacagccttctgcagctgatgatactgttaatgcatatttataaagcaatcctttctgtactttaaggggaggtttttgccaccctttttttcttctttctatttcttcttctgaaactttgagctgtatggtattgtttaccgcatctatttcgatcaggtcatcattgtgtacaaaagcaatcagacctccttcatgggcttccggtgtgatgtgtcctacaacaaaaccatgggttcctccactgaatcttccatctgttattaaagcaacactgcttcccaggccggctccgatcaatgcacttgttggcttcagcatttccggcattccgggagctcctttcgggccttcgtgacggatgacaataacatcaccgtgctgcactgttccatcctgaattcctctgatcagatttttttcgccatcaaacacacgggctttccctacaaagcgctcaccttcttttcctgtgattttggcaacacttcccttttccgcaaggtttccatacaatattctcaggtgtccggtagcttttacaggttctgaaagtggctttataattttctgagtattaaaatccaatcccggaacatctgccagattttcggctactgtttttccggtaacggttagacagtctccatgcagtaatccctgttccagcaaatatttcatcaccgccggggttcctccgtgttcatgcagatcctgcatcagatattttccactcggtttcaggtctgccaataccggagtatgatcgctcatcttctggaaatcgtcctgagtaagaggcaccccaacactttttgccatggcaataaaatgcagaacagcatttgtacttcctcccaaaataacaataaggcgaagtgcattttcaaatgctttacgggtcatgatatcggaaggtttaatgtctttttccagtagtactttcaggtattttcctgcctcaagacattcttcctgtttttctttgcttaaggccggattggaagaggaatacggaagactcattcctaatgcttctatggcagaagccattgtattggcggtatacattccaccacatgctccagctccgggacaagagttcttcaccacaccgtcgaaatcttcttcagtgatttctcctgcaatctttttccccaacgcttcgaaagcagaaacaatgttaagtgcttctcctttgtaacaacctggtgcaatagttcctccatacaccatgatggagggcctgtctagccttcccattgcgattatggttccgggcatatttttgtcgcagcctggcagagcaatcagtccgtcgtaatactgtgcgccgcagatcgcttcgatgctgtctgcaatcacatcacggcttaccagggaataacgcattccgtctgttccgttgctcattccgtcacttacgccgatggtattaaaaatcaatccggctaatccatggttccatgttcccttttttactacctgagcaagatcattcagatgcatattacaggtgttcccgtcatagcccatactggcaattcccacctgggccttgtgcatatcttcttctgtaaatcctatcccgtacaacatggccttggcggcgggctgttcactgttttgcgtgaatgtttttgaatatttatttaacatatttatcctgcattttctattcttttcttctctttaaactgaatttttttactaaattttgattcaaaactacattttgtaatattcttttcattttcagtttttctaaaaattacaatattcaaccgtttatgaaatacatatatttgtctgattattaaatatttaaatcttaaaaatttacaatgacagaactcttaccaattttaaatatgcctgctgtactcttccgctcgccgtgtcttcccagtttcttgtaaaaggaatatcatcaagtgaatccaaagccacaatttctgctgcagtaccacagaaaaagccggcatctgcaccacgcatttcctctggtttaaagaaggtttcttttaccggaatatcaagctcattacaaatctccataacggtttgtcttgtgattcccggaagaatacttcctttggccggtgtatacaaaaccccatctttttcgtagaagacattggcccctgaactttcagcaacatttccgttttcatccaacaccagcgcttcatcatagcctttgtctttggcatcctggcaggctaatattgagtttacataatgtcctcctaccttcgcctcaaccttgaaagctttaggattaggacgttgaaaaggggaagtcataattttcattttatctgccagatatccattattccattcccaggcaagaagagacaggtaagatttctgtccttttgaaagcgacatattgggagagcacgttaccaatggccggatataagcgtctgtaaacccattccgttccaaaagttcataggttagatctgtaagctgatctacagaataatcgaagggaatgtgcatcagttctgctgatcttttcagtctttcataatgttcttttgctttgaaaatcctggttccgtgatctgtgttgtaagatttgattccttcaaaaaccgaatagccatagtgtaaggattgtccataaagatctgttccggcatctttcgctttcataaattttccgtcaaaatagatggtcgtgtcgtcgttgtaatacatgttatagagattaaaaaaaattaacaaacgggaataaaaaaagccctctcacagtgtgagagggctcaatatatgtacagtcatacatcttccttctcacaatcgcaagggaataataatgacgataataattactgataataactgatacatactctgtattctttaaaaattaaaacaaaaaagccgtttcaaatatgaaacggcctatatataatttaaattaaaatctgtttaaaatgccgtttccttactgttgttaatgacaacagcaataatagaaatgacaataatatttttctgattcgtaaaattcatactgcaaatgtataaactttttaataacccacaagtttttttgacactttttattttctctgtaaaaaacggttcaacgtttcctttgcctgagcgacatcatgaacccttacaatttttgcgccctgctccagcactttcatatgaagtttctgggtttcttcattaatgtccaaaggggatttaccaagaggcttataaataaatgactttctggaaatgcctatcaacaaaggaaatctcccaaatcccagatattcaacttcgtcaatcattttcatctgatcttctactgtttttccgaaaccaaaaccgggatcaagaatgatatcgttcactcctttttctaaaagttcttttgttttttgagaaaaataccggttaacttccagcgtaatatcttcaaatctgattttatcatgcatggtttcataagacggatttacatgcatcaggatataaggaagttttgtctgagctgcggtatcaaacatttctgcatcatactgtccgcctgaaatatcattgatcagatcaatcccttcattgaatccgaatttcactgtttccgcataaaaagtatccagtgagattagaacttccggaaactcttttttaatcagagagatcatatttccgatcctgttgatctcttctccggcgcttaaaaattctgcgttgggacgtgtggactgcggcccgatatccagtatttcagctccttctttcaatagtttttcagcatgttccaacgctgatttttcattattgaattttccaccgtcagaaaaagaatccggtgtaagattgaggattcccatgatctttggagtgtccagctgtactaatcggccgttacagttgagtgagtaggttggtgagttggagggttggagggttggagagttggaaagcatggatcgtaagatttataattgattgatgatgattgatgaatgattttgtactgcaaaattagtgatttatagtttttaagagatgaattggggctggaagttggaagatggaagctggaagttaggccaaacacttccaccttaccctcaaatactcccactcttaaccacgtatcccgtatcccgtatcccgaaactctcaaaccctcacactcacaaactcagcttatcaaattcaaaaatctgaaaccgaattcgtatatttggaagattaagaaaatttatgctaaaaacatcagtacagttcgggaaagttatcagtcagtgccgtgatcttttcggtaaaaaattacaggattacggagcagcatggagagtgttaagaccaagctccattacagatcagatttatataaaagttaacaggatccgtacgctgcagatgactgataaaaaaatggtagatgagagtgaggaggatgaatttatcgcaattgtcaactattctattattggactcattcagcttgagaagggtctttccaatgattttaatgaaaacaaggaagaaattttaggtttgtatgacaaatatgccaatgaagcaatggctttaatggaaagaaaaaatcatgattacggtgaggcctggagagatatgagaatttcttctattacagatcttatttaccagaaagtattaagaaccaagcagattgaagataaccagggacagaccatcgtttcggaagggcttgatgccaactatttcgatatgttgaattatgcggtcttctgcctgatcaagttttcagaaaaagaaaatcaattcgaacccaaaaatatttaatatgatcaaaggtatattacgctttattattgctgttatttttatcctgtcaggctttgtgaaagctgtggatctgctaggtttttccttcaaaatggaagaatattttgctcctccggttttcaatatgccatttttagaaaggtttgccctgctgttttccattatagtggtggttatggaacttttcctaggatttatgctcctgcttaaattaaagcttaaatttaccttatctgtattaattgccctttgtattttctttggtttccttacgttctattcggcttattttaatgtcgttacagattgtggatgtttcggcgacgccatcaaatttacgccgtggcaaagcttccttaaggatgttgttcttcttgtaggattgatcattttattcatcttatacagaaaagaattccgtaaaaaagatgcctatggagttacctcaaaagagtcttcaaatacagtaaaatatgttctgttagcaatattttctctgggtatgatctatgttatggcacaaggacttatgcatgagcctatcattgattttcgtgattataaaatcggaacagacatcaaagccgaaaaaattaaaattgacaagaatccttctgaatataagactttctattctctaaaaaatgagaaaacaggacaggttgtaaaagtaaatcaggatgattatatcaaaaaaacagaatattgggctgaaggttctccatggaaaattgaagatggaaaaaatgaatctgtactgatcaaggaaggttacaagtctgaaattgtgaaattcaagattgaagatcctacaggagtggatgtcaccaatgaaattattaatgctccaaaggccgttctggttttctcttatcatccaaaggatgttcctgctgacctgcttcagaaagtagaagcaaaagtaaatgcccagaaaggagctcttatttatggagtttctactgaacctaacactttcaaaaccattaaaaatacactgatggacggaattgccatcaaaacaatagcgagaagcaatccttttgtactgatccttgaaaacggaaaaattgtagataaacagcctgcaaaggactacgttaactaattataaatgatgaatgatgaatgataaatgatctttttgacgaggctaatcgtgaatcaattatcaattatcaattatcaattatcaattatcaattatcaaatttaaacactaaacttaaacatataaaagcacatgcaaaaatcaaataaatcaatcgccggttatcacttattaatgatcctttcttctgttgacggagagtttgctcctgaggaaggaatgctggtacaacaatatctggcggatgaattcccgttcagaatgaatcttgacaacgaactggaaacgctggctcttttacaaccggaagaatggaaagaccattttgaatttcatgcaagatgttttcatgaagattctacagaagacgaacgtaagaaatttgtccagtttgccaaatcgcttatcaaagctgataataaggtaactgaagaggaacatacattctatgttttgctgaaaaacctttggggattgtagcctaaacgaaaaataaataaatcaatcaatatataaatcttatgagaagaaaaatagttgcaggcaactggaaaatgaacaaaaatgtaattgatgcacaacaattaatgattcagttactaagctataaaaataataacgctaccaactgtgaagtttggatcgctcccccttcattatacctgatgatggcgaaagacatttttgaaaaggatgaaatcggtgtattttctcaggatatgagcgagcatgaaagtggtgcttacaccggtgaaatttctgcagatatgctggaatccatagatgctacaggttctttgatcggacattctgaaagaagacaataccacggggaaactgattctcactgtaacagaaagatcaaactggctcttgataaaggtcttattcctgtttactgcaatggagaaactcttgagcagagaaaggcaggacagcaccttgaagttgtaaagaatcaaactgaagtagcgcttttcaccctttctgctgaagaaattaaaaaagtggtgattgcttatgaaccggtttgggctatcggaactggagaaacagcaagcccggagcaggctcaggaaatccatgctcacatcagaaacattattgctgcaaaatacggacaggaagttgctgatgaggtttcaattctttatggaggttctgtaaaaccagacaatgcaaaagaaattttctctcagccggatatcgatggaggtctgattggaggagctgctttgaagctggaagacttctctaaaattattgaagcttttaactagaattcattgatctaaaataaaaacggcggaatcttcgattccgccgttttctttaaaaaaatctaattattgaatatcgactacatacatagttcctttgtctactttacctgttttaggtaaaattttggctttggggtttccgtttccatcatccaccactccgaagtcatcatcattgaaaacagccagtttattgtttcctaagtaaacaattccctcaaatttatcgtgctcatagcccagttttgctacaagatccaccgccaatgttttggtaactgtttttattccggcattcgtaatttcatcccatgaacactgttccaaagcttttccattcactttcattccgtccacggcgttaatatctggtccgtttacatccgttgcattgctcagattgattctgtaaacttttttgattcctccctgagatccgaaatttccgtctctttcaatgactaagaattcactgttgcttattgctgtaatatcacacactgaatcagaagctcctccttcctgtttatataaaaactgtttagtctgccctgtaaccgtatcaaatgtgacaattctcgttaaagttttattggttgccaatgctttgctgggcacatacatcatagactgtatggttcccaccaatgttctgccgtccggagtcatacaaagtccttccattccacggttggctcttctttttgccaaaacagccggtaattttcttggccctgtgtctacaccaaccggacttatcctttccatttccattccatcagcactgtaatgtacaatgtgcggaccgtactcatcagaaacccagaatgtaccatcagctactgctacaatactttcactgtcaagaccgtacttatcagtacctaaaacatttcctgaagcatcatatgcagtctctcctgtacttcccattcctgcagggtttggaagtccggtaataggctgtccgaaaggatttttaagcttgatatatttgattacctcaatattcccgtctgcattgattttaaaatgcataatggttggggtaaagttaggggccaggaattttttcccgtcctggaaatcagtattgggacctctgtctgtaatgacataaaattcaccttttcttgtaggatgagcggctgctccggagccaaatccaccattgataacatctactccgttgatcgtagccagctttgtaaatggaaattcctgaggtagtttggaataattaatatcctgattaattatggttgtatcatcgtcacttttacatgaagccaatacggtcagcattacagcagaccatagtaattttttcatattcacttttatggcagcgaaaatagagattgattataaactgatcttgaatgtaatgataattgtattttaacaatgttgagtgattgtcccatttaaaaccaccccgtcaaaaattttttaggttttgccaatctgcaggatgggaattcttacatcttcaactgcagattgctacggaatgacacaattgaaataatggtttatccattcagtttgtcattttgtaggactctaaacttaaaacttaatccaacgaagaagccgcaccagattggtgcggcttcttatgattttaaaaatcaattattttttctctgtagatctttgtaaaacctcatctaccattccgtagccttttgcttcttcagaagtcatccagtaatctctgtcagaagatttttctacccattcataggtttgtcctgaatgatgagcgatgatctcataaagctcctgcttcaatttcaacatctctcttaagttgatctccatgtcagaagcaactccctgggcacctcctgaaggctggtgaatcattactcttgagtgcttaagtgcagaacgttttcctttttctccggcaaccagtaatacagctcccattgaagcagccatacctgtacagattgtcgctacatccggcttaatgatctgcattgtgtcataaatacctaaaccggcataaacgctaccaccgggagagttgatatagatctgaatatcttttgatgggtcagcactttccaggaataaaagctgagctgtaacgatgttggctacctgatcatcaatacctgttcccaggaagataattctgtccatcatcagacgggaaaaaacgtccatctgtgcaacgtttaatcttctttcttccatgatgtacggagtaagattcgttggtccatacattcccatatactgatcggttaccaaaccgctgtttcctaaatgttttacagagaagtctctgaattcctttttaatgtccatatttctattatgtattattttttaaatattctcaaagtttaaattacaatatttattcctaaaattttataggactttttgtcacagacttccaaaaaaatctgactttaaactatctctttctatcaacataaattcctttgataggtgaatattctatgatgttactcaaccggatagaagcctgtttcagcaaagtgatctttttgatcagctcgtaatacttgatttcatccgtattgctgtactgatcaagttctttagctgtttccttgatcaaatagtcaatatatctgtatttatgcaataaaatatcgcctttgatctgatctgccactttatctccgtaattgggaggataaatatttctggaagcccagttttcaagctcgtccagcggaatcagagcatctacaactttcgtggtaatctcttcatccataaaagatacaaaaaagttcccacttctcagctcatctttttggattccttccctcacctggttgataatgatctcattttctttaactaaaaatgtatattgttcttcttcgaaatggtgaagaatttcttcaataacggtaatctggtattcctcattctgctcatttcttcttttcaggataatatctccgaacatcaacatgtggtccaccaatttattctccatgaataagacatcatacagaaaagggtcttctttttcctgatccaaaggaacaatctccatctttggagctgctttctccttctgctgttgctgaacatgatgggtctgattctgcgtgatctgcttctggacatccagttcattgaaaagactctgttccgaaagtccgaatttattggaaacctccttaagataaacttctcttttcagggcattctgtacaaaggaaactgattttacaatatcccttatcgcttcagcctttttgataggatcgtttcctatatcttttaacagaatttccgctttaaagtcgatgaaatccatcgcttcgttttcgatatacttttcgacatattcctgcggatgttttctggcaaatgaatccgggtcatctccatcagggaaaagcaatacacggatattcattccttctgtcagaagcatatcaatacttcggaaactggctttaatacctgcattatctccgtcaaaaagaattgttacgttttccgttagtctcttaatgagtttaatctgctcagtagttaaggatgttccggaacttgccacaacgttttcaattcccgacatatgaagcgaaatcacatccatatatccttccaccaaaagacaggcattcttccttgaaatggcctgtttactctggtttaatccataaaggacatttgatttatggtagatctccgtttccggtgaattgagatacttcgctgttttgacattatttttaaggattcttgctccaaatcctaatactctaccggaaaaactgtgaatcgggaaaatgaccctttccctgaaacggtctacccctgcaggcgtattttccggaaaaatagaaagtccggatttttcaagaatttctttagtgtatcccttttccagcgcatatgccgtaaaagcattctttttctcaggagaatatccaagctggaattttttaatgatgtcatcccgaagttctctttctttaaagtaagaaagtccaatgctcctgccttcctgatcatcccaaaggatttcctgaaaatacgtattggcaacttcatggattttatacagcaaatctttttctgtctgggcattttttgcttcctcagaaatgtcacgctggtcttcttcaatttcaattccgtatttttttgcagcgtggcgaagtgcttcaggatacgtaaagttctcaatttccatcaggaaagagatggccgttcctccttttcctgtagagaagtctttccagatctgcttgctggcagaaactacaaaacttggtgttttttcatcatgaaacggactgagtcctttgtaattagaccctgcccttttcaactgcacatactcacccacaatctcttcaacgcggatggtggagaatatcttatcaatggtctgcttggaaatcatagtgtaaaagtaagatatttcttttcctttaacaaaaaagaaattctacatttttagtttatgatatttcacaatacctcaaaactcctgtgacattcttcaataaaaaaggccgggaatttcccggcctaaaaacacataatacaaaaattaatcctttatgaattttatgctttgttttgtatttttataatcaattataaccacatagtttccttttgcgaggtctttagtatatctgcctaattctatatttttttcactttttgcctctaccgtatattcgttcatcaattttgatgcatagttgtagatcttaacagaaatatttcctgtcagctcagttttgcttataagctttgaattttctacaacaggatttgtgtcaagggcaaatacctgatctttcttaacagattcaacagcattatcaagattattttcctcggttgatacaacaaaaccactcaataatgttctttttgtattagttcctatccgggcatttaacctgatggaataaactcctgcctcttcattgctgacatctgccaaaaatctgttatcctgaaggttgaattttgcatttacagatttttcctttcctctctctcctttcaagcctgatattcgataaaccgaacttttgataaccactttatcaagatcatctgaagtaagtttaggaaaagatacttccagataggtttttccgttttctttaataactttatactccatcggattatctattccgtcttttactaccgcaataaactcagagttgctgctaagcttaacttgtctgttttccaaggtataattggatgacaacaggtgattttctgtattcctgttatcttttgtttctggcctgatctggttaaaaacctttccagtcattgggtctgtaatatctactgaggcatctgaattttttgtaataatttcaaactgaatatttctggcattcttgcttagctgtaagttctcaggttcttcgcttgaaattaactgataattgctgacagctttaaattctttactttcattttgcagtgatctaccggaaactcccgtattaaccaccagcccgtctaacaccggtttaatagcttcatcccagacatataccccttccatgatatctatatgattgatatatcctctgagatcagtatccgtcattaactgttttgctcctggtcttgtagaactgtaaaatggagttaccccatcattcttaccacctcctaaggcagcaattgcagttccagccggtataattgctggagaaagcagccctgtcaacctggtatatccccaggctcccaaactataaaatttttgaggctggttaagaggatgattgtccatataaggtctgaaataggtttcacagtaataggtagtggataattgtgatcctgttcctaatcctaatgcccctgttatccattccaatcccgggtagttagcaaaatctgccagctgagttccccagtgaggagtccctaaagtaatcactttatctattttatttactttattatattccagcattgcaacatctgaagcttttcctccattactatgagcaataatggtcattgtattcgcattcaaatgattccctacctaatcaatagcacgagataaaatctcaccattttcccaatctccttttaatcggctggtagccacaaaagcagttttatacccttcctgatatgctcttttatacattgagtttccaataagtaaagatgctgtagacattacaaaaccgtgggtaaaaagtatagtcttcccattgtagttaggaggtacacttccatataaaatgttattctctccaagactgttaagataattcagagataataaatgaggtttcggcaaagtagcatacggaagatgttgcgtaaaaaacttacccgaaataataagtaaacataaaaacagaaattttttcataacctaagtgtttaaattgttatcagtcttaaaattaatacactcaactgtgagaatcactaatatttcacaaaaattatcatgcaacacatacaaaaaccatctaacaatcaagcacttaaattaaataaaattcgtataaattaatacgttaacaaaaattaacagaaaatacctggcgattaaaaaagaaaataaaataagaataagcactttatgaattttatacttttctgtctcatctcaatcaattaatattgtaatgcatttataagttctgattcctgatatagtaaacttatcatcagaaaataaagctgctttttgttaccggctacagataaaaataataatttagaagtaaatttgttccatgaaagtaaactcttataatgaatgggaacagatcgttgaacagatcatccctcaattaaaacataacattctccttttaaaagggaacctgggtgcaggcaaaacgacgtttacccagtttcttctaaaaaaactggaaagtaccgatgaagtgaactctcctacctactccattgttaacgaatataatacccccaaaggaaaggtttatcattttgatctgtaccgtctgaaaaacataaaagaagtatatgatatcggtattgaagaatacctggacaattcttttttatgcattatcgaatggccggaagtctatgaggaagagctttacgggctcaactaccacacaatgagcattgtgaacacgggtgaaaacagagaaatttcattcgattaaatattatgtatctttgctcattaattgagtgtaaaataacaatctgtaagacataatttaatttaaggatgagtacaaatatttttactcctttcacagaagaagaattaatgccgaaagaggaaaaattggaggttataaaaaaaggaaaacagttcagtattgggattcctaaagaaacctgtctcaacgaaaggagaacctgcattactcccgacgccgtacaggtgctggtagagcatggccatgaaatcattatagaatcaggggccggacaaggttcattttttacagatttacaatactctgaatctggagcaaagatcaccaatgatcctaaagaagctttcgggcaggatcttattctgaaggtaaatcctcctacagaggaagaaattgaatacatgaaacccaatacctatctggtttcagcacttcagatcaatctcagagataaggagtatttcttaaagcttgcagagaaaaaaataaatgctattgctttcgaatttattgttgatgaatacaaacagctggctttagtaagattagtaggtgaaattgcaggaactgtttctattttatatgcatccgaattattagccttatccaatggtttaatgcttggaggaattacaggagtaagaccggcagaagtagtagttctcggagctggaattgtaggtgaatttgcgacaaaagcagccattggtttaggagccagcgtaaaagtttttgataattctttatcaaaactgagaagacttcacactattgttgacagccgtgtaccgacttccattattgaccctaaagaactcagcaaaagtttaagacgtgctgatgtagtgatcggagcactcccaagactgaatatgacgcctatcgttactgaagatatggtcatgaaaatgaaaaaaggcagtgtgatcatcgatatcaccatagataacggtaaagtgattgaaacttcagaacttaccaccatggaagatccttacgtcatcaaacacggtgtcatccactgcggacttccgaaccttacctcaagaatgccgagaaccaccaccaaggcgatctcgaacttcttcctttcctatattttaaattatgacgaagagggcggctttgaaaacatgctgatccgcaaaaacgaaatgaagcagagcttatatatgtacaagggaagacataccaagaagatcatctgcgaccgtttcggacttacataccacgatatcaatcttttaattttctaatgaagaaactgaaattttatgcaataggcttcgtaccggggcttctgattgtattttttattttgaacaagaagggagcaagctgcagcggctacttacccaacagccgtgttattgcagaaacactttccaaggaattcaaatattctgatgaggctaaaaatgccatgaaaacctacaagattgatgaaaaatttgtaaaagacagtatcattaccaacggaaaagtggattttgaccgcagccatgctcagaaaaaaccatgtcctgactatcttttaacctatcctgaaaaaaatccgtcttacgagatcacttttgaaaaatgtgaagaaagtgtgacagtaaacggtctgaagaaactcaaatagttttttataatcctacattatggaaggcaattactacatgattcatgattatctgatattcatcggagtttttgccattttcctgtttctgacaacaagtatttacctcttcagccaaaaccacaaactgaaacagaaaaataccaaactatcagaaaccaacaaacttattgaacaacgtctgaatgaagtccgtctggaacacataggtactaagctgaacccgcatttgtttaaaaacattctcaattcagttcagtcacatgcctatcagacgtatatgtcactggataagctggccaatgtgctggattatattttatacgaaagcaacaataagtttgtcagtcctaaagaagagctcaattttgctttaagccttattgaaattaataaaatcaagatcaatcccctcttcgacttcagaatcaaatccaggatcaacaagacggattccgtatatgaagaaaaagtatttgccccgttgatttctgtagaccttattgaaaatgctttcaaacatacagattttctcgcccaggactctttcatttctatttacatggagcttgaaaacggaattttcaccatgaaagtaagcaataaagcttctttaaaaaatattctggaaaaagaaaaaagcggttttggaagccagtcttttgatcaaaggcttaagatgatctacagtacgtattaccagcttgaaagaagctcaagaaacggagtttttacagcagagttaaaaatcaatttaggagaattttatgataaaatgcgttattctggatgacgaattactggcgatcagttatttaaaacttctatgcgagcagatcgaaaatgtagaagtggtaaaagcattcaatgatcctaaagtttttctgaatgaaatagacagcatcgactgcaatctgtgtattctggatattgaaatgcccggaatgacaggtcttcaggtagctgagattatttcaggctcaaaaaaaatcatctttacaaccgcctataaagaatatgcggcagaagctttcgacctgaatgtggtggattacgtaagaaaacctattaaaaaagagcggttgatccaggcatttgagaaagcaaaggaacttgtggaagacagtcctaaaaagccatttatcgaatggaataccaacatcggaaaaaccgttatattcacagaacagatttcttatataaaaacctccgaaattgacagcagggataaagatattatactcagcgacggaactaccatcgttttaaaaaaccttaatttcaaaaatcttctggaaatgctgccgtccaaagattttgcacaggtcaataaaaaagaaatcattgccctgtcttctattaaagtattttcaaccaacgaaattattacaaccattccttcggaagaccatacttttctgaaactccagatcggagatgcctacaaaaattctctgatggagcgatttgggaaataatctttcttcagatattttctgtttcattacagaatatacccgctttattacagcgcatcttttcaatatacaatccattttacttttgcagagaattaaatgattttataatgaaaaactttttctatgctgcaggaattctcatatccggtttctgtttttcccagaaaacttcttcaaaagttaaggcttcattttttgacggaatagcaacagccggatatgtagatcatggtgcgtttatcaactttacaggtccgaatctgaacgttacttacaaaaatgccaaatttatactgggaatgcttccttcgctaaggattaaagaagacagatcctcaggaaccaaaaacagtcccattatgcctactctgggagctggtctgacaatggtttataaaaagattgccgttcagattcctgcttactataattcaaaaacggccgatcagaatggcagctggaaaataggaattggacttggttactctttcagatagattttattacattttttagaacattcattacatttaaaaaaaaagagtatttaacataactatattcttatgaactttgcatcaaaattcgaatcatgaatttggggaaatacaaaaatttaattttctacattacaaccatcgcagtcttttccggactgatgtattacttcattatcgaaggacaaacgctggaggtaaaagaaaatatcgttgccagcaccagcagtggctctacctgggaaaatttcctggaatcatttaaaaccaatcttcaccatccgcttgccttattgctggcacaaattgtcacgattattatgacggcaagacttttcggatggatttgtatgaaaataaagcagcctacggtaatcggagaaatgattgcagggatagtactgggaccgtcgcttgtcggaatgtactttcctgaattttcagcatttcttttccctaaagagtctttaggcaacctgcagtttctgagccagataggtcttatccttttcatgtacattgtaggaatggagctggatctgagcgtattaagaaaaaaagctcatgatgccgtggtcatcagccatgccagtatcattatcccatttgcactgggaataggactttcttattttgtgtaccaggaatttgccccggacggtattcaatttacttcttttgctttattcatagccatttctatgagtattactgcatttcctgttctggcaaggattgtacaggaaagaaaccttcagaaaaccaaactgggaaccattgtgattacctgtgctgccgcagatgacattacggcatggtgtattcttgctgccgtaattgcaattgtaaaagcaggctctttcaccagctctatttatgtgattatcatggccattgcctatgtatttctgatgattaaaattgtaaggcctttcctgaaaagggttggagaccttcaggtaggaaaaaatacaatcagcaaacccatggtggcaattttcttcctgacgctgatcttatccgcatatgctactgaagtaatcggtattcacgctttattcggtgcttttatggcgggagctattatgccggaaaatgcaaagttccgaaccctttttatcgataaagtagaagatgtggccttagtacttctgctgccgctattctttgtatttacgggacttcgtacacaaatcggccttcttaatgacagccatctgtggatgactgcagggtttattattctgactgctgttctaggaaaatttgcaggaagtgcccttacagcaaagtttgtaggcataagctggaaagaaagcttaacgatcggagccctcatgaatacaagaggtcttatggagcttattgtccttaacattgggtatgatcttggtgttttaagtcctgaaatatttgcaatgctcgtgatcatggccctttttacaactttcatgacgggaccagctctagacttcattaatttcatttttaaatctaaaaaaaatcaggacgagcctattcaggataatgattccaagtaccgtgtccttctctcatttgacaagccggaatcaggaagtacccttttaaagctggcccacaactttacccataaaatgaatggcaataaaagcattacagccatgaacattgcaccggtagatgagatgcatgcctatgatagtaacgaatatgaaaattcacagtttcagaatgtaattgaaacctctcaggatcttaatctggaagttactaccctattcaaagcctctactgatattgaaagtgatcttaccagcattaccaataaagggcactatgatctgcttctgatcatgcttggcaaatctatgtatgaaggcagtttattaggaagattattaggctttacaaccaagattattaatcctgaaaaactgctgaacacagtaaaaggtaaaggtaatatattcaacaattctccttttgacgattttacccttcagattctcgacaaaaccaatattcctgtgggagttctggtggaaaaggattttaacgcagcagataaagtatttgttccgatttttaatctgagtgatttctaccttcttgaatatgctaaaaggctgatcaataacaataattcccagattatcattctggatgctgcaggacagatcagaaataatattgaggtaaaagaacttatcagaagtattgaacaggtggctcccaatcatattacgctgtataacgaaaaaaaaattgagaaagaattcctgaagtctcaggacctgatgctgatcagcagtaaaagctggaaaaacctgatcgataccaaaagtctttggctttctgatatcccgtccacattaataatttcaaacccttagaccaaaataacacaccgatatttctatttctaccggaagctgtaaatattattcgttgtctgtaaagaaaaaacgggtatatttatagcttcaattttttggacatgctgattaacagtgaaaatggagttataaagctgaaaacctttagtaccggactttataaaggaatgagtcttgatcagctgaaacagtctgatttttatagagaaaagtatgatgatgtgtgggatgtcaaaaccggatatttctggtattattttaagcctatagaaatacagggatatcagatatctttcagtctgtgcttttttgaaaatcagctggacattgttcacatgaacacatgggaaaatggtgatgccaaagattggagcgaatggacggaggaaaaagaaatgaatgtctttcacaggaacaacacttttcttacaaaggttctgaatagatctccaacccaaaaaaagaaaaaaccttacccaagctgcaccttcaagttttcctggggaaatgtttggtcggtgtacgacccaagaagcgccgccagcctgatgggaatctattataatgaagaggaaaaacaaataaaataacttataaccaaagattaagattgtaatatgtgccgatatgccatgatggtttacaaaggtcattatgcctgtttcaactgccggaaaacattcaaacgccgccaccttaaagatgtggaccgggatgctcaggtttcagtggaagccaaatgtcccgaatgcggaaatctgatggcgaatatgggactcgacttcaaatcaccacctaaaaatgatgataagcaatgggcccatatccaggatttgtataccgtcggaattacttttcattcgtgtggatgctccggccccggttatataccgcaggaccggaaagcaattattgaatatctggaaaagatccgatcagaatatatgaaatcactggtattctggagatatcgtattgaacctgaaacaaaaaaagaaagggaactggattatcagaagaacagctcacatctatgggccgtcaaccgtaatgctttcaaagaaacggtgaccaatcaggaaggaatcaactattggcttaaaagaatcaatgaagttgaggaaagactgaatattattaaagctgatcaaaagaaataactagtattactctgttattttcagaagtttataaattcgctgaaaaacaaagccactgttcattcaacttcccgatattccatatttagatttcttcagaatgacaccattggaatgtttgtcatatccatacaatttgtcattccgcacgaatccatcctgaattacattaaaaatacattagaagctcataattctgacaaaaaccttaacggaagtgtaacattccctaccattggaggagcgtcaaaaattctttgaatttttgacggggtggttatctatatggtatcaatctcatgtcgtaattctacgacaatttttaaaatttaaccccaaaaattaatttcaaatacagttttttaatagctttataggataattcactttggatggaaattgatttcttacaatatcaggtacggaatggagacacgctgacttctatcgcttcccggctgggcatgaccggtgaagaactgaagctgtttcataatgatcattgcgaaaaaatggacaggatctggtttgaaaaccttaataaagtgaaaacgatttttgttcctgtacattacaaaacagaagtacagaaagagcaggaaagaaaaagtactcttccgtcacaactctctccttccttttttgccacaacatacactgttaacgaaagttttgaaagcccttttgaagatccggttaacatcggttacaccattgatcttcatctccgtaaagaccaaaacaaagaacaatatattgcaagctacatccagaaagattttacatctgatggaaacaagcctgatgataaagtaagcagtctttccattgcctgcatgaaaagtattatgccccttgagtttattattaataaacatggcaaaatcacggggcttgcagatcataaaaaaatcactgacacttttatccatcagcgtaaagatcttgaagagttctatataggagaagtttctcaaaattacatgaatgcttttgaaaaaaatattaaagacgaatcatttttattactgcagcttcagagtacgcttctgtttcagacgctgtttccaaagacagactggtttcagaagaaaacaaagtggaaagaaccgttttattttttacagaattcttttccggtacaatgtgaaatcaatatagaacaggaaaatggaggtgaaaacactgttttaacgattttgaatggcaaaatcagtgaattatgtacatcacaggagatcctgcgtggaatcaggcttaatgaaaagacatcagaacctgcatcaggtaatattatattagaatacaccacccacaaaaaaaataaaaatcttcttcaggcgaaagcttcggtttcattgagccatgaaggattatcaatacaccaacaccatatcaacataacacaaggataatatgaaaaattatgtcatacaaaaaggcgatacgttcagttcgctcgcccggcagtttaaggtgaaagatgaaggaattttaaaaacgtaccacaaccttcactgtccgccggaagatgttatgcaggaacctgttcccggaaaaaagattttaattccggaagacccacaacttatggctgaagaaacagaacctcataatccctcttcatcctctggagaagaatctacagaagataccggtaccggggaagaaaacccgacaggagatcagcctcagaataaagaacaaacgtcagaaaaagctgatcaatcgaataaagaagaaaaaaaggaagataatagtgaagacaatagttctacccctcatgaaggaaaatatttcgttgtgcagaaaggaacggtacaatgtaatcagggattcaaatttccaaaatttaaggtaacaagccatcagaagcattactggaacgatgaagaaggaaacgctgattatctggctgtcacagaagatgatttacagctcgatcctgcagcacaaccattcggacaatgtaagcttaaaccgacttcaggaggctatcttccctgcgcttacgctcctgccggaaaatggcagaaaacctatgaaaaggtaaaagtgatgggaaaaagctgtcttacggaaatttcagaactgatgtgcagcacgggagggaaaataaccattctcaagcacggacagcaaagtgaagcaggcaaaagcaatgttgccaaagcaaatacgcaggaacagcaggtttataatcctgttgtagattttgatgaattcaaggaagatacaaaaggaacagacgaactttattacagctaagccatgacaggaactattatcggaaatcagaatcctttggcaggaacaacatattcctacgaagtaaaaccttccctcctctcattcggactgaaaggtgaatatgaatggtatctttacaagaaacagaaaaacggaacctggaaagacatcaccggaaagcctaaaaccggtgaaaaggtaacttaccgatttggagaaatagccgtaggaatagagtttcaaatgaaagtctatgagattaaaaaagctattttaccaggacttcctgccagcaaggaactggctggcacccttatcttgattccaacaagcaataaagtgtcaaaaatagataaagtagttcttttcaaccggggagcagctaacgtcaataaagccagttatcgtgatactcttattgcgcaggcacattgtactggcatgtttaataaagagatcgaattccatctctgggaagatgatgcgccgggaaaaggccatgatcctgtcattaataaaaacaaccgtcatacccgcagctacaaagctctggtgaatgcaaagggtattgcagaagtacaaatccccctgatgtctgatgaaaaaatccttcgccagatggccaatcagtttatgatgaaaggtgacaaaaatgaaggagccaatcatgagtattatgttacggcaagctattcaggtcaaattcaaggagcaagtcaggtgaacgtagatgtagctaatccggattataaagggcaaccacaaaatcaaccgaagccacagcctaaacctcagccccagaaaaatacaccaaagttccctgccggatccggaaacgctcccaaacagtctgatcctaaaggcaatattatagaagctgttttcattgatgataaaggaaatgaactttccaaagttgctgtaggggataaagtaagggtcaggattcattccaaaaatatggtgggaaaacacattcagtatgtaatttgggaatatgataccacgtccaatgatgaagtttacagaagcggaaacattaaaattcctgccgatgtatgtgatacttcagggtttgtcattacaaaagatatttttgaaaaaggaatagactcccctatcggcgatccagactcggataaacaaaactattttatcgaaattatttccaaggatctttctgcggaatctcagaaatttggggtaaatccggagggtctgatgcaggtggagaagttgaagagtgcggcggcggtgcagaagcagaaacaaaaccaaaaaggagaaaaatgtttttgtaatagagattttgaagaaaaggatgtgagacagcttgttaaattattaaaaggcactgaaacaatttgggagggacaagcattaaaagggggaagaagagctccatgtaatatcagtgacaagtcttttgcaacccttacaaaagcattaaactctgcattcaaaaagtataatatcaatacctgtattcaaaagattcatttcctcgcccaagcttgtgaagagaccggtacctttgccctatctgaagaaacaaaaagtgattttttatcaagtcagagtatttataaaggccgcggattactacaactgacaggtgtaagaactgatgagaaagatttaactactttatttaataaaccaggaccttacaaagattatgctgattataaaaatgatcaaaatatcgtgaaaaatccgagcattgttgctaataatgtagattattgtattgatagtggagcttggatttggagcgttaataaaaagatgcccaaagctccttctcctgctgtagatcgttggggcatagaaacatcagaaaaatcacttaatcaattagctttatttggtgacaaatatttggaattgatatctgttcttttaaatggaagaaatgaaaagacaaaaatgcctaacggatgggaaaaaagaaagaccaactataatatcttgaaaactggtttttttatgtatgacaggtttcacaatgataatagcaaacctgccaacgcaaaggatattgttacttatcatatttatgctgacggaacaattgaacgccatattcctaaaaaaattaaatctggatatgaaaaaaagtacaagtatgtatatcatgataaagataaaaaagagcatgaaatctgtatagttgactggattgaaatagataaagttgaacgtcaaaaacctaatcctacatctgttccaaaaggatatatctctcacaattcctttaatatttctggggtcaaccaaaaagatgtttacaaatatagtgatggttccatcgttgcctctggtaaagcaggagaaggaagtggaactattttaagaaaatatgttaaatcaggaggaaaaacaattattgtaaaaataccagatccgttgaattataattctggtaattctaaaattaatcttgtctttaaagatacaattagaaagtatatgggacgagatcattttgcctgtttgattggagcattagctgaaacaggcttttctaaagtaacatcaggaggagccgcgatgcaagatggaacttgttttccaagtgtctcgcatacaaatggtagtagtatagatgtagcatattttacacatgcaaatacacaaaaatttattaattcaatgattaaatttggatttaattattttttagcagggacaggaatgaatttttcaaaacctaaaggcttcaatggaactcttgaaggaggtcattctgatcataatggccatttacacgcaggtgcccctaaatcattaagtataagtataaaagaaataaaagaataaactttaaaatgagaaacgtagtatttttattaatatgtataatcttaggaaatatttcatgcaaaaaaaatagttttgagcataattttgaaaaacactccaaagatactattgaatcacaatatgaaacaccatactttgatgatgacaatattaaagacaaagcacaaattaaagcgaaacagagtaatgaactttcaagttttgtactgtcgatttatttatcctctttgaataaaacagttgaaattcccatattaaacaatagtgttctatataacaatactgaagctgattattatttaagtgatccaattattaataacaagatcatcaccattcgagtagattatgccgatcaaattacaaaaccaaatatttcaggagaaagaaagaatatgattgaaaaaataaaatttaggtttgatactaaaaacaaaaaaatacaagttataggatatgatttaagttatacaaaagctaaaaataattattcaaaatcatttaattttattactggcaagttttattctacatcatcttttaatggcaaaaaggaagaaacatctggttgggcttcagaacttcagaacatatacatagaaaatttgaacagtgattttttcaataaacttttattacatggaaatgagattgaataaattcttaattaaaaaatacaatatatcaccacgtggttgcaaaactgcactataaatatttgcaagcaccgattaattatatcaaaaaaattccgtttcattaaaaaaatatttatacctttgctctgtgatttttaacaacggaacatattattatagaatttttacctcagctctgggatagggattcttatgaatataatttaaaacctcgtcctagggacgaggtttttttattttaaaaaatgtaaaaagatgaaaataagtattattggagtgggattaatcggaggttcgatggctttgaaattaagagagaaaaacctggctagcttcatttacggaatcgataacaatacacagcatatcagtgacgcattaaatcttaaaatcattgatgcggaagcaggtctcgaagaaggaattaaaaattctgatctgattattcttgctattcctgtagatgctgcgaggaaattactgcctgcaattttagatctggtctccgatcatcaaatagtaatggatgcaggttctacaaaagcaggcattgtacatgcggtaaaagaccatccgaaacgttcaagatttgtagcgtttcacccgatgtggggaacagaaaacaacggccctaaatccgctattgcagaaagtttctccggaaaagcgggtgtaatatgcaacaaagaagaatctgcagaagatgctttggctaccgttgaaaaagtagtcaatgcccttgatatgcacatgatttatatgaatgcagaagatcatgatgttcataccgcttatatttcccatatctctcacattacgtcttacgctcttgccaataccgtccttgaaaaagaacgtgaggaagaaacgattttccagcttgccagctccggtttttcaagtaccgtacgtcttgccaaatcacatccggaaatgtgggttcctatttttaaacaaaacaaagaaaatgtactggatgttctgaacgaacatatttcccagctcagaaaattcaaatctgcccttgaaaaagaaaactatgaataccttgaagagctgatcaccaatgccaacagaattagaggaattttaagatagttattatctaagatactaaaagcctcaacagcttttacttttattttattaagaaacccttagtcagtaatgcctaagggttttatattgtaaaacactgatatttctattaacactccggaacgttaactgcaatggcaagtccgccttccgaagtttctttaaaacggtcactcatagactgagcggtttcccacatggtcaaaatcacctcatccaatgttacttttgccttggtaggatcactttccaatgcgatattagctgcggtaatcgctttcatagcgcccatagtatttctttcaatacatgggatctgcaccagtcctttgattggatcgcaggttaatccaagatgatgttccatcgcaatttctgccgccatcaaaacctgccctacgcttccccccagaatctctgtaagtccggccgctgccattgcagaggaaaccccgatttccgcctggcaacctcccatcgctgcagaaatagtagcgtttttcttgaataatgtcccgatttctccagccacaagcagaaatcttactatatcgtcatcagaggtaaacggagtaaatgcctgggcatacatcaatactgccggaataactccacttgcgccattggtaggtgctgtgataattcttccgaaacttgcattctcctcatttactgccagggcaaagcaggcaatccatttgttgatattcgtgaagttctcttcagcatctaccacctgctggaaccattcatctttatttttatagattttatctcccagaagctttctgttgattcctgcagctcttcgggaaacattcaatccacccggaagaacaccttctttattcacccctttataaatacattctttaatctgctgccagatataaagtgcttccttcctcgtttcttcctgtgttctccaactttcttcgttgatcagaatcaaatcagacattttattaagcccaagtttttcacagtatttcgcgatatcagaagctttatgacaagggtataatgtacgtacacactgcttttgaatagaattcttttcctggctggctatgaaaccgcctcctacagaataaaaatcctgcacaagctccgttccatcctcaaaaacagctctgaagatcattccgttaggatgaaaatcaaggctttttttcatgtttaaaaccaaatggtgcccgtagataaatggaatgactttctctcctcccagattaatagtttgagtgcttttaatatagtctatcttctcatcaatttttgaagtattgatcgttttaaaatcctctccatttaagccaagcattcccgcaatatcagttccgtgcccaatccccgtttttgcgagtgagccaaaaaattcaagaaaaacctcttttacttcttcgattgatctttctctttttataatcctgataaatgcagcagcggcattccagggtcccattgtgtgcgaactggacgggccaattcctactttaataatttcaaaaaccgatattgattccataaatgattcgtcattttcctcaaaaacaaagatacatgataaatcccaaaatcaaccttcaaatctttaatgaaaatcaagtatgatcagaatataaaagctattgcaggcattcctcatgctgggaaagatcaaggcctttattttcggactcttcggaaacccttagagtgatcatagagttcgtaattttatacaaaagcagcgaaccaaagaaagtaaaaacagagacaagaaccagggcagccatatgatgaagaaagacctcaattccgccatgaagcagacttgcattttcaccatgggcaaaaacagccgtaagaatcatccccataatacctcctaccccatgacatgcaaagacatccagcgtatcatctactttctttaaagccttccagttgaccattatattagaaactattgctgtgataaatccgataaaaagactttcctgaatacttacaaaaccacatccgggagtaatcgccacgagccctactacagctccgatacaggctcccaaagcagaaacacttcttccattgattctgtcgaaaaaaatccatgtcatcattgcggaagcagaggcaatagtcgttgtaccaaaagctgttgcggcagaagcagaagcacttaatgctgaacccgcattaaatccgaaccatccgaaccataacattccggtacccagcagtacataaggtatattggaaggctcatggtgaggattttttctgtttcccactaccatagcacctgcaagggctgcaaagcctgcgctcatatgcactactgttccgccggcaaaatctttcaccccgaaatatttatttaaaagaccatcaggatgccataccatatgacaaagcggtgtataaatgaaaatactgaaaagaacgataaataataaataggaaataaaacgaaccctctctgcaaaagatccggtgatgatggcaggagtaatgactgcaaatttcatctgaaacagggcaaagagaataaaaggaatagttggagccattattttatgcggcagattacctactccacagaaaaaaggatagcttaacggatttccgataataccgtaatgctttccgccaatggtaattcccaatgaatttccaaaagataaggaaaagcctacgactacccataccaaagaaataacgcccaaagcaataaagctctgcagcatggtagaaatcacgtttttcctgccaaccattcctccgtaaaagaaggacaatcccggtgtcatcagcagaacaagacctgccgccgccagaatccaggcaacatccgctcctacaattttatcttcacttaaaaactctcctgtatgaggaatatcggcaaccggattccagaataagcctccgattgcaaccagtgtgatgatagaaaatgaaacaatccattttaaccctactttcataaaatttatatttaaccctatcaaatttaaacataaatttgataaaaatgatatttttaatcaaacacccctataaaaaaaatactatttactagataatactctaattttcacaaaacacttccttcaatattttggaaacttctttagatttggtagcagggaaaagatgggttcctcccttcactacataatcaggtttggagtaacggataggaaaaacgatatctttatcacctaatatctgaatgacattgggattttcttcaaacttccattcagccactttttctacagaccacttcaggtaataaggatctcttactttaaaatattgcagaagtcttggatttttagggtcaaaaagctttctgataacagcatatacattggcggccctgtcattgaataagcctacaggtaatattctcgggattttggtaacctctcccgtctttataaatctggatttttctttatcggatttaatgcttccaaggattactaccttctccgcaggtttcaatttgttaatttcctgcacaataattcctccaaaagaataccccagaaggtagaatggttctgaatcatctattttctctgccattcttttaacgtaagcatcgaagggctcatttttttcggggatgagccaatctataaaaatcagttcacagtgtttgggaaattctattctttcaaggaccttgaagtctgctcccagaccgcttacaatataaattttcataccactaatttataaaaaatacagaaataaagaatgtcctcttgctttaacagcactaaaaaagagcagctcctgggaactgctcttctgtatcaataaaatatattttactttttcttttttggaactctgttctcgttatccagcatttctgtggaaactttgaactgaatatccatttcgttcttgatgaagtaatctttcagtgaagactgatagaatactttaaagtctcttctgttcagagagaacttggcagattcaatagatgtggtaaactgagtaacgtacacattcgcagggaaagagattgtttttctcactcctttaagggtaagatcaccgtatactgtagaattgtattcactgtttgctaaaggaataatctttgtcagatggaattttgcaatagggaattttttcacttcaaagaagttggagcttttcagatcattagtaagcttgatctggtcttcatctgaaacatctcccgccatcaggcttctcatatctattataaattctccgtctacaagaaccgtatggtcaaagttgaattttccgctttttaactttactgttcctgagtgggaggtttcctgggttttcaccaccttatacccccaccatctgatctctgatgaagtcacttttgaaaccttatcaaatttcttttgggcagaaacaaatgatatgcttgcgcacaccatagcaaacaatagtaatcttttcattcttttttatttacaattcaacaaaaataaaaaaaagtgtagaacttctacacttttaacaatctttttttgattaatttattgagcagttacctttacaaccatatcaatatcatctttcacaaaaacatcctgcattgtagacttgtaagcaacatcaaatttctgtctgtcgaaagagaatttgttggataccaaacttactacccctttgctgtaagaaattttagcagggaaagaaatagggtttgtttttccttttacagtaaggtttcctgttacaagagaattgtaaattttgtcattgtttttctttactcctgtaattttaaaagttgctgtagggaatttttcaacttcaaagaagtcaccattcttaaggtgcccgtttaatttttgctgatattctcccgtaaggtcagtagaactgatagaagtcatatccaatacgaagcttccgcctaccagttggtttcctttcattaccatatctccggactttacttttacagtaccgtcatgagagcttgcttcagattttgctactttgtatccccaccagtgtacatcagacgctactactttttttgactgtccgaaagctagaccaccagctaaaactgctaataaaaatatttttttcattgaatagagttatttacttatttaacggtacaaatgtaggtatcttcttcaatagatttcattgatgtatatcaataaattttattattttcatgaataatatcatcccataaaaaaactccgaatttcttcggagcctttatttatacctgatagtacgctgtataaagtgctataccatttagtgctgtatgattttgcttgaccagataaataggaatatttttaagcatttcttccattttatcactgatcttgaatttttcatagaactttcctttgtctatatactctcttacggtctgtgcaatatcaccggcaatcagtaatcctccggtagctttcagctttaatgtaaggttgttggcttctcttgccaggaattcaaggaaagtatccaaagctattttgcagatgagtacgttttcttccacagctgctttataaagctcttctacaaagttgccctgtgcaaggcgctctcccaaccattccggctcaggatgtcttttcacatctcttaagaatctgtaaatattgaataatcctgattttgaaagtacattttcccagcttacaataccataaatattattgagaaactggtaaaactcgacttctacgttggttcttggtgaaaactctgagtgtccgccttctgttgcgaaaggtctcaggtattttccgtcaaagaaatatccggcctcacccaatccgtttccgggagcaagaacggctacatttcctttttcaaggtgtccgctggtatagatggcttcaagatcattatcttccagcagagacattccataagcagatgcttcaaggtcattcagcatgtctactttttcaaacccaaaatcgcgggcatattcagcaacatctaaatgccatcccaatcttgcagggctgcttttcccgtccagtacaggacctggtacggccattcccagacgttttacattttgcaattgattatcctggataaacttcttcagaatatctgaaaaagaagaatattcctgggttgcatatgtattttctaattttatctcaagacctccgttcccggaaacgaaatagcctaagattgttatatcttcacggaggcttgctccaatgatagaaacattatcattattactgttctctactcctggtaaataaagtggaaattttggattcagaatcataacctcaaattttaccaaatataataattgtttttgtaaatcctgcacagaacaaaaaaacctttccactttcgtgaaaaggttttggttaataattgtttatatattaaatctaactactttcctaatggaatattgtaaccgaatcctactccgatattccccacattataatcctgacctggcaaatctcctttagttcctacaaaaaccttttggtattgtacaaagaagttccagtctctgttgtggtatccgatctccggtttaaggtaaaaacctccgtctgctctttcaacattggtatttgatgctacggctttatccccaacaaggaaaccatatcctaagtctgttccgaaatagaaaccggtttgttttggataaattctgattaaagcagctacaggaactactcccacatcattatttttatatccgttattgtcttttccaaaatagtgagtatatcctgatgcgatacctaacccaaatcctggtgtaatcaggttctggtaagatacatccactcctactgcagcggaaagattatctgcgggaactgctaaaccaacattcgcacctactttgatcatattgttcatttgagcactttgggcgcttgcgatacctgctgttaaaataccagccagtactattgcttgtttaaacattttcataactctaatttttaaattttactaaacaagaggatgtaaaaatcgtgccaagcaaggctttttctttgattttaacagtcaaacacaacataaatcaatgaatatcaatatcttaattttaacaaaatttaaatgtttgtttaacaaaaattatcaaaaaaaggatcccgaaaagtgaattaaagaaaaaagaaatgaagcaagaagatggaagctggaagttatatcctcttatatgaaaaactcacatctaattaaagtaaagagaaatttctccttcctttacaacataactccctgcttcatgcttccagcccgcataacaatattaacaatccttaacccgttactattttaacctttttctatgaaatacatcaaaaaaataaattctccatgatggctgattcattaataaaaaacaaacatcttctctggcgtgcgggttttggtgtgggtattaatcaaattgatgatttgaaaaataaaaacgttaagacgataatcaacgaattatttaaagaagacagttttagtgagattacctatgatactcctgaccctgatttagccgcagactacatgaacagcacagctcctgctgaaatgaaaaaagaaatgcagcgtattaacagggaacaaaacaatgaactgaatctgaattttttgaataccatcgtcaacagcaaagagcagatgagggaaaagatggcatttttctggcatggacatttcgcctcaagggtaatcaatccgaagttcaacagacagcttttgaatacgatcaggaagaatgcactgggaaatttcaaagatctgctttttgaggtaagccagtcaccggccatgcttaattttcttaacaaccagcagaataaaaaagatcatcccaatgagaatttcgcccgcgaggtcatggagctttttaccatgggaagaggcaattataccgaacatgatgtaagagaaggtgcaagagcattcacaggatggagttatgataaggaaggtaatttcaaagaaagaaaaaatcttcatgatgaaggcagcaaaacttttctgggaaaaacaggtaactttgatggaaatgacattcttaatattattctggaacagaaggctactgcacagtttattaccacaaagatttataaattctttgttaacgaaaaaccagatcaggatattgtaaacaaactcagtacgaatttctacaattcagggtatgatattaaaaaactgatgactgagatattttccagcacatggttttatgatcagaagaatatcggcaaccggataaaatctccaatagaactgatggctggtatgatgaggatccttcctatgcatattcagaatcctgaaaaccttatcgtgtatcagaaattactgggccagatgcttctttatccacccaatgttgcagggtggcccaatggaaaatcctggatcgacagttccacgcttatgctgagactccagattccacagatctggtccggactccgccctttagaatacagcccccgccaggatgatgatatcgatatgggaatgaaatcccgtgaaacagctttgaacaaaagctttaaaaatcccaacattaccatcgattgggataggattgagaaagtttttgctgataaaaactgtgaagattatcttttgcagaatactcagagccttgatatgaactccgtaaagaatttttctgataagagtatcaaaatgaatgtcatcaacctgatgtctactccggaataccagctaatgtagggagaaggttttaggttgcaggtagcaggtagcaagtaaagctgtcgcagtataacttgcctttttactgctataaaaataaaatgcagcccaattcctaacttttacgtgcaaactatcatctgccaccttaaaaccctaaaacaaaattatgttaatcaaaagaagagaatttctcaaaataagctcactggctacggcttctatgctgatgcctaatttcttaaaagcgatgacgttggatgaagctttgaatcccagtcagaatattctggtcgttcttcagtttacaggtggaaatgacgggctgaatactattattccagttaaaaatgatatttatttcagggaaaggaaaacactggctatacaggattcgatacctttaacggatgaggcaggaatcaatccgtctctctcctattttaaagagctttttgataatggtgagctttctgtgatgaataatgtaggatatcccaatccggacaaatctcatttccgaagcatggatatctggcagtcggcaagcagaagcgaccagtttctggaaacgggctggctgggacgtttcctggacgaagaatgctaccgctgcgaccatcctacccaggcacttgaggtggatgatatgctaagccttgccctgaaagggcaaaataacaaagccttcgcatttaaagatcctaaaagactttaccagacgagtcaggaaaaatatttcaaatccctttatgaccaccatcacgatgatgaaactgtatcctatctttatcagactttaggttccaccatcaataatgccgattacatctttgaaaaaagcaaagctaaaaagacagagcagatttatccgaactctcaattgggaaaagactttaagactgtagcctctttaataaagtcagatatcaatactcaggtttactacctttcggtaggaagttttgatacccatgtgaatcagaatgaccgacagaaaaaattgttcaatgatatcaatgaagcagtaaaatcttttgttgccgatatgaaaagcaatggtctcttcaaaaatattttactgatgacattttctgaattcgggcgccgtgtcgctcagaatgccagcaacggaactgatcacggaaccgctaaccagatgttctttatcggtggaagccttaagaagaaggggctgttaaacgctctccccgatctgcagaatctgaatgaaggcgatctgatctacaaagaagatttcaggaaagtctatgccacgatcctgaaaaactggctaaaggcagactcttctaaagtattgggatggaaagacgggatttatgattttgtgtagacggaccgcaaaagtcacaaataaacaatttagatttctacggaatgacaaactgtgagaatagaccatcattataattgtatcattccgtaggaatccagtcacaatcttgcaaaaaattataattctgaccaatatatcaattgaaaagtaagaattccctccagcgaaaagggtggcaaaaatttaaagaatttttgacggggtgatttttcagcattctaaaatatccatcaacaataaaaaagagactgtacctggttatgacagtctcttttcaataattttaaattttaactactttacgtttaagccgtaatctgctttggttctttttctttctgatcttcttttttatcaagtttctcagatattttttttacaatatattctattgctatgggtgctatgattgcaattaatgctttaaaaattcttgatttcatacatataattttgtgattacaaataatgcaatttccaagccaagatgaaataaagaaacaaatactcctttgcagcctcctattaatgatagatttaaatcaatcagctttcttcagggatgatcaggttctgataatttttatatccggcattgaacttttcctccattttcagccgtaatttctttggcttatgaacaatcagagaatctccgaatcctaataacagtctttccagctcaaaattgatctgaacacagattttaaaaagtgtaccctcatagtcttctctgataatttcctggcttttatgcagcggcttggttttcacatacggtgcatttcccgcatctacccagaagatcacatttctcggatccattgattctgatacggtaacgcctacaatatctttgaaatattcatccccatccaggtctttatcaatatactgaacactgtcatccacttcaatactttccattctgtccagtgccagattgtacattttctgtttgtaaagacagatcaggaaccaacgattgttaaattccttcagcagctgcggatgtacagtatatatattggattctcttgccgtaaagcttttgtaaagaatcttcaaaactttcttattagcaatactttcgtacagaatatcaatatgttccaaaccttttagctgttcatttttatccagatgaataatcgatttctggctggtggcatgaatagagtcttccagcttctgaatgaccccgttcatctctttgaacatggaaaagtccttgaactgtttcagaatctgaactgcattattcatcgctttcaggtcactttcattcaccgaaatattatgaatactgtattcagggtcgctgtaacggtagtattttctttcgtaaacctcaataggagcctcgtatccgaatttttcactccgcatattctgaagatccagctgaactgtacgtttacttacataagattcttttccttcaaattcaaacaatgcttccgaacattcatcaatgagatcctccagcgtatatttcctgtatttgtttttaagacatttatctaatgttttatacctgatcagagcatttttattcgatgacataccttagtgtttaatgattgggtgtttcagataagcaattcgcttattcttttttgctcttttccggctgttatttttcttttaaagcattaccgtcaaaggtaatcccatcccagccgaattttataaaattccggatattctgatgatcagtgccttcaggatttttcagaacatcatctctgtaaaactcaccaaaaagccaaagggtttcttcttttgtaagatcctgcatactggcaaagctgaacactttacacgaaccattattctgcccggcctggttggtggtatctccgttttgaaaagcagtaggggtaaactcataatgttcgtcaatataagcgataacatcattaaactgaatagtttcagggaaatgttttaattgttctaatagtaccatagatctcggttttattattttatatttatttcaacagatttccaccctggatgatctgctttttttaattttttgtaaaaataattaaaatttctttatctgcgcaaaactattgcgcaataagggtattactttgcatcatcaaaatgaaacaacaatggaatttaatggaaatcatttaatcgaattaggatatagacctgcaaaatggtttaaagatgccattagctatatcaatgagaataaactggatgaacagcagatcagagaatatctggtacagttcacacagccggaccttattccgcttcatgagacagccaaagattttatgatcaacatccgggctgagcatgaaagtgagaatgataatgtagataaagtaatcaaaaccatgaatgttctgatgaaaacccctactctgattggcggagctttaatgccggatgcctgccctactggccctgaaggtcagattccggtaggtggcgtggtaattgcccaaaatgccattcacccgggattccatagcgctgatatctgctgttctgtgatgctgacagattttggaaaagccaatccaaaagatgttctggatgctgcacattctgtaacacacttcgggtatggaggaagaccaagaggagagcagatgccgatgtctcaggaactgatggatgctttcagagaaaatgaattcttaaatgatgaaaagctgatcagcattgcccgttctcatatgggaacccagggagacggaaaccacttcctttttgtcggaatttccaaaaatacgggaaataccatgatggtaacccatcacggatcaagagctcctggagctgccttatatgataaaggaatgaaggttgccaatcgtttcagacaggaaatttctcctgaaacattaagagaaaatgcatggattccttatgatacggaagaaggtaaatcctattggaaagcgcttcaactgatcagacagtggaccaaagaaaaccatacttctatccatgatgccgtcctgaacaagcttgaaatggaaaaggaaaacagatactggaacgaacataatttcgttttcaaggatggagacctgttctaccatgccaaaggagcaactccgctggatgataagttcatgcctgatattacgggaccaagactgattccattgaatatggctgagccggtactgattgttcagggaacaaccaacgaaagaaacttaggttttgccccacatggagcaggaagaaacttcagcagaagccagcataaaaaatctctggctcataaaacgactgaggagatcttcaatgaggaaaccgccgggctggatatccgtttctattccaatgaaattgatatttctgaacttccaagcgcttataaaagtgctaagaatgtaagagcacagattgaagaatacggactttgtgaagtcctggatgaagtgatgccttacggatgtatcatggccggagatgtgcagaaaaatgcaccatggaagaaaaagaaaaaatacagaaaagcataatttttaatatgatattcaaaccttacgggctttagaaatccgtaaggttgaataaaagcaacaacttaatttcacagtaccagaaaagttaattaaagaaaaaattcaaggcaaagaaagttcctataagattaaaattactttccgcctttttaacccattataaggcaaagggagttcctatattttttggataaattactccccgctttttataaactataggtaaaaggagttcctatacccttcacttttaatgaatttactcctcacttattttttaaacttaaaaacaatgaaaacactacaattattcaatgctgtactggctaaagaatcgaatgcaaagccgtttatttccaatgacggttttatcattgaacctaatgctgtctgggcaaaaaataaaatcatatccttctataccaaggaaaaactgaacggaaatgatctgaataaaaccttccataaatcttggaaaaaaataaagaatacctcaagatatgatttattaattgaacagatcactcattatgtttcgacctatggaagcgattttcagaacgaaatttatattcctgctgaaatactgaatatcccggatatgaagatggtttttaaagtcatcaaagcgtacactgtggaagaaatgcaggaaaaatgtatttctcttttaagatcaggaatggctttaaaggaggaaaccattgatgatttgcttgatattctgcataacgaactggaatatgattttacagcaaaagaaaatatcagaaacaaggaagcgatcataaaaatagccgaccagtacgatatttatcctgaaaatcctgttgagttcttccgttacgttatttataaaacaactaacacaacgcttttaatcaaaaataatgatctgattaatcttattaagcagagtaatttcaatccaacctatttgtttgaaagtttcggactggagaaaatggcagaaatctttaaccggtttaaaccattattccttgcttataaaaacagggctccaaaagtcattaataaaatttcaaaactatctaaaacacatcataagccgctgatctcaaatccgttgaatgacgccaccaatacattgctggaaaacagcgactggcattggctggaaaacgcaacaccgttcgccttgttcaaagcattgtcagcatgccattcaagaatgtacggacaggatacctttgtctacagagtgagaaacggaaaatcatggactaaaaaaggtaaggaaacttacgtgaatcagttcaattatgattttattttagattttctgaaactgaagtatgaaaacctgtccggaaagaaattctatttccctgagcatgtagaatttgcactgccaacttctgaaaagatgtttgtgggaaatattcctaccggaacccgtttttatgctaaaagacttgctgtaggagtgtattgggaagatcgttggggtgcccgtgaccttgatctttcaggattgaatattgcaggaaaaataggctggaatgctgcttataatcacggaaacggacagctgatgtactccggagatatgacttctgcgccaaatggtgccgttgaatatctttatgccaataaaggacactgtgcaccaacgcttgttatgaacaacgttttcagtggaaatgcggattccggatataaaatcattatcggaaaaggggacaagatttcctacgactatatgatgaatcctaataatctgtttgctgaagccaaatgtaacgctgtccagaagcaaatgattctgggaatgctgctcacaaaaaacgaaaaacaatgtttcgtactattgaatttcggagcgggtcattctcatgtttcaggaaataatcaggtttctgtgatggcgacaacggcattgtaccaacaatggtatgaagccatgtccttcaatgagcttataaaagagcttggaggtgaaattaccacagaaaaggcggaagctgattttgatttctcgctggaaaacctggaaaaagatagctttatcagaatttttaaataattcttaacgctgcctgagtatatcaggtggcgttttttatgattcgctgggaaaacgttgacaaccaacccgttgacgattctttgaatttttgcgaccctgccaaaagaggggaattttcactccttcagctgggatattaatcaggattgtagttttccaattaatttttctagtagcatttgtccggattcctacggaatgacacaattggaatgatgtttatccatacagtttgtcattccgtaggaatccagcctccaaaattcagaattccctaatgtatactattacaaacagcttaaactttggctaaagccgtttgaaaactgtaatctttatcaaatggactaaagttagttgctattgaataaaactttaccttaattattcattcacctttttcactgaaagaattccttcatttacactaataatcactttcttcccatagtcaatctgaatattgaacatattttccagtggaaactgaagcacagcctgaagaattaaacgaataactccggcatgggtgataatcagaactttattgacatcatttttttgaatcagttcactccaaaagctgagaactctgttttgcatttgaatgagattatctccgccggcagctttaacattgacaaaatctttgtaccagggattgatttcttcttccggaatatcggtccattttttcagttcccagttgccgaaattcatttctctgagtctttcatcagtgtgataattaaatttaaaataatcagctaataaacagcagcgctcggagggactggaaataattgcatcaaaactatgatcaatatccaacgctttaaaatcatcaatataatttttccttaaaggcatttcagcaaaaccataacacaggttttcaggattttctacagcggtatgacggatcagatgaatttccatacgatgattgttcccaaataaaataaaacttcacaaacctgctgcacagacccaagacaatctcccgtgtagccaccaatatgctttttaaaataccagcccatatagattttaccagcataagcgagtgcaaaagcaaaaatcaatctccagtccgggatcaggacaaaagccatcagaacgcttataaatcccaccaataaggccattccatccaagggtttattggccagaggtttcgatttgctgacatcaatatctgtaacatattggtgagtgtagatcatcgttcctgaaataaaccggcttaccgtatgggccagaataatgattcccagcaatctgaccgtttgatcactgatactacccaacgcctgaatactgtaaaatttcaaggcaaaaagcaggataattccaatagttccatatgctcctactctgctgtctttcataatggtcaggattttttcttttccgtatccacctccgaagctgtcacacatatctgtaaaaccatcttcatgaaaagctcctgtcagcaaaacaccggcaatcatcattaaaacaatcccaacctccaggttaaacaacatggtagaaaggaaaagcaccgctgcattgatcaatccaaccaaaagtccaacccatgcgaaatatttctgagatttattcataatctcaccggaatacggaacagtaaacggaaccggaattctggtgaagaacatgagtgctgtagcaaaatagatcagttcatttttgaggattttcattttctttttagtctaaaaaaattgttaagtcaatttccgtaaaattaggaaagcttttaacaacagtaaagggatcagttaaaaaaataagaaacatgaatcttatcacgtaaagttatcttttttatttcctgagtatttttagttttgcaacgtaacaataaccatgaaaaaagaacaaatgaaaaaagcgtatttcgttggattatgtcttatatccgtcgtaagctgttcagctcccggtgatgagctggaaaatgtaaatgaagcacaggctttaaatgcatctggtagtaacatgtcagcaaaaggaggcttcagagatactccggacaccccaactcctccccctgcaggaatctggtcaaaatctttttatttaacgaatcctatttacggtttctacagtaatctgaccaaaaagcacctgtacaatacctctccgttaccatccgaacttcccaaatcctatccaggactggactattattttcaggaaagattattaggttctgcagacggacccggccctgtcatcacaagatggtttcacacaggaaccaatgatctggtattaacgactaatcctaatgaattggtgggacaaagtaattgggaaaaaagaaatctcggcaccagctataatggtgatgagccgggaagttttccgatttacaggtatttcaatggtgataaaaagacgcacttttataccagagacaaaaatgagctgggagacggaaaagacggttatgaatatgaaggaatcgctttctacctgaaagattctgagcccaaagcctaccgtgttcatgacggacagtttttccaggataatgcgacaggagccctttatatcgtatttgaaagtaccctgagacgtattgaatcttttgcagtgatcaataatctgtttgctgttcagggtaaagcctatctggtttttaaggtaaatatagaagattacacaggagaaagaggaccggacatcacttcaggaactcagctggtaagaaacaccaataccggaaagctgtatcttgtagatgatggtttatacaggtatatccctacgatgcagatatttaatatctataaattcaatgaggatgctatccaaaataaacctgtaagaatgatgtttacaggtaaagatgttgcacacacttattaattatatttgaatttaagataaaaaggggcttcattgcccctttcttattgtatgaagttaagatgatttattggaaatatgagcatcttcaaagctggacatttcattcaggaaattaacggcactttgaataatcggatacgccagtgcacagcctgttccttctcccagacgcagattcagattgagaatagcttgctctctcatcaatcccagcagctgaggatgggcattttcattgcttacatggcagaagatacaattgttcagaatctcagggttctttttccagaccgtggctaccgctaccgtggcgataaaaccatctaccatgatcagcatattatggtgatatgcttcttgtatggctccgatcatttgggcaatttccaatccgccaaaggtttgggcaatttcatcttcggtcatttcggaaggatatttttctaccgcttctgttaaaatatggattttattctgcagctgatggtcattcaatccggttccacgtcctacacaatggctgaccggaatatcaaagagcttgctcatcatcaaagaagaagcggaagtatttccaattcccatttctccgaaaccaataatattacacccttttttagcaatctcagacactacagatttcccatttttcagggcctgctgatattcttcaggagtcatagcgggttcttccagaatattacgactggatttccttacctttttatcaatcagattcagcccttcggggaaatcaaaattcactccggcatctacaattttaatgttgataccattctgtctgcaaaaaacattaatggcagcacctcctcctaagaaattcatcaccatctgataggtaacttcctgtggataggcacttacgcctgcagtagcaatcccatgatcggcagcaaaaactaccatatgaggatttagtagctgtggtgaagtggttttctgaaccattcctattttatgggcaagatgttcaagatgtcctaatgcgcctaacggttttgttttaaaatcaattttatgctgtaattctgatgataacatgggtgtttatagttgttaaatggaaaaatgcaatattagtgaaattcaatgagtctttttcttttgtcttgacacaaaagaaacaaaaggtcaagaccttgaaaattgagctaaaaataaaatatgttctctaaaaattctcaactcgtgcgaattcattattacttttttgtatcaatacatttgtcgcactcagacaggagaattttcttaacgttcacaaaatttatttttttaacgccaattttcaaaagtcaaaaaaattttagcccgcaatattcacttaccctcaaactcactaacccgaaacctgcacctcgaaacttaaaacagtcacgtaagaacattgcgcacttcgctctttactttgcaccacaaatacaaaacaatgacaccaaaaatacttgaaaaaataaaagaagttgagactgcaaaaggcgtggaagtccttcttgcagtagaatcgggaagcagagcctggggttttgcgtcccctgacagtgattatgatatccgttttatataccgtcacgaaaaagactggtacctttccccctgggataaggatgaaacgatagaatttatgacagaagatgatctggacggttccggttgggatctgcgaaagacgtttcatcttttgttaaagtcgaatgcggctttgctgagctggttttactctcctatcgtttataaagcggatgaaaagtttgtagaactctttaaacccttggctgatgcctgcttttctccggtggcggtttcttatcattatttaagcatgagcaagaaatatctggaagcatgcagaagtgatgaagtaaaattaaaaagttatttttattgcttaagaaccgcattaacagggaaatggatcatagaaaaaggaacggttccgcctgtattgttcagtgatctgcttgtgttaaccgatgatataaccagacgaaaaatagaagatctcgttgccttaaaagcaaccaaaggagaatcttaccatcattcgaatgattgggaactgtttgattttctggagagaacgatagcagagaatgaagaaaaatcgaaaggtttatcaggaggaaaggcggataaaggtgagatggagagagtttttagggagatattaaaattataaagtatgaaacaactatctgaaagagctcttaattttttaaaaagaaaagaacgaaaaaaagaattttatattgataaagaggagatagaaaatcttttatcattatatcccattaataattattcagagatccttagatttcaagaagtatattccgggcttatcatagatgataacattattcacatttttaaccctgccgaattaaaagattataagacaatcaaaaccgttctatgtgaagagcaaattttgtttcctatttgtggtggacttttcatttcggaagatggaagaattgctataaaagataatgtcagcaatgattatatcttttattttgaattttttgaaacctttatagaacaacaagctttttttgaagaatatcaagattacaaataccttccagccataggatattatactaagaacattagtttaatttcagaagtacttccagattatgattttatcgctgaatgttctgaccgttataattctctttggaaaaatatttcgaattttgtccacgccagattgtaccctgcaggctacactctaatttttgatggtatttcagaagaagaacgtagttttttaattaaaaggctaaaatcaaaacaaataatataaataattaactaaatgaccatccaagatctaaaaaataaaaacctcgttctcttcgaagccatctccggaagccgggctttcgggctggcaacggagaattctgatacggatatccgtggggtgtattatctgccgaaggaagatttctttggcctgaattacattccgcaggtttccaatgagacgaatgacattacgtattacgaaatcgggagatttacagaactgctgcagaaaaacaatcccaatatcctggaaattctggtcagtccggaggattgtattctgtataaacatccgctgatggatctgctgaaaacagaggattttctgtcaaaactctgtaaagatacctttgcaggctatgcggtttcacagattaaaaaggcaaaagggcttaataaaaagatcttaaatccgatcgatagagaaagaaaatcaattctggatttctgctttattctggagggacaaggttctgtaccgttgaaaaaatggctggatgaattcccctcctctggaggggtgtccgtaggacggggtggtctctcacaggaacattgcggattggtaagcattgatcataccaaagggatgtttgctttattttatgatgaatcaggaacactgggatataaagggattattcagaatgaagaggcaaatcaggtttctgtatcctctgttcctaaagatgagaaaccgatcgcttatctgttctgtaacctggatgcctactctgtttactgcaaagattacagggaatactggaaatgggtggctgagcgtaatgaggaccgttacaatgtcaaccagactcacggacagaattacgacagcaaaaatatgatgcacaccatccgtttgctgcagtcctgtgaacagatttttaaaaccggctctctgacgattcgtgtagaaaaccgtgatgaactgttagatatcaaagcgggcaaccagtcgtatgaaagcgtcatgcaaaaggcagaaaacctgatacaatctatagaaaatcattattctgccaccactcttcccgactttccggatctggataaaacaacaaaaatattaattcagatcagagaaaaactgtatcatcatgggtgataagtgataaatgatgagtgatgaatagtgggactgttgaattgccaatgcttccactctcaaactcaaccactcgcatcccgaatcccgcacctctcacccacacaatcaaaccccgaaactcgcacctcgtaccccttaactctccaccacactcacttaccctcaaactctcccactctcaaacccgaaaactcacttcttcgaagccttcgcagtaggattataatcaagacagattttgatccagtattcaaaatcatcaggtttttggaaacctgagggttccacgtaacaatatcctttaagctgctttcctttcataatcatcggcagaaaaccttttttctccgaaacctcatcttccagttcagggtcatagcggcacatcagattgtcatgactgatgttgatacacatcttcccgttcaccagaaaagacagtccgctgaacattttcttttcttcaatctccatattattttctgcggaaagcctttcacgtacccggtcggcaaattcagtactgtaagccatgattttaattttttgatttatcccttttaataataatggcttcgacaggctcagcctgacagcacttaaaaatttcggctggtattccagttgtcaccctgagcctgtcgaagggcatcaataagcatacctttgttaattattaagcttgagtattaattaaagggataagttgatcgacttttctcttattaaaattaataaaaaacaaggatgatcacactatttctttgtttccggtaatagattgtaaattcaaggataaaattttatttaaattaattattgttttacgataattaactatacatttgcaatatcaatcttcctatcatgaatcagactaaaattattgcaagaattctattttatatctgttccgtattatcgttgggatatttaatcaccgggctctactctctgatctgccttataacagatttttctgttacgccttatggaaacggaaaatacctccatatcaattatccgttgacagaaaaacctttcctgaatattgacaacaattatccgtatatcatcttttcatttctgtcagtgcttatcacatatggaatctttttctgtttggccgccagggttttcagggtattttttcagcagaaactgtttacacaggataatatacggcagctaacgagattttacctctataatattttcattcctcttccactggtgattatcgcgggtttctttgtggaagtagaaagtatcatctggggactggtgtttattcactttatgcttggaattttctgcctgtttcttgcgaatatctttaagcaaggactacatttgcaaaacgaacaagacctatttatttaacatgccaattatagtcaacttagatgtgatgcttgccaaacgaaaaatgcagagtaaagaattggcagaaaaactgggtatcacacccgttaacctttctatcctgaaaaccggtaaagccaaaggcgtccgtttcgatacccttgaagcgatctgtaaaatcctggaatgccagccgggcgatattcttgaatttaaagagtagttgggattcaggatacttgttacgaggtttgagagtcagagtgtttgagagtggagtataaaagttcacttctaacttccagcatccagcttccggcttccaaacataaactttaaactttaaatcataaaattgctgccgaaaggccgcctgtccttctattccccaaacacaacgctatgaacacattaaccatcaacaaccttagtctcacctataaaaatggttttcaggccattaaaaacatttctcttgatatcacaaacggaatgttcggcctgcttggtccgaacggagccggaaaatcttctctgatgaaaaccattgtcggacttcagaaacccacttccggaactctgcttttcaatgatgtggatattgttaaaaaccctgattatattaaacagaatctgggatttcttccccaggattttggcgtgtatccgaaagtgtccgcatatgatcttctggaacatatagctctattgaaaggtattagtgataaaaacaaacgtaaaaatcagattttgggtctgctggaaaaagttaatctttctgatttttccaaaaaagaggtccatactttttcaggcggaatgaaacagcgtttcggtgtggcacaggctctgctaggagatccgaaaattattattgtcgatgaacctactgcaggactggatcctgaagaacgcaatcgtttcaattcattgctgaatgatatcagcgagcaggtgattgttattctttctacccatctcgtggaagacgtcagaaacctctgttcggaaatggcagtgatgaaccatgggcaaatccttcgaaaaggaaaccctggaatactgatcgctgaactggagaacaaaatatggtcaaaacctatccataaaaaagagctggaaacttatgtttccaattatgagatcatcagcagacaattactggaaagagaacttcacatcaccgtattttctgaagaacctccgaaagatttcagtcctgtaaatcctttgctggagcacgtttatttccatacacttactcaaaaactttaatcatgaacactttatttttattcgaagccggacgctcttccaagcactggctcacctatcttgtggctttacttttaataagcctgggtattttttgcggcagccagttcaatctttcggcaggagaaggaatttatctgaactcaccttacactatcggttttatgaccgggatgctgagcctttcggttattttttttgctaccgtttatgctttacaactgttgttcagagaccaggattcaaaatttgacagcattctgttttcttttcctttttcaaaattcacttatctgaaagggaaattttacgcgtattttcttcagacatttttaagtttcaatttattaatgactggctttctcctggggcagctgatgcgtacaggaagtgaaatgcaggagtattttaatatcttgtattacctctacccattattgatcttcgggctaatcaacagtttctttgtatgcagttttttgtttcttatttcatttacagtaaagaagaaactgctggttgtggtaggcggactctttctgtatgtattgtatatgatcattttactattttccaattctccgtttatggcgggaagtctgcctcagtcattggaaacacaacaattttcagctctgatcgatccgtttggattatctgcttattttatgcaggcccgggaccttactgctcatcagaaaaatatccatatggtacctttcacaggctaccttctgttcaacaggatcttatttttcctactctcttttggatttttatttctatctcttacattattttctttctccaatacatcaggacagaaagtaaaaacacggggaaatcttcagtcattttctgaaataggcacattggaatattctactgttgctccagcttttaactggtggagttcattccggcccgtattatctttcgtaaaaacagatcttacctatctgtttaaaagcattgccgttcctgcagtttccattatgctgttattctttgtcggaatggaaatgtatgctgaaattgaaaaaggaatccgccttccacagaagtatgcaagctcaggtctgatctcaacaaccatttcagagaattttcatctgtttggcttactgattacggcttattttctgaatgatatttactggagaagtcaatcttccggattcaatctgattgaaaacagtactttctttgcaaaaaaccggttaactggtcattttgtttcggtcagtttactcctgttcttctttaccggaattgtaatggttcagggaattatttttcaggcagcttatcagtattttcatattgattggaacgcctacctcggtgtttttcttttcaatactttccctttgatcttattttcgggatttattctgttgattaatgacagaatccccaataaatttatagcgctgggagtttccgttcttgctgtttttttattgtcggggccggtttccgggaaaatcattacctatcctcttctcagaatattttcagatttcaaagggacttacagtgactttaacggatatggaatttatgaaaaagcttttgcacaaaggcttgtattcggagctggaatcatcagtctgttgtggttattaaacagtattgctaaaactaaaaaaatacgtgtttccgatttggccttcactatctttctgctaatccaagcaaccattgccggcatattctttatgaaaggatacgttccgaaaaatgaagctcagaacatcttaagttctgtagaatatgaaaaaaattaccgcaaatatgaaaatattccgcagccggatatcactggtattactacagaaatcaagctgtatccttcgaaaaatgcttatcagatcaccggaaaatatatactcatcaaccagaccaatcaacccatcaataagattcttatcaattttaataaggatttaaagcttgaatctgctgtaatgacatcaggaaatgaaagaacgaagattctgcaaaacatcacggaagtttcattacagcaacctcttctgccgggaaaaactgcttttcttgattttacattatcttatcagtggtttgctgtaaacggccatcagccctttaatgccatcataaaaaacggatcatttatgagaatcagcaggtattatcctgtgattggttatcaaaaagattatgaaatccaggataagaaacagcgcgatcatttcaacctggaaaatcgcataggattgaaagaacctgaagctcctgaagtggaaaaaaaagattttatcaaccttaatatgattgtttctaccgagcgggatcaaacggccataggtaccggagatctgataaaaaaatggacaaaatccggacgaaattatttcgaatataaagcagagcagattcctttccggtttgccgtttcttctgcagaatataaagtaaaaagtatgaattataaagggatggccattactgtcttttaccatcaaaaacattctgaaaacgtcagccatcttcttgaaaatgctaagcttaccttagattactgcctgcagaattttggaccatacccatttaaaaccatcagttttgcggaaatttcttcttttacccggggctttgccgctacagcttacccttcagcagtctttatgccagaagatatgatttttcatgccaatatacaggcagacaagaaccaggatgtcattaatgagctggccggacatgagctttcccatctgtggtggggaaacagccggattgatccggatgaccggaaaggcactgtgatgcttactgaaacgttagcaatgtatacggaaatgatgctctataaaagaatgcatggcaaagaaaaaatgatggaaagaatcaaggtacaccagcagatctacgataatgaaaaagggttgtctgaaaatatacccatttataaaactacgggaaatatgcctcacatttcttattccaagggtgcaattgccatggtacagttgagtaatctgataggtgaagatcgtgtgaatacagccttaaaaaactttctcaacaataaccggtatccaaagaaacccacttcattagacctcatacgtgaattttacaaagttgctcctgatgcctcaacccgaaaacagattgacaggttatttaaaactacagaagatatcatttttacttccggtcctgatacggcttccacagaagcaaaattaaaggacccgattgatggattttaatttttttgaaaatatttttcaggaattgtaacaaaataaaatgacttacacctttaaaaatacttcaatgctttgcatttcgcaatgtcataaaagcaaaaatccctcagtttgagggattttttatagtaagaatgaatcttattatgcttcgttagaaggagtctggttttccaccggcttttcgctttgtggtctttcaccttgcggcttttgtccttcaggtcttctctgtccttctggtctgccttgtccttcgtgtcttggtttgccttccggcttcggaggtcttggtaaaagcactttgcgggaaagcttcattttcttacggtcatcatatcccatgaacttcacctctacctcatcaccttctgcataaggaactttgtcaagacgagcccactcaatttcagaaatgtgaagaagtccttctgttcctttagcaatcgctacaaatgctccgaaatccattactttcactactttacctttgtaaacttcgcctacaaccggtacgaaagtaatttcattgattttagcaatagcagcattgatcttttctctgtctgttcctgcaatttcgatgcgtccgatttctccgatttcctcgattgcaataaccgtatctgtatctttctgtaactgctgaataatttttccaccaggcccaattacagcaccgataaagtctttcggaatctccattactaccattttcggagcgtgaggcttcacgtctgctcttggctgggaaatggtttccgtgattttattcagaatgtgtaatcttccgtctttagcctgcatcaaagctttctccatgatatccatagaaagtccctggattttgatatccatctgacaagctgtgataccgtctgcagtacctgttactttaaagtccatatcacctaagtgatcttcatctcctaagatatcagaaagtactgtaaacttacctgattttgtatcagtgatcagacccattgcaatccctgaaacaggttttgtaatctgaacccctgcatccatcaatgccagtgtaccagcacaaactgttgccattgaagaagaaccgttagattccaggatatcggaaacaattctgattgtatatggattttctgcaggaattactgcagttaaagctctctgagctaagtttccgtgtcctacttctcttcttgaagtacctcttaaaggtcttgcttcacctgtagagaatggagggaaattatagtgtaagaagaatctttcgtcgtgctgcgtaattacgctgtcgatcatgttcgcatcttttacagaacctagagttaccgcagtcagagactgagtttctcctcttgtaaagattgcagaaccgtgagctcccggaagataatcaatttctgaccagataggacggatcgtctgaggatcacgaccatcaagacggatattgtcttcaaggatcatctgacgcattgcttctttctctacgtcatgataatatacttttacgaaaggagttactcttgccaattcttcttcgttatcagcatactgagctaagaactcttcaagaacagctttgaatttttctcctctttcttctttattggatggcgtttttgctacttcatatactttatcgtagcactctttccatactttttcacgaatttcttcatcgtgttcttcgtgattgtattctctctttgggaaagcttttcctactttttcagctaatctttcctgagcttcaatctgttttctgatctcagcatgagcgaagttgatggcttcaagcatttcctgctcagagatctccttcatttctccttctaccattacgatggagtctttagtagctccaaccataatgtcaatatctgattttaataaattttcatagcttgggttaactgacaattctccgtcaattcttacgactcttgcttcagacattggcccgttgaaaggaatatctgtaatcgcaatagctgcagaagctgccagacctgccaatgcttcaggcattacttctttatcataagaaatcaatgaaatcattacctgtacttccgcgtggaaatcttcagggaaaagaggacgtaatactctgtccaccaatctcatggtaagcacttcatcatcagatggttttgcttctctacggaagaaatttccaggaattcttccacctgcatagaacttttctctgtaatctaccgttaatggtaaaaaatctacaccaggatttgcttctttgttggctacaactgttgctaaaagcattgttccgccacatttcaccactacagatccgtcagcctgcttagccagctttcccgtttcgatagtgatatccctgccgtctgcaagggtaatcgtttctgtaaacgcttgaggtatactcataaatttgcttctttatactccgtattgagtatgattaatatttaaactctttaaattttcgtctgcaaaggtactatataataatgaaatattaaatttttcgattgcataaataggctcttaaaatacaaaaaattggctatcaatggatgaaaattttactatttatatctgaaatcccgtcctgttcatgatttatgaaaataaaaatcagtttttttgaagataatgtattgaaaaatcctgctgtttttgtattattgtctcaaaaaatgaaaataaggaagctaattgaaaaaatatcggtttcattataaaaaccagtaaaaattattgcaaagacataggctgatgcctatatttgccctacttcaccaaatacaatgctgtaggttaaaaaaagttaaggaattatccttatacagataaatacatgtttatgattaataaagaagtacaatccaaagacaggaattatacggttccattgattaccatcaccctgctgttttttatgtggggcttcatcacctgtatgaatgacatcctgatcccctatctgaagcaacttttcagtcttacctttttcgaatccatgctggtacagttctgtttcttcggggcttactttatcggatctctgatttatttcctgatctctatcacgaaaggagatcccatcaataaattaggatataaaaaaggaattcttttcggaattttcctggccgcgctgggctgtgtactgttctatccggcagctacattttcgtattatccgctgtttctgggcgccctgtttattttaggactgggctttaccgtactgcagattactgccaatgcgtatgtttccttgctgggaagtgaagaatctgcctcaagccgactgaatatgacacaggcattcaatgcattcgggacaaccattgcaccggtgctcggagggcatcttatttttgaatttttctcttctccggatggatccttcagtgcagtagctacaagaattccttaccttattttcgcaggaatccttttgttggtagctttattgatttcaagagttaagctgccttcgttccagatgggtgaagaagaagtggtaaaaggctggggagcactggagttcagtcatctgaaattcggggtgtttgccatgttctgctatgtgggcggagaagttgctgtgggaagttttatcatcagtttcctggaacagccgcagattatgggctttaatgaaatcatcagcaaaaattatctttccctatattggggaggggccatgatcggacgttttcttggtgcaatttcattgaatcaatctttaagccagcaaaaaaaggctgtttatatgcttggggcagcaggagctgttttccttgtcatcttcagtattgtgaaccttactttttctcagatcagctttttcctggtattcatcgttcttaatttcattgccttttttgtgggtaaagcggctccggcaagaacgttatccatctttgcagcgattaatgtagctttattgatttctgctatggtaaatcatggtgaactggcgatgtacagtattctgggaatcggaattttcaattctattatgttctccaatatttatacactggctatttcaggattgggtaaatataccagtcagggatcatcattagtggttatggccattttaggaggagctattgttcctattttccagggctatcttgcagaccagtttggggtacaacattcctttattattcctgtattctgctatctggttattctgatcttcggagcatactgtaccaaatatcttggtcatgtggaaagcactgaagctaaagcaggtcattaaaatcaactttattaaaatatataagcggaatatctcaaaagtattccgctttatttttttcatacttcggaatgtaactttcgcaataaaaaaatgactcatcatacagaacagcattacaatgaaaatacaattacagcttgaatatgcagcatttctattgttaggaatctatgcttttgcccagacaggatattcctggtggtggtttgccggattattccttgcaccggacatttccatgttgggttatacggtcaataataaagtgggtgctttcttttacaatctgttccatcacttcggagttgccattatcatttatcttgcaggaacagccctatctctgccctatttacaaattgccggggccatcttattttcccattctgcttttgacagaattttaggatatggtttgaaatatccggacagttttcagaatacacatttgggaaaaattgggaagaaggctgagtagtttaaggtacaaaaccaacccgtcaaaaattctttgaatttttgcctcccctccggaagagagaattattaccccttcagttggaatactcaatctgtatttaatactctaaatattttgactattcctacagaatgacaaactgcatggatagatcattttacaattcaattgtttcattcagtatgaatctcaatactcttttattataacatgaaaatcaatgatcttaagagacgtaagtgttcttctcaacggttcagaaatttctaaaaaacttttgtgtcttttgcagttaagaatcccttgttatataaaaacaaaaaagcaacctctttcgaagttgctttttgtttttgaaaatctttatagattattttcttaaacctagttcagcgatgatcgctctgtatcttgcgatatctttatttttaaggtaatctagtaatctttttcttttacctaccaatttaaccaaagatttttcagtgttgaaatctttgtgattgctctttaagtgagcagaaaggtggttaattctgaaagtgaaaagtgcaatttgtccttcagcacttcctgtgtcttgtgcagattttccgtgttttgcgaaaatttcctgctttttgtctgttgttaagtacattccaatattgtttaatgattattatgtaacgggtgcaaaattacgactattttttgattctgcaaacattattgatttcataaatcaaatttgatagaaaaaaatgttaaaaaattcttaataaattatatgcaatccaacgaaaaggcagtaattttgcattcgaattacaaatgaaaaaaattatattctttgcagcggttactacttttttattcattggatttacttcggtaaaagcccagaaaaatgctgatgacaaaattaaaaaagtcctttacttcaatcccgaagtagagccggatattgatgaaataaaagatcccaccaacaatgcattctttgatgccgttaccgataatttcagcggcagaaaaaacaagatgcttcgcgctgaagttcagattccctttgacagcatagacaaacagactattgtagattactgtctaaataatgatgctgattttgccattgtttccaaagtgagatatttcaaagtaggttttggcaaatatgttttttccaatcaggtagtggtaagcatgaagttatttggtgccgatggtaacctggtcgctgaaacagatcatgatacctaccggaaaaatatgcgtcttctgggctctaccgtgaattctgttaaaataggaactgaaggtgctataaaaggaatcatcaaaaaactgagaaaactgaaacctacggaagcggagctttaaggtttaaggttggaatatacagcctttcatcatcaatggtcaattttgcttcgcaagtcaatggtgaatttttgctgtagagattaatatatatctaattcattcatcatttatattttaaatatttcctttactctgaattataaaaattttcacattatataaaagcacttgtttacattcgtaagcaggtgtttttttgtataatcaactccataaacaactgatttgcaattaaatattttcaccaaataaggaattattaaatattttttactattttagttcaacattaaaaccaaaatcatatgaaaaatctaaagaaactcagtagagaaaaagcaaaacaagtcaatggaggatcaatggaaagatgcagtgagactaatccatgcacagtaggatggtgttgtttcggaatctgctcaccctttatctgtattgaataagaagcaaactaacaacataaaaatcaaactcatgaaaaatctaaaaaaactaagcagacaagtacaaaaggaaatcaaaggcagcgggcctttcaaaagatgtacagaacattatgaatgtccgggcggatcatgttgccacaacacctgtgttgttaatccatgtcctctggaataatatatgatcattacagacacctgcatttgtaggtgtttttttttacatcataaataaaatattggtttacaacaaaatattttcactcacaattgaataatatagaaatatttgttattttagtctgacattaatctaaactataactatatgaaaaatctaaaaaaactaagcagaaatgctgccaaagaaatcaatggcggcttaggaccgttcagatgcagcataacaagaccttgctctgttgggtattgctgtaacggggaatgtctggatcatgactgtatgatagagccttaactaatctctttatcattatgaaaaaatcacatcttaaaagactcaacagacaggaacaaaaaggaatcatcggaggcgcaataaaaaagtgtggcgacgattcagactgcggaccttacaattgctgtgtaaacagtgtctgcaccttcattcctacttcagaatgtggaccaatttaaaagaatattggactttaaatttaatttttgaacatctgccccggcagatgttttttgtcttatacagaagcattaaagtttaattaatccttaattttgccactttattgctcagtcttaaaaatttgaattatttttgcatatccaaaaaatttcacgttttgaattctagagacgaacttatcttcaaccctgccgatattgccgaaactctcagcgaacttcctgctgatgagaggctgctcgcgttcctgaaggttccgaaagagtacaaagcagaagttttttcacaccttgatcctgatttccaggaagataccatcagaagtatcggaagcgatgaagtttctgaaatcctgaatgcgatgactccggatgacagaacggctcttttcgaggattttccggacgagctgatcaagtattccatcaatcatcttaacccgcaggaaagaagaattgctttaaagcttctcgggtataactcagactctattgcccgtctgatgacgccttactatattcagatccgtaaggaatggacagtaaaaagatgtctgcagcagatcaaaaaggtaggaaaaagagtggaaaccatgaactacctgtatgtggtagatgaaagaaaccgcttaattgatgaccttgccataggaactttactactggaagaagaagatacgcttgtttctgatattacagacaatcatttcgtagcgattaccactacaacttctaaagaagatgcggtgacgtatttcgaaaagtatgaccgcggtgcccttcccattattacggaagccggtgttctggtaggaattgtaacgattgacgacattctcgatcagattgagcagcagaacacagaagatatccagaagttcgggggattggaagcactggaccttccgtatacacagacatcatggactgaaatgattaaaaagagagcaacctggctgatcattctatttgtttcggaaatgctgactgcttctgcgatggggtattttgataaagaaattgagaaagctgttgtgctggccttatttgttccgttgatcatttccagcggaggaaattccggatcacaggcagcaacactgattatccgtgccatggcacttcaggaaatcaacctgaaagactggtggtacgttatgagaaaagagattatttccggattatgcctgggagcaattttaggagttatcggatttataagaatcatgctctggcagcagattggtttgttcgattacggccaatactgggtatatgtaggattaagcgtctctgtatccctgattgccattgtactatggggaactttatcaggctctatgatcccgtttgtcttaaagaaattaaaacttgaccctgccacttcttctgctccatttgtagcaacattggtggatgttacgggacttatcatctattttacggtggccggacttttcttaaccggaaaacttttgtaattttaggcatcatctaacatgccaatatgaaaatcgtttcacttgtaccttctattacggaggcattatttgaccttggactgaccgaaaatgaagtaataggaagaacaaaattctgtattcatcctcaggaaaaaataaaaaatgtatcggtaatcggcgggacaaaaaacatcaatattgagaaaatcatagccctgcagccagaccttatcattgccaataaggaggaaaacgtaaaagaacaggtggaagttttaatggaggattgtaaagtaatggtgaccaatattgacaccattgaagacaattattaccttcttaaaaatcttggaaaactttttgggaaagaagagaaagcccagctttacaatcttaaaatttatgatgtactgaatcaggcaaagctagacagtcctgttaaagcagcatatcttatctggaaaaacccttatatgacaattggttcagatacttttattcacagaatcttatcggaaatcggttttcagaatattttcaaggacaaaacccgttatcctcaaatcactactgaagatctggcagatgctgatgttattatgctttcctctgaaccttttccatttaaagaaaaacatattgaggaattgaaggccttctaccctgataaaaaaattatgatcgtagatggtgaggcattttcctggtatggaacccatattgcaaaatgtgaaaattatttcaaagaattactgaccgaaattcacctcatgcagcagagctaatttttcaccatcaactttaaacccaaaactttaaacattgaactttatatgtctgataccattatattatccgaaggagcagaatttgaccatgttatacaggaagtttctaaatacatccacctgtatgtaatggcatttgaaaaagaagaaagaaccatcacgcgggtagacaggcgcgaaaatatgtatggaggaaagggaacggtatatatgctccagatgtttgatcagaaagaactggccaataaccgtctggccgcctatatggttttattgaacaaaggagatgaatccgggtttcatacccataacctgagaaatgaacaggagctgtacgtagttatgcacggaaccggagaatatcgtgaaagaaccggaacggaaggacccatccggaagaaaattcttcacaaaggagatattacggctatcagttcgattggataccattccatcgaaaacacagggaatgaacctttaataatgtttgtgattacgaccaataatccataaaaaactccgactatcaagccggagtttatattatatcattttgaaactgagttacaaaattttggctacttctccacaaagccattccagcaattcacggtcttcgttggtaaacggattaatggtatgagaatcaatatcgatctgaccgatattttttccatccttaaaaataggaactacgatttctgcctttgtatcgatagagcagcttaaataattgctttcttcatgtacatccggaaccacaaaagtttcattggaaacggcaacctgaccgcaaattccttttccgtaaggaatgatagtatgatctgtaggggctcctacgtaagggcctaaaattaactcgtccttatctccgtttttgaaatagaaacccgtccagttgaagtaggaaatctcctgatccaacaggtggcataccttttcaagcttttcttctgtattatgttttggactttcaagaattgaggaaagtcttttctttaattctgacattgtatatatattttaagagaattgttttagggaaagctcttctttatatccgaacattccacgctctttaatcatttctgctacgccatccggaacctgagtttcccagcctttcacacaacatgcaatttttctcagtatctctcttgagtaaatttccaaaaactccggattataattagtgatatctacaatacggttgttgtgtttgaaatatttgtataattctttcagattttcttctactttcaggtttgaagaatccagcagctgatgtgtttccggatctttataaggatacaggtaaaccctcattccgtttctgaaaaacttcccgaatgcttccaggattcctcctgacagatttttataatatttctcatcgaataccatcaacaggttatttacccccattgctaccccgatatccccacttgtataagaagcaaaataatcgatcagtctgtagtattcagagaaatttgaaataataacggtataccccagtttgcctaaaatatccactctgtcaaggaaatctctttcatcaatatctccgtctgccctcagattggaaatggtaatttcgataaggacttctgtttcttcatgggtacaggtggcatctttgaaaaacatatccatcccgtttttaagcatatcaatgtttactttcgttaccggtctgaagctccctcttaccgcaaaaatatttttcttgtataatacgtctgccggcagcatattattcccctgtgaattgaaaataacagcatcagtcattccgttttttaccagctgaagggacatcagcctgttatctacataggcaaaagcaggtccgctgaaatcgatcatatcaatctccaggttatcttttgcgatatcgtcgtatagagattctactaaagttcttgggttatcaaagtaattgaaagctccgaaaataaggtttacaccaaggttacctaaagtttcctgctggagagtagcgtcattttccttgaattttacatggataacgatctcattgtaatcttcattttctttggtctgaaaacggattcctacccagccgtggccttttacagtcttatcaaaattgatggttgttactgtattggcataagaaaagaattttctgtccggattattatctcttgaaattctttcttcaatcaaagcgacttcataccgaagcattttacgaagtctgttctgggtaacgtacctgttttttacttcttttccgtagatggcatcactaaaatctttgtcataagcagacattgccttagcaatcgtaccggaagctccccctgctctaaaaaagtggcgaacagtctcctgccctgctccaatttctgcgaaagtaccataaatagtaggatctagattaattgttaatgctttttgtttaggagttagtttctgatacattaggacatgaaattttttgtaaatttaccaaaattaaaccaacctcaaaacaaaatgaagttgaaatttttaggaaccggtacttctcaaggtgtacctgttataggctgcacatgtgaagtgtgtacttcagaaaatcccaaagataaacgtttacgttcttccgtgatggttactacggaggaaaataaaaaaatactgatcgactgcggtccggatttcagacagcaaatgcttaccaaccacgaacacactgtagacattgcattgattacccatgagcacaatgatcacgtcattggattggatgatatgcggccactgatttttaaaagcggaaaagatgttccgctctactgctactcaagggtggctcatgaaataaaaaacaggtttccatacgcttttgctgatgttaggtatcccggtgcgcctgcttttgaacttcacgagattgaaaacaaaccttttgaagtattggatacagaaatcacccctgtagaagtaattcattataaaattaccgtctttggatataagtttaaaaaactggcttacattacggatgccggttttatttctgaaacagagaaggaaaaactgaaagatctggatgttctgatcttaaactgtatcagaaaatttgatcctcatcctgcccattttattcttccggatgttattcaattgtttgaagagctcaaacctaaaaaattatttctaacccacatcagccatcatcttggactgcatgacattgaagataaggagcttccggccggaattcaccttgcctacgatggtttggaactcagtttttaaaaatttttattcaaaaaccttttgaacattgaaaaaagttcctatatttgcacaccaatttgaaacaaacatcatgtttgaaatcaacatcaagcccaggtggcggaattggtagacgcgctggtctcaaacaccagttcttaggagtaccggttcgatcccggtcctgggtacaaaaaacctctgaaatcatttaattttcagaggtttttattttttagtaagttaaaaaattccctaattcataaaagttcaatcgtagcagatataatctcatttgaatactcaattaaaaaaagaaaactttaattctcttctgtatccgaaaatccctgaattcttttaataatcaattttcttaaccgatcttcgtgctgatcaccccactgtcccaaagcacctatgacaggaattacactttcaccaaaatcagttaagctatattctacttttggaggaacaacaggataaattttctttgtaacaagctcgtggtcttccaactcttttagctgaatgtttaaaacccttcgtgatgcatccggaatcttacgctgcaattcacttggtcttttatgcccctgataaataaaccaaagcaggcgtatcttccatttgccgtaaagtacttcaccaatcagatcaagaccgcagtttaagttcggaattatttttctctcgtacataatgtaaaattaagcgtatgttcccatttgcacaataggggaataatttatccctatctgaatcgtaattccgtacttgtctgaactgcttttatacctcaattttgtcctataaataattttaaaaaaaatgaaacaatttaattacaacaatgagttatcaggcaaaattgcgttggtgacaggaggtacaaaaggcgccggaaagtcaatagcagaaaggttgctgcaggctggcgcaacagttattattaccgcaagaaatgcacctgagcaggaaaacagcaatctgcatttcattgcttccgacctgagcacagcagcgggatcccaaaaagtagtcagtgaagtgcttacaaactacggaaggctggatatcctggttaacaaccttggttcttcatcaacgccagctggtgggttctctgtattaagtgatgaagactgggagtcaaccctgcaggcgaatttactcgctcctgttcggctggaccggggatttttaccacagatgattgaacgaaaaagtggtgttatcattcacatcgcatcaattcagggtaaattgcctctttatgattctactttgccttacgcagctgcaaaagcagcactgagaaactacagtaaaagcttatcaaacgaagttactcctaaaggcgtccgggtcctgactgtttcaccaggctggatcaatacgacagcttcggaagcatggttgggagaaattgcaagaaacgcaaacagtactatagaagaagcgcaacagggtgtaatggatgcattgggtggaataccttttggaagacctgccgagcctgaagaaatagcggaatttgtcggcttccttgtttcaccaagagccagctatttaacaggaactgagtatgtaatcgatggcggaacagtaccaacaatttaatcatctctaaaaacagaaaatatgaatttaccaaacgtaatcgcaaagctgataaaagcacaaaacaatttcgatagcgctgcttatgcccaatgttttacagaaacagccatagttttcgatgaaggcagaatccataagggaaaagtagaaattgaaaagtggattgacaaatccaataatgaatataaagccaccatggaagcgctggattataacgaaaaagaaaatattctatcagcggaagtttcaggatcatttccgggcaatccgatcattttaaaatttcattttgaaattattgacgaaaaaattcagcagttaaaagtgacagattaagagagaatctgtatcaataaaaagagtccgttttacaaattgtgggacggactcttttttagcttaaatatgaattaagcagtatcagcctttcctatccgacctttccttctgcaaatcgaatattctttgacgtatgttaatcaggaaaccagaaacagataaaattcaaaagtctttaagcccaggaaaaatgccatccgtttacaggcaaggacttcatcagaaaactgctactttttgcgcttataccgcaattgtatcaatccggtttcaaatgtttttgaagtcataaattcaagtgcctgttcaggccggtcatctttaaaaagctttgttccgctgcctaataagatcggaattaccgaaataataaactcgtctatcagctcattcttcaacaattcatttattatttccgcaccaccgtcacaatatatattcttcccttctccggattttaaaccattaaccaattctgtaatatctcctgtatagaaagttgtcctgccttctttcggccttgctgttcttgtgataacataaatatcccgctgtccgttgtcataatgggatgagccgatttctttaagtacataatcataggtttttctcccaataataatagtatcgattccggccgtaaactccgcatagccgtaatcctcgccttctttttcaactattttcagaaagctcagatcatcattgggttttgcaatgtagccatctaagctcatcgcaatgaaaagtgataattttcgcatagattctaatttactattgaagcaaatttacttctataaaaggttctgtactttgtaaaaatgcgacacattaaagcaatgaggggacaagtccggtattccgcctgatttcattggtaagatgcgaatgatcatagtaaccacattcaaacgctatttccaataagctccggttttgatctgaatttttgatcaaactcatagtatactgaaaccttattatgtttgaatattccttaggtgataacccgatcagttttttaaaattccgttccagctgccttaccgtcgtacaatgtattttggccagctcgttaacacttatatttccattggttgaatgtatatgattaagtactttcttcagctggatatttttgtttttgagcctcgaggaaaagaactggtcaaaataagggaaaggattgtcagatgctttatcaacatcaaaggaattgaccttttcaaattcaacagtagcatttgtcaattcattttgtgaggcatagctgtaaaaatttgtaaaagtggcaggtttcagacatactcctgctaaatgggtttcgctgtcgataaaactatctttaaaagaattcatggcacccaccacataagtcttttcagattctattgtgaataaaccattatccgttaaacatttatctcccaaattgataagtataccagcgcagccatccgggaaaactctctcccactgcctctctgtctcatttcctttcaactcccaatagaaatgaataaaaggctccaattccttacaaggcttcatttttttgtactgcatgtttttttcttcagtatagttttgtaaaatttatcttactatgcaggatattacagattttacgaaacactaaccccgaaaatacggcccaccaatgctgtaattcccatagcaacagttccccagaaacaaatcctcaatactgcgattttaatatttgaacctccggctctcgctgaaattgcccccaaaagcatcagaaagatgattgaaaacccgtattggaaatacaccatttgttttataggtgccaatagagaaactacaaacggtaataaagcccctaccgcaaaagaactgaaagaagccagcgccgccagcaaaggtttagcttgtgttatttcgtttattcccagttcgtcccgggcatgtgctcccagggcatcatgttctgtaagttcaatagctacctgcatggccgtttctttggtacagcctcttttttcatacactttggctaattctctgagctctatctccggcatttgttcaagttcaagcttttcgcgcatcagatctgctttttccgtatcttcctgagaactaacggatacatattcacctgccgccatagacattgctcccgcaatcatacctgccagcgctgcaaggataatgatatgtctttcgggctctgctgccgcaactccgataacaatacttgtggtggataataacccgtcgttggctcccaatacggctgcccggagccaccctaccctgtttacataatgtttctccagctgatgatgcataactttttgttttgatagcacgttaaagttaccaaatgtttcatcaagaatcgttttaaattaagccatttcggatagggattttatattttgaaagatgtgtttccgatactgaccttatgataaaaatcaatacagaatgcataactatttttttacgaatcatgatatcactccgtttcaatacatacatttccgttttgtataacctatttatatctggggcaattcatctgcagattttccggccggctgttatccggtatatttttctctcggcgttgtttttcaagatcttcatagaatctataaagccggctttgctcagcttctgtaaggttttctatttccctgcctttatcttctttacgcgcagccatcagttcatcaagcttactctgaagcacttttatatccttattttgtgtattcctgataaaaagtacagcaagtcctgcaatacctaaaaaagcacttcctttaaaatattcccgccaatccggccatctgtctaaaatatcttttatcataacttttattttaacaatttatttaaaaacaagtcatacagattactccatatgacaggtttcaacattaatctaaatctatgcaaactagaagttcttactgctttcaattttaacaatattttttccttcttaaatttgtattgttcttatggctctttctgcacaaagtcgtttattttaaataattactgtattatacgacgattacggaatgctgtaacttgttatctcataacagattgccttcaccgctttatcataagcattaatcatctgggaaaatatacaatcaacccctatttattataatgtcccggtttattatcttaatagaattctgtactgatctccattttaaaagaattaatcctgctttacaaattcaatgactgtaaatatgataattcacttttttaatagaatctacatcataggcaagtccacccatctcacaaggttgatctgatatccgttaaactgaaaaagtcatactgtcagatgacagaattagtctgcggcctggaattctcttttgcagctaacggcaaaaggccaaccagtataatgaatttcatatttaaaaattttatggtgtgtagtttcaaatgtagtaaacatactcctaacgctttatgactcagatcatagaattccctaactgcacgttttccatcggaaaatccgattttcctatctttgcagcaatgaatttattatatatcaactgggacatcaatcccgaaatcgtcaatatcctgggaattcctatcaaatattacggattactgtttcttgcagggcttgttttgagtctaaatatcttaaaacgcatctataaaaaggaagatctcagcacgcaggcccatgaagctttattctcctatgcactgataggaattctggtgggcgccagattggggcattgtcttttttatgattttgattattattctcagcatccgcttgaaatatttttacccattcagaaaggtcccgacggaagctaccactttacaggatttgcaggtcttgccagtcatggcggcggtattggattggtcattatgcttctcatttatgcgagaaaatatactatcccattcatgaccgttctggatgcaatagccattgtacttccgttgggaggtactttcatcaggctggccaaccttatgaattctgaaattatcggagttcctactgatgttccgtgggcttttatattccgtcaggtagatgatcttccgagacatccggcacagctttatgaagcgatttcttattttattattttcctttctgtgtatttcatttacaggaagaatatctttaaaatcggaaaaggattttattttggaatcagtattctgctgatcttcattatgagaatcctgattgagtttatcaaggtagatcaggtagaatttgagcacggaatgattcttaacatgggacagcttctgagtattccatttgttcttctcggattattctttattattaaaagtatattggagaaaggaaagattaaaaccgcttgatttattattccttttaaataaaaactcactgaaagctgcttttcagtgagtttcttttttaatgaaatttacaaagtattatcttgttgtatatccaccgttggcaaagatggtctgtcctgtaatccaccagccatctgtcaccagaaattctactaaaggcgcaatatctttaatatctgtcaatcctcccaacgcagatgctgatttatgataagctacagcatcatccgtttcctgcccgtagaagaaaggagtgtccatcgggccgggagccactgcggttacagaaatacctctggctccaaactctttggaagccgctcttgtaaaatgctctaccggtgcctttgcccctgcataggtggaatacaatccggtgtaggccgccagcaatgaagtaacaatcgtacagattttcccatgatcgttcagttttttaccggcttcctgcaaaaagaagtaagcggattttgaattgacattgaacatggtatcatattctgcttctgtagtttctgaaaatgtttttttaagcaccattcctacagtattgatggcaatatcgattcctccgaaacgggtaatggtttcatcaaagaatttcgtgatatgatctactttggtaagatctccctggaataaaaatgcttctgctcccagtgcctgtacttcagccagtgttttttcgctttctgcccttgagctttcactgttgtaatgaatggccagttttgctccttttgcagcaaaatctctgcttaataatcctcctaagtttttaccgcctcccgcaattaaaacaacttttccttttacattttgtgttgacattgtttttatttttaaatgttaatgagacaaagatggatattaaaaacggcctcagcatggtgaaattttcgggaatttcattttccgatctcatacagaaaaaacatttactttttttatgtaaacaatagttgttcaatagaacgctatttaccagccagatacatcttgagagactcttgtttatttaaacaccctgctacaattcccaaaccgacgccaattttaggcataacatttgataccttcctcccgtatcacgcaccaccacttcatttttaatatatttttttataatcctcaggtttctggggatttttttataagatttttaccactttacaaatacacttatacatacagtatagcgcagcctgcaacactatttctgataatcaatcatttaaaacctgattattcattttattgttgtatatttgtagataataaaccaagtcattactttgttttctgtaacgacacgaatatttttattcagtctttgccttttgagcagccatatttttaacttttattcttctattaaagaacaatacttgtcggaattttaaagctctgtatgattggaaatatccaggacaggaaacatcagtgggctttataggtctcatgcaggccagattgaaccgattaatttatagaaactaaatactaaaaataatttatggcagattctttttctaaaaaggaaaatttcaagaaaaaaattcaaaagcaaaaagaaaaggcgctaagacgcgaagaacgtaaaacgaacaacaacaaagggaaagacatggaggatgtattcatgtatgtagatgaattcggaagattaacttctactccccctgaacaaagacaggaagtaaaccttgatgatattcaactgggtgcagctcctatcattgaagaagatccaagaaaaacaggaattgttacgttcctgagtgaaaagggatatggtttcattactgaagataacagtaaagaaaacatctttttccacaacaataactgtgcagagccggtgaaaaaaggaaacaaagtatcttttgaaaaagagaaatctcctaaaggattttctgctgttgaaatacagcttgttaaataatacatacctgtaaaaatgtttctgtgttaaaagcagatccgttttaaaccatacataaagagactgtccgcgcggacagtctcttttttagggacatataaaaaaagttaacttaacttataaaaagttagattctaacgcaatatcttagaattatttcaaatctccttacgggaacccgtagaatacagttaaaatttataaatataaaagaagctgccatttcagacagctcctctcatcgtaaaaaagtaaaaaattaatcaagttttcctcccaatgctttaaacagcaggacgttatttctggtattctgatgctggaactgtagtaaatccaattcagcggttagtttgctcttctgggaattgatcagctcaaaataatttgcatagcccgtcagatacagatcattggaaacctcaacaccgcggtcaaggaaacctacttcttctgatttcagcttcaaaacacgttcataaattttagtttgttttaaaatagactgaagttcattaaaagcagtcgttatgcttttctgatagtttaaaaaagcaatttcctgctctttgctggctactttaaattcatatttcaactgtcctttattaaaaacaggaaccatcaaccctcccaacagctgtccggccagtgaacctggcttaaagaatgtttccacagaaaaagaattcaggccgaaaccggctcccagatcaattttgggataaaaagcagctcttgccgcctgtgcatcagcctgggaagcttccaagacatagtaatttgctgctacatccggcctggaatggataacattttctacattaatggttttatttaaaacatccatattggtaggcattaataccttacctcgtttcacctctccgccatagctacctgtcaaagttgtgatcgcctgttctacggtaacgatttccacgcgaatgtgctcaatctctgcgagccagttattattctgtgccttgaactgctgtactgccaattcggtagctttacctacttcacgctgagccagaacaatttcaaaggccctttgctgaaggttgtagttcttctgataaatagcaagacgattgtctaaagccaccagctgataatacagattggcaatatcagtgaaaagctctacctgcagtaacctcaaaccttctgttgaagccagatatttcttctgggcagctatctttttatttttcaactttccccatgcatcaatttcccagctgcttctcgctcccagccagtaatttggtgtaaaatccctgttaattttctgatcttccgtaatattgggtgaaagattagtatcatagttaccaaccccttccatggtatattttccataacggttaccggaagcttctattccgacttcaagggagggcaacaggtccatttttgatctttgcagaaaactgttggcaatctctactctttgctgtgcaatctggaaatccggatttgcctgcaccaccttatcaaaaagctcaagcagataaggatccgtaaaataagccttcagattgatctgctggaattcatccgggtttttatttttatctgttttgataatctcgtcaggtagttgctgagcttttttcagctccgttactttgggaacagcacacgaaaccaggctcagtgataccattccatacaatatatttctatgatttaatcttttcatctttcttcttattttcaagttttgcaaagaatatatacagtcccggaatcaccaccagtccgaagatcgttccaatcagcattcctccggcggccgctgttccaatagaacggttaccgattgccccggctccggatgctatacataaaggaataagtccggcaacgaaggcaaaggaggtcatcagaattggtctaagacgctgtcttgctccttcaatggctgccggaatgatatcaaatccctgtttatttcttgccacggcaaattccacgatcaggatggcatttttagctaaaagtccgatcagcatgaccaaggctacctgtgcataaatattgttatccagccctgcagcaaccaatgcgatataagaaccgaaaattcccgtcggaaggcttaatagtaccggcatcggaagaaggaaactttcatactgtgcggccagcaacagatacacaaacaatagacagatggcgaagatataaacggtctggtttcctgataagatttcttcccttgtcattcctgaccattcaatgtcaaatcctcttggcaaagattctttggctacacgttctacagctgcaatggcatctccggagctataaccatctgctggttcaccgttgatcatagcagacatatacatattgtaccttgtaagtacttcagggccgtagaccttctcaatagtaatgaaagtggagaaaggaaccatttcacccttatcattttttaaatataaattcaaaatgctttcaggagtatccctgtgctccggacttgcctgcaccatcactttatacatctggctgaaacggataaaattcgtagcgtaataagatcccagcatggtctgcagcgtagacatggcattgtccaccgatactcctttttttgctgccatatcataatctatattgatcatatattgcgggaaagtagcatcaaaactggtaaaactgttctgcagttcgggcgcttcattgagttttttaacaaaatccttagtgatcttgtctgtattttcaatagttcctccggttctgtccagcagacgcaattcaaaaccactggtatttccgaatccgggaacggttggtggtgcaaagatctcaatctgggcatctgctatgccctttgttttatctgaaagttctgaaatcagatcatttactgaaatatttctttctttccagtctttaaggttgatcatcgccattccgtaagatgaacctgcgatctctgttacgatactgtaacctgcaagcgtggtcacgttttcgactcctttgatcttcttggcgatcactgtcacttcgtccagtactttttctgttctttctacggttgctccctgcggagtggtaacacttacataaaccatcccctggtcttccatcgggataaaccctgttggcaggaatttactggtcacaaaggtcagtgcgatgaataagaacaacagtccgaaagtcactgtagttcttgtagcaaattttgacaaaatgcctacataaccattcgtcagtctttcaaatcctgtattgaaactctggaaagccctgtcaatgattgtcttcttcttatgatggtcatgaggttttaaaataattgcacaaagcgccggagtaagtgtcaacgcattcacccctgaaatcacaatactgatagccaatgttaatgaaaactgacggtaaaatactccaacaggcccatccaggaaagcaacaggaataaatacggcagacattacgatcgtaatcgctactacggctccggcaatttctttggtggcactgatggttgcatccagagcattcattccttcttccattttcacatggacagcttcaacgacgacaatggcattgtcaaccacaataccgatcgcaagaactaatgcaaacagcgttaaaagattgacagagaaatcaagcatatccatgaatgcaaaagttcctaccaacgccactggcacagctagcacaggaattaatgtggaacgccagtcctgcaggaagataaataccacaattcctaccagaataaaagcttcaataagggttgtcaataccgcactgatggaagcatcaaggaatcgggaaacatcataagccatgttatattccattcccggcgggaaggaggtgactttcaattcttccatttttgcctttacactttcgattacttcagaagcattggaacttggacgctgtttcatcatgattgatgcagagggtcttccgtctgttttggaaaccattccgtagttcatcgccccgaattcaactttggcaatatctttaagctttaaaatggttccatccacatcagaccggatcggaacttcttcatattgttttggctcaaaaaactttcctttatatttgataacatactgaagctggcttgaggttttaccagaggtttcacctacttttccgggtgctgcggaaatattctgcttttgcagggaagtaattacttcgtcagctgaaatattataagcagccattttctgcggatccagccatactctcatcgagtattctttctgtcccatgatctctgcacgtcctactccatcaatacgtttcaactcctgaaggacgttaatatccgtaaagttatagatgaactgctcatcctggctgggatccgtactggtgatattaaggtacatcagcatactgttcacctctttttcagtagttaccccggctctgatcacctcttcaggaagctcatccagaatagtggttaccctgttctgaacgtttactgctgccacatcaggatctgttcctacttcaaagaacacctgaataagggtaagcccgtcattggaggttaccgtagacatatatgtcatccccggaactccattgatcgctcgttccagaggaagagctaccgcattggcagacacttcagcattcgctcctgtatattttgctgtaacggttacagaaggcggtacaatatcgggaaactgggtgatcggcattttgagcaacgccataattcccagcaatacaaataatatggaaataaccaacgaaagaacctttcgtcttataaacatttctaccattgatttaaagattatgaaaggttaatacttctttttgattttgataatatcaccgtctttcaaagactgtgttccttcataaatgattaaatctccttttttaagaccgctttccaccatataagaatctcttaaggtagtcccaatcttaatgctggtcattttcactttattctgcttatccactacaaaaacataggtcttatcctggatggagaaggtagatttctgtggaataaggattgcgttattctgctgttcggaaataataagctttccggaagtaccgtgcttgatcagacggtccggattcgggaaaagtactttataccggatagagcctgtagttctgtcgatctctccttcagctgtttttaaagcaccgttgaactgataattggctccattaggcagtgtcagttcaatcttctgatgattcccgattttatcattagccaaaagctcaaaatacaggttttcaggaatcgaaaagtaagcatatacttcgttcaattgggaaagtgtggtcaataatgttccgttttccactaaactaccgtccttatggggaatcacatcaattaccccgtcaaaaggtgctgtgatttttgtaaagcttattttctgaagaactgctcttttttcagcatcagcaaaggcatgttttgctttcgcggaagacagttttgcctttaccatttccagctcgttattggctacaaatttcttagcatgaaggctctgaatctgcttcaattctacttctgcaatgcggacatctgcttcagtctgttttaaagcggcattcgctttcaaaagctccatttgcaattcagcatcattgattttgaataaagcctgcccctgatgtacaaactgtccctcgttgacataaatatgctgtataatacctccgattctggaacgcatttcaacattctttttagcctggatatctgtgacaaactggttgctcaccaatgtatctttttctttgatttccagtacgggaacttctttttctttctgattgtttttttccttgtctttactgcatgacacagcgaataatgttgcaagaatgcaaattattacgtttttacaatacatttttaaatgtttaaattataagatttccgttaaaagtgatctggctttcagaaatttaaacttagtacagctggaggagatggagaaaggatttaaccccgcagataatggaaactgcaatttccggaagagcaattttcggaataacttttaatatccctgaaaagtctgccactgcagaatcattttttctaactgagtgttttacaatttttgaagcagcaggcagcgcatgcgtgttcatatctgcttcttcataaacatccagaacgtgaatgtttgttacaggaggaacgtgaggaatattctgcaacgatttttctgcccagttcgaattgaaaagggaaaaaaccagtatgatataaaataagaaaaatgacctcagacctgccatgtcaatcagaatactttagtttttcagtaaaaacgatagtgttgcaaaaatagagatttttgtgggaaaatccagtcacagaactgttaaaaaaacttaaacaatggatgaataattctacttattcgtgtcgggattcctaaggaatgacaagtagaccgcgaagtctattcatgcagtctgttattttgaagcaatctaacttctaaaattccggatgaaaaatggcattaagtttcggctaaaaccaatggaattttggttatcatttttaaacgggctaaagcccgtttctattgcatcattaaattgtatactaaaacaattttctgagaactctgaaacgataatcaaagatatattccagtttctttctgacgaaaaggcgatgggcaatctcacctaaaaaacccataggaagttcataatttatagtatctctcatcaaaacgccttcttcattaggaataaattcatgatggtggttccacagcttgtagggaccttttttttgaaaatctatgaaacttttctgaaaatctacgtgggtgatctcagtctgccatttcatcttgatcccgaataggggcgaaacataataatcgatgagcattccttcatagatttcatcatcttccattttcgtcaatacaataaagcccatgtctttcggagtgatttctgaaagattgttggctgaggaaaagaatttccacgccgtttctatatcacagttgagctgttgttcacggaaaagtgtatgtttcataaaacggaatcagttaacctaagtgttatgaaacaaaggtataacaaagatttaattatagatccacattaataccggttttccggatttctgaatcatcggatctatttccttcattgccttgttcgatacggttggacagccccagccttccggtgagccttttggaaacacctcttcatcactcatcagattccaggaatgaaagacgatatacctttttaaagcattgctgttggtttcttcaaggccgtgcatcaggtattttacattgataccccactcgctgtaccctcttccttccagtttatatttccctaaagaagacagatggcttccatcttcattactgaatccgggattggctttagaatcatctttgctccatgcattggaaccgcagccatggcctacgagatatttttttgaaattttattgtttttaaaatcccagacaaaaaaacggttaaccccggaatgaaggctcatatcaatcagaatgcagaaatctttgctgagattttttgaatcacagaatttcaatgcttcttccgctttactttttattttggaaagattggcttcaggcttcttttcagcaacaacaggggtatcaaccgtctgtattgtatttctgtttttttcctgaaagcatgaacacatccaaaaaacaacaaaaaacagataaattctcttcatgaattatttatagtgctgaaaaattccaaaatctgtaggtgtccaaagtgccgctttttgtccggcagcctttaaagcgttatttgaccaagtattacaggtgtaaagaaaactataagttcctttggcatcataaaaggcatcattatcaccatataccgcattggttggaattaatatgaagttaccgttctgatctctgtcaaacttatcttctacatatttcaccaggttttcatactgccctctgctgatcataatcatcttacaatcttcaccttccttcattgtattatagtaagtacaatgcatggcagaatcacttaaccagaaggctgctttaacggctgtagaaaacttaaggtcagcccaggtaggggtatccagataaaaacctttgtctccccatcctattcctacatactgatagtctgttttttttgatttcgtattggcaaagggaattttccggctccagtcctgaagatcgtttttcaccggcattactatatctgtatgcactccattggtataaatatagatcgggacttctttcttctgtccgtcatcttttgctgaaacaggaatataaggaatcagcagtccaaggattacataaataatcacaattcccaaaataatgcccaccactttcaggagatacattaagatcattttcacagtcatgttttttaataaaatttaatctgcaatttttggtaaaagtatttgttttaatcgaaaaaatggctatatttagttacgaaatattcagaaatatgcgtaaaaataccaaatcccaaaaaagatttaaaataagagtaaaaactgctcctaaaagaatacaaaaaagacgttgattttcggtgagatcctaatctcctgaaaatcaatttttctttataggaaaagcttttcaagaaacttattgatgtaaatctttacctccttaaagcggaaagtttaaggaatggtcggttatcagctctggtttggaaattcaaaaaattccaaaggaggaattgtcaccgaaagttccgggaaaaatcagtccgaagacttctgtaaaaactcaatatttctcttgagccctgcaaatttggtacgtttcacgggagattttctgaaaatttcggagaaaatttcctgagtaagctctttccattctccttttttgaagtttttcaacgcttcgttgggctgaaagcggctttgtttattaggcgctgagaaacggttccaagggcaaacgtcctggcatatatcacagccgaacatccagtcttccattttatctttaaaatagtcgggaatttcgcttttgagttctatagttgcataagaaatacatcggcttccgtcaataattttttcagaaactatagcatccgtcgggcatgcatctatacattttctgcaggttccgcaatggtctgtggtggcatgatcaggaatcagttcaagatcacagataatttctgccagaaagtagaaagaaccattttgtttggtaataagattggcatttttccctacccagccaattcctgattttctggcccagcttcgttccaacaccggtgcagaatcaacaaaaacccggaatccaaactctcctatttcttcctgcagctctgctaccatctcacggagaatttctttgattacttcatgataatcttctgcataagcatattttgagattttataattctcaagaattgaaattttctcctcgggaaagtaattgtaagaaagtgaaattacagatctggatccttccaccagaagacgcggatcaagtcttttgtcgaaatgattttccatatatttcatttcgccattatagttattcttcagccatttttcaagatgaggggcatcttcctccagaaaatctgctttggaaataccacaactctggaatccaaaactttttgccttggattttatcagttgggaatatttttcggcgccagcattcattaatttcacaatgcaaaattaagattattttatcaatctgatcattgacaccgaagttcggcttacagttggcttcaggtctcctattttctgaaaatttatattttaattaggatttttttcaaaaaaaaattgcgtaatttcgtttctgattttaaaataaacaactatgtctttaatagaagtaatacaatccggaaactatgaattgatcgacgttcgtgagccaatggagcttgaaatggacggcagcatagatggagcaaagaatattcctctgggtgaagtagaagatagacaagatgaaatcctatctattgaaaagccggttatcttattctgcagaagtggaaacagaagcggaaaagcattggattatcttaacgctcaaggattaaaggacggttataacggcggaggctgggctgagctgaaggctgttctggaagcaaatcagggaactttttaaaagttcctttttttatatctttatttctatgaatctgaaaactcgatttgaacagctatgttctccttttacagtagacagacagctaatccacaatctctggaatgaaattgaaaccaggtattctgaaaaaggcaggtattaccacaatcttcttcatcttgaaaatatgtttacggagcttgaagatgtgaaaggtaatatttcagatttcacagggatttctttctccatattttatcacgacatcatctatgatgccacatcgaaatccaatgaagaaaaaagtgcagctactgcagaaaaaagacttgctgagctgcatctaagtaaagatgatatttcagtgatttcggaacagattattgctacgaaatcccatcagctgtctgatcataacgataccaattatcttctggatgctgatctttctgtgctgggtaaagattttaaaacttatatggaatacacccggaatataagaaaagagtattctatttatcctgattttctttataaaccgggacgaaaaaaagtccttaaacatctccttgaacttgaaagtatttttaaaactgaatattttaaggaaaaatatgaggttcaggcaaaagagaatattgaagctgaactccggttactgtaactgcaaaatgcaagatccggttttgtataaaacaaagacatcttagtgataagatgtcttctttttatattgttgacagattatgagtatttaccgataaattctgccgctttccccaatacaagctcaggaacttctttatgcggtgtatgtccgatattgggaataatgtatttctcagcacttccactcacctgagtaacggttttttccacctgatccaatgttccatattcgtctgcttctccctggataaataataatggagctgtaatctctttcaggagatattcaatattccaggttctgtaatcatcccttgtccaggtttctgtccatgctttgaatagtgtttctaccttatcagcatgatacttctgtagccgctcaggaagatttgttgttttgtaggcttcccatgcatcataaacaccttttaaagtaatgtcttccacaaaaatatgtccggcttcacaaataacagcttttattctttcgggatattttgcagctgtgatcagagctatcgtcccaccatcgctgtgcccgaacagaataacgttatcaatattcatttcagccagaaggtcattcagcaaatcggcttccaactccatataatttaccggtctttcatgtgtgaacatggggtatgattttccatatcccaaacggtcataagcaagagtattgcactgcacggcttcagcaagctttaccggaaaatctctccaaagctgcacggagcctaatgaatcatgcagaaaaacaattgtgggcttgtctttaaactgattattgtgttctatatataattttttgtcctttacatcaattattcttccctccattgaatacaattatatttaaaacgttggcatttttgtttcttcaaattcttttaaaagatgattgaagacagtttccaccggaagaatctcatcaattaaagctgaaacctggcctatttcgagttctccgtcttccatatctccttcaaacattccgcgctttgctctggctcttcctaatgaagcgattaaagcatctttgtttctaccgctctggtagatttcttccagctcattaaagaatttatttttaaccattcttaccggtgccagttcttttagggtaagatgtgtatctccttcctgaagttccgtgattttctttttccagttttcatgagcgctcgcttctgtagtggcagcaaaacgggaaccgatctgcacaccgtctgcaccaagaatcattgcagctttgatctgtgaaccaagggcaatgcctcctgcagcaattaacggcttagaaatatgttttttaacattgggaataagacagaatgttgttgtttcatctcttccgttgtggcctcctgcctcgaaaccttccgcaacaatagcatccactccggcatcttcacattttacagcaaatttggtagaggaaactacgtgagctacttttattccttctttctgaagagtctctgtataggtcttagggttaccggctgatgtaaagacaatcttcactttttcttcaagaatgatctgaatgatttcttcaatattgggatacagcataggtacattcaccccgaaaggtttatctgttgcctgtttgcatttctgaatattttctctgaggatatcaggatacatacttcctgctcctatgatacccaatccgccacagttggaaacagccgaagcaagtctccatcctgaatgccagatcatgcctgcctggataatcggatatttaatattaaaaagtgtcgaaattttattttgagttgcctccatctcatgaagtttttttgcagcgttgaaatctataaaattgctcatgcgtaaaaataataaaaacaatggttttccgggaaatatctgtcaatattttccatggtggattttagtctttataaagtttaatgataaaaaaaaccttcagaaattctgaaggttttaattttattttgtcaaggattgtttcttccagttagacttaaagttacagctgtcgtaacgtccgtcaattgaaataaaagttgtcggtaacttggagttgacaaacttttcaaccatttcgcttttctttttattcagcgccatttgtttgattctgctgaagtctgtttccagcgtaatctggtgagaaggaatcacatcttcaattttgatgatcttgatttgctttctcttgttttcttcgtcttcaaaagcagttgtgatatctcctttgttcaatccagccaattcatagctgattgttcccgggatactttctctttcaattttatcagaaccatcagctcccggaattactccagcattgaattttgttcttttatcatctgagaatttaaaagcagcatctttgaatgtcattttaccatcaataataagacctctgatactgtctaattttgcttttgctgttttgatctcttcatctgttggtgtagcttttagcaagatatgtcttgcatcatacactttacctgatcttttcaccaactgaataatgtggaatccgaattcagattcaacaggatctgaaatttcattttcctgaaggttcaatgctgcagcctcgaatggctttaccatctgtcctttgttgatatttttatataatcctccgttagcagctgatccttcatcttcagaataaattcttgcctggctttcaaaagtttccccggcaaggatatcctgcttgatttttttcaacctgttgataagatcttgtttgtgagcttctgtaagggatggataaatcataatctgagccagagtaacttcgtcttttacctgtggcaactgtgttttatacatattgtagaaatcagttacctcattcggggttacgtctgctttatcggtaactctctggtactttgcctgcccgtagtactggtctgtgtctatcttttcgatagcatttttcatctcataagcatttctgaacttataagcggccagcaatgttttttcatccggaaattgagaaagcaactgacggtatttagcattagcctgttctttgatggctgcagaacggttttcaattaaggtatctttttttgcttcgtatacaagaagcttattgctgataaggttttccaggaactcacatttgtctgtgttggcagctccctgctgtttaccataattcatctgctcgattacatcagattccaatacaatctcatctccgataacagctgcaataccatccaccaaatctccttgttttagctgggcattcatcatatttgaagagaatatcatgatgaaaatcccaagaagaaaagtgatttttagtttatttgtcattttactattttaacaagttgcaaatttagaattcttaacgaatttcactcaattttttattataaatatttcttaaaaagacttatttactgcagttcaacatcaaatgtcgttaattctttgaattgtctcaatctgctgaacatatctgcttcatttacttcttctattctttctgttccgaatttctctacggtgaatgaagccattgcagatcctacgataagggcagacttcattgtttcgaaatcaatttttccttttttagcaagataggctgcgaaacctccggcgaaagtatctccggctcctgtaggatcgaaaacatcttccaatggaagcgcagggatagcaaatactttattgtcatggaaaagtaaagctccgtgctctccttttttgatgataacgtattcaggacccattgtgtggatctttttagctgcttttactaaagaatattctcctgaaagctgccttgcctcttcatcattgatggtgattacgtctgttttggcaatcatatccatcagaatatcccatgcagaatccatccagaaattcatggtatcaaggataaccagcttaggacgcttgttcattttttcaagtacagataactgaactccagggtgtaggtttccaagtaacaaaatttcggcatcctgcattgaatcagggatttttggatcaaaattttccagaacattgacttctgtagccaaagtatctcttgtattcagatcgttgtggtattttccggaccagaagaatgtttttccttcttttacgatttcaattccttcaatgtttacatctctgttggtgaacatatcaagatgttcctgtggaaagtctcctcctactacagaaacaattccggatttaacgcctaaaattgatgaagtgatcccgatataagtggctgcacctcctaaaattttgtccgttttaccaaatggtgtttcaattgcatcaaatgcaacacttcctacaactaaaagtttcatatatttttcaatgtatattaaaagtaaattattttttccattcaaaagtgtccagcaggtgtttcatatcatttttgatatagttcaccgcaggggcaagagagtccggtttcggtctcgtgttaaagtataagtaagcagttacgaagtgtttcgtactgtctgtaatgtagaattgaagattggaagcactttgtcctttcagctcatagaaattcccatatactttcttttcaggatattcaaaggatttcgtatctatggaactggctttgatggtatgctcatataccattttctcagcttctttaatatggtctgcgaagtcgttctgtatcggataataagtaacgaaaattttggctttcatttttgggtagttcaggtagaaccagcaaggctttttggctggcgctatggaagcaaagtccgaatactcgaaggtataggcacaatcgttttcaaacttctggtatttcggtgcaggatattccagacgcaattctccataaggttttggtgaagggtcttttccacatgaaattaaaagcagcgatacaaaaataaaaatgacttttttaatcattttgcaaaagtacaaattagatttcagatttaagaagacaaatttcagtctttcagagcgttttgaatgtaaatttccagaggcttcggaaaggatttttcatgagagccatcaagatctgtaatcaggtattgattttcagcgataaaatcactccatactttttctgaagtgacctcaacattccatatttcaatgcttaaatttttgtgggtcagtttatgggtaatggtttttgaacctgtaataaatggttccatatcagaaggaatagctgccggaaattcaaacagtttcttccagataaagtcgtctgctctctgacggatcaggaacttgccgtttctttgtacaaaataataggtcagagcaagatctccggcttttactttttttgtttttaccggataatctgaaattttctgcagggaaaatgccaggcagtcttcattgagaggacattctccacaaagtggatttttgggcttacaaatttctgaacctaagtccatcatagcctgattaaaatctcctacattttccggcataaccaaagctgccagctcagagaaataggtaaacgctcttgaatttgaaatatcgaaatcatcagcaaaaagacggctcaggacacggtagaaattcccgtcaacggcaggcattcttcctccgaaacaaatgcttgaaacagctgcagcagtatattttcctacccctttcagttttaaaatttcttcatattggtgaggaaaaactccctgataatcattcatgatctgttgtgcagccttatggatattgattgctcttgaataataccccaatcctttccaatacagtaaaacttcgttttcttcagcttctgccaacgtttttacatcgggaaatcttttaatgaaattattataatgattcagtccctgattaatccttgtctgctgaaatacaatttcacagatccagatcttatacggatcttttgtctgtctgaaaggcagatctcttgcattattcctgtaccattccaaaagccggttccctatatgaagaaactctgaagctgttttatttttttccaaaaaccaatcttgttttaaatcattgaagagattgtttctcttcatcttattttcagtgctgcaaagataggtttattttattttttctttacattgtataccggagcagcttttaaccactgatatttaagatttctgtcttttgcaataaagcggtatccttcaagctttttcagataaacatacatagaatctgtattttttatctttagtttatattctgataaaaacagcattggcatttctacagcagaatctcttactgttttcaatacttttcctgattttactttataaagaaagaatgatttcccacgccctttggagctgtccgagagcttaacctctgaacttgcaatcaccagttcactgccatcaaagcattcatcttcattcatgacatatgcttttccttcctggtgttcatctgcaaaaagatcgttttcgtaatgacccggactttggtattttttttcacagcttatcataagtaccatcagcagagccggcaagacaaagatcagcttcttattcatattacatttcataggtgttggttgaaaaaaaaccgatgtaaaattgcatcggtttttgttatataaagtaagtttaattttactcctgagtatattctgcatcccattcgttaccatcatctcctttgtgtccgtcaagtttaataacgaaactttttgtagggaaataaggtgtcatacggatatccagccatactctatctttgtttactctgtcctgctcgaaacgaacaattttgaatttctcgatcagcttgtccggtcctttgatattatccaggaacgttacaatctgtcttcttaaatcgtcttcgtttttagcattccagttttcgaaagctcttctgtttaggaagtcaagcaatactttggttacatagtcgaatacacgaactacagaatacgtctgaagaccgatattgtctcctgtaaacaatgtctttgcagagaaagccataatttttccgtattcgtttaccattggtactagacccattttttccaactgagaaatttcacttttcttcaattcaaattttacagcgtctacttcgttgatattaccatgttttttacctgctgctacctgagacatcagtgttttatgaatttttcctgctaatgaagtggaaggcggaagttctacgttttcctcttctcctacttcttctgctttgccacgtcctaccagccagttacatgtcatgataacgttacttctgtgaagttcacctcctgtaaggttagcagagtggaataagtctacaacgtcatccggtttatcaaggttggcgaagtctgtaaccatcattactttgttttcgttacagatttttgcccatttctcaattaccttatttgatcctaaatatcctggtattgcaaggattgaatagttatctctaaggtcaagacggtcgtaataatttttgaattcttctgaaatggcatcaatgaacaaaggattatccagatcggaaacctgttcaaggcttgcattgacgatacttacgttatccactttatccaattctgtatttttatagaattgcgctactgttctgtagttggtttccagcatacgaacagcgtccagtgtattttttaagttcttttttaagttctgatcggcctgttgtgctttggttttgcacgtttcagccattttatctgctgattcattaccctctaaaaggcttacccaaagattgatcttctgaagaagttcttttctttcttctgctttattgctgtcattcaggaagatttcttttcttgcctttcttgttgggttcatattggcaataccgtctacaacggattcaacaaagccaaatcctcccattttattgagctctgcaagcgggttgcccttcggctgccctgcgtgttgctgctgcccctgctgctggctttcttgtgcctgtaatttgctatccatgatttaatgtaagtctttaattatttttcaagttcttgtgccacttctttcaatacttctatgaacgccgctcttgtctgatcgttctccagcatattgcgtagaattttgttggttttcagctgacgtactattttattgtactgctcctgctccatgctcagctgctgcagataatctgatttctgagtaaggcttttgggagtaaagtctccaaggttttgaaaacggaattcttcttctaccactccaccatcttctgtttcgtgctgtaccgatactgaaggctggaaatgtctgaaaacgtcttccactgtttttaatcctgttacgatttcaggggtataagactcttctgttgtaagttggcttactatcagtgatttattttcctgtatttcctgaatagcttcattagcgtctacttttacctcgtttccgccaacaccataattaaacattgccatattattgttattttgagatttactattttggtttggatctgtctttgagtaatttacagatgaatcgaataaattaccaatccaatgtttaaatttaaaaaaaaactgtaacatacaaaattttactaagatttttcttgaatcatgtaaatttataaatatttattcaacataaaatcaccacattacgatatcactaagctatgaaaaaataaataaactcattcaagaaaaataaaataaaatttctgtctgctttattccctgcaaatgtaccaaatgaatattaaaataagaattccttaagctttacaaaaaatattctttatatttaaacaaagtgaaccttgtcatgaaagatgtaaaaatagcgtttagaaagcccatatttcctgtttcagaagcattacatcaatatctggaaaaatacaacagaaccaccaagatcaaattcctgtatgaagatctgctgaggttcagtgacagtgtgaacattctggataaagacggcaaagatacgttgtggcttggagtaatgtattctgaatttgagtttaaagaaatagaagccaacttaaataaaatttataccctactccattctgacggggatacggctacgctaccttatctgacagtagatacgatcgatttttgtactttcggaaattcaaaacctttccggatccgggtgagaaatgtactgaatgataattatacttatttttatattaaacaggcggatgcctcacgaatattcggattggagtttgaagacctgctttctcccaaccggattaattttctggtgtacaaaaacacgttgatagaagagcatattttaggaattccgggagatgtttttattcaaaagcatttatccagctgttccgaactggaaaaggcacagatctccaaagaatttgtaaaattcaatgaacgctgtcttatcggacttcttggtgatatgcgctcttataattatgtggttattcccatacatgatttcgaccaggttatttacagaatccgtcccattgattttgatcagcagacttatgaaggaaatctgaaagtctatcttccacagtatttcaaagaaaacaatcagatggtgaacatggtactggaaaaactgaagccaagctctattgaacagtaccgtaaagaagtacgttcccagattgtaaaaagggtgaccagcagcaaaacccggtttgatgaacttatttctattatgaagaaagataatattgcacctgaagctaatgtcatcgagttaagaacagctttgcaaaagcttacctatgatgttaatttcaagtactgtaaaaccatgggtgacattatggaaaccggaatcaagtttgtgctccggaattataaaagagaatactaaaagaaaatccatctcaagcaatatgaaatggatctttcttttctaacaatttaaggtaaaattaccagatttttattctgtcctgaggagctttatacattttatctcccggtttgatatcaaatgctttgatgaatgagtcctggtttaccaacggaccgaaagccctgaacattcccggagagtgcggatctgttttcacctgattgatcatatactgatcggtagcttttgttctccaaaccgtggcccagctcatgaaaaacctctgatcctgcgtgaatccgctaatttttccagggtttccgtgatctttcaggtacatctggagcgcatcataagctacagctactcctcctaaatctccaatattttcaccacttgtgaatttaccgtttacgaaacttccttttacgggttcataagcactatactgagctgcaagttgtcctactttggcatcaaagtttttacggtcagcatccgtccaccagttattaaggttaccatctccatcgaaacgggaaccactgtcgtcaaatccgtgagaaatttcgtgaccgataacggctccgattcccccgaagttcaccgctgcatcagctttgggattatagaaaggcggctgaagaatagctgcagggaatacaatttcattgtttgatccgctgtagtaagcattcaccgtttgcggagacattccccattctgttttatcgaccggttttcctactttatccagacttctctgatactgccatgctgccacattctgaagattagagtataaagttgctccttctttcggagattctactttcagctggctataatctttccatttgtccggataagcaatttttacggtaaacttggataatttttcctgagcttttactttggtttcaggagacatccaatcgatattggcgatgtgtgttttgaatgattttaaaagataatcaatataggtttccatctgctttttagcttcaggagtgaagtatttgtctacatacagtttcccaaaagcttctccaagaacaccatttacaagggtaagccctctcttgttcatcggacgttgttctttttgcccctgtaaatatttcgcatagaaatcgaatctgatctgctctaagctgtcatcaagattgcttgcattcccgttgataatgtggtatttcagataatctttcaataatggaaggtttttctgagtaacgaactgatccatattctggtaatatttcagttctccgatgattactctgtctgtatttacgcctgcatctttaagatattttgcaaggtctacatttttaactagtcctgatagttctgatacatttttaggattgtatcttaaattagcatctctgttctgttcaagcgttaataagtaattggcaagctgcttttcaaagtctactacattctgcgcagcctgagtattatttttatatcctaaaacaccgaacagttttccaacataggtctgatattcggccaatgttttggtattggcatcatttactttctggtaatagtctcttcccaggccaagatccggaccaccaagatacactgcattcatgttggaattcttcatatctgctcccactctccatccgtagaaagaattatctcctaatcttgtagcttccaacaggtatttctgaagatcgccaagagttttaatagcatctactttggcaagatcagctttaattggtgtcagaccttctgcatttcttttattggtatccataaaagacgcatataaattctgaattttctgtccttctgatcctgcaggatatgattctgtaagaattttatttaaaatatctaatgaagcatcatctacattttctctcaatgcattgaaagaaccccagttggctttatctgaagggatctgagtagttttcacccagtttccattcacatagctaaaaaagtcatcctgtgggcggacacttgtatccatatatgataaggtgatcccctcttctttcacttcttctttcaccggctcagccacttttgctgtagcttcagttttattctctgtccctgcagtcttagctgcaccacacgaattgagaaatacaatacctgaaagggcaagtattccaatatttagctttttcattaaagataatttttgattttacacaaacttatcaaatatacaaactttaatgatatgtaatgaatggtaattgataattcagggtttaatgtttagagccaccccagcaaaatttttttgaatttttgctacccctccgagggagggaatgatggaagccgttatgacaaaatataagtcagctgatcaaccctaatccctaacttctatcatctactctccaccaccttaaaaaaacaaaaccgcccattgctgagcggttgttatttttaccagattttgattctgtcttccggagctttgtataatttgtctccttttttcacgtcaaatgctttgtagaaagcgtcaacgttgataagcggaccaaaacttctgaaatatccaggagaatgcggatcagttttcacctgattcaccatatatttctcgcttgataatgttctccaaaccgttgcccagcttaggaagaatctctgatcctgagtgaatccactgattttccctgggtttcctttgtctttcagatacatttgaagggcatcataagcgatgtttaccccacctaagtcagcgatattttctccgtttgtgaaagttccgtttacaaaagttccttttacaggctcgtatttatcatactgagaagcaagggcctttgttgctttttcgaagtttgctttatcttccggagtccaccagtctactaagttaccgtctgcatcgaactgtgcacctgaatcatcaaatccatggctcatttcgtgaccgataacagcaccgatacctccaaagtttacggcagcatcagcattcggattgaagaacggcggctgaaggatcgctgcagggaatacgatttcgttatttaccgggttgtaatatgcattaacagtctgtggagtcattccccattctgttttatcaaccggcttgcctattttagctaaatctttgttatactgccattccgtaatattctgaaggttcttgtaaagacttcctcctttagcttcagaaatgatatctaattttgaataatctttccatttatcaggataagcaacttttacagtaaacttgttcagtttctgcattgctttttctttagtggtagaagacatccatgttaagttattgatatgaacagcgaaacttttctttaaatagtcaatcagttccaccatctgagcttttgcttcagcagggaaatatttctcaacatatagttttccgaaagcttctcccaaagtaccgttgatcaactcaaaacctcttttgttaagagctctctgctcctgctgacctctaaggtatttgccatagaaagcaaacttcatgtttcctaagttttcacttaagtaagaagcacttccatgaatcatgtggaatttcaggtaatctttgatcacagaaagatcctgagcattgatcaatttatcaaagttcttatagaatcctaattcgctgataattaccttgtcagtatttactcctacttttttaagatattcagggatatttactccttttaccaacgctgaaagttcagccattgttttaggattgtactgaagggtattgtcacggctctgctcattggtcaggtatgtattggcgatacttttttcaaagttaacaataccttttgcagcctcatcagcatttttatatcctaattcttttagcattgaagctacatatttctgatattcagcgatagcttcagtatttttttcatttactttctgatagtagtctcttcctaaacctaaagtagggtttcctaaataaacagcgttcattttagaatctttaagatctgcatcaactccccatccgtaaagaatgttttcaccatctttggttacagaagtcaggtaattctgaaggtcagccatatttttaatggcatcaattttattcaggttatcctggataggtttgattccgtctgcatttctcttctgcatgttcatataagtagcatacaggtcctgaatctttttaccttcgcttccgtcagcaaatttatctttcaaaagggagttcaggatggtcatggaattgttatccgtatcctcagcaagtttgttgaagcttccccatgttggtttgtcagatggaattttggctgttttcatccaggttccactcacatagttgtaaaagtcatcctgcggacgaactgaagtgtccatcaggctaaggtctaaacctttgtctgtgttattcactgctactttagcagctttagcttgtgcgctcatagtcgtttgagtgcagatccctgctattaaaaacaaagaaagcgttatttttttcattatgataacaatttatagaatatgtatgatttattttgaatttgttacttttcagaaaaacaaatttaaataaataagttggaagccggaggatggaagctggaagttataaaagtgataaagaatagtaatactatctctacaatgagtccctgcttattcttctcacctccggctttatctaagaagttgctatctcttttacatttccggttcttttcagaaatccccaggactgcatttcgcctttcaatgcttttcttaaacttttaaataatacgatatacatcagccatctatacccgaatctctgcggaataatatacaggagattgatcagtttttcacgctgcatgatgaatgcaatcaaagctaaggaagcatccaccaaaaggaagatcagataataggtaaatattttatctccgtttccggacaggattccaaagaacataatcacatctgccaatggcgagaaaaatggtataatatattggaatagtaaaatattcggcattgcccaaagtcccaatcctttatatctggggttaaggaaagtctgtctttgtttccagaacatctgcatgataccatatgtccagcggaaacgctgttttaaaaactgttttacggtttccggagcttcggttaccgcaacagctctgttttcgttggctactgtatatccggctttcaagattttcacagtaatatcacaatcttctgccagggtatcggatgaatagcctccggtttcaataaccaccgatcttttaaatgccccgatggctcccggaatcacagtaatggcattgatgtgggcataagccagtctgtcaaaattctgacttgttgtatattctatagcctgccatttggttaaccagtttactctgtttccaactttcacatttcctgcaacagctgctattttttcttcagggtctgaatttaaaaaccttgcaatcagatattttacggcatcctgctgcagtttggtatctgcatcaatacatactacatattccgcatccgtctgtgatatcccgaaattaagagcagtggcttttccaccgtttcttttggtgaaaattttcagtttcgggtgatcaggaaatgctgcttttgctttttcataagtagaatccttacttccgtcgtccaccataataatatcaaagttaggataggtctgtttcagtaaattctgcagggaagacactatattcacttcttcgttataagcagggacaataatggaaactttcggataggattccagaaccggaaactctcccaactttttctctttttttctttctttaaatgcccaatatgccatcagcaaaagtctgatcaagcctaaaacaatgaaaatagtaaataatgctacgaggaaatgactaactccataaataatggtagccagcacaagattcagctgcatgatgtaatatgatttcgttttaggaacttcaggcatcagctcatttctacttttgtgcagaatgctggtaaggttggtaaaatgatacccttgtttctgaagagtcggaatcagaatctttaaagcttttaccgtctcttctctggtatctccgcctgcatcgtgaagaagaatgatatttcctctctgctgtctgatgccggccattacacgttttacaatttcatctgattttattccgggctgccagtcttcaggatctatattttccccgatgtccagataattctgctgtcttgccaaagctaccggaataatctcttccgaagtggtaggctctgagtctgcattgtaaggagctctgaacagaatcgtactgtgtcctgtcacgcactctatcagcagccttgtcagtttcaattcaagtaacgctctttccggacttacttttgccacattttcatgggtaaatgtatgatttccgatttcatgcccttcccgataaattcttttcacaagcggaaggttcttttctgcatttaatcctaccagaaagaatgctgccggaacgtgatatttggacaatacatctaaaacctgcggtgtataggtttcatccggaccgtcatcaaaagtaagcacaagttctttctgaggggcacttccgtatttcttcacttcataagaactcggataggtaacatagttttcgtctgtgataattttctctttcggatcaatttccaacgcgatttttccgtcgtgaggggtattcagaacatccagcacttccccatcaccgatgtaatctaccatggtctgaccttttacattctccaatgcttttaaattgagctttgaaagaccggcaaatgtaaggtctttatcatagaagttccacaccctgctgtcttcacttcctaatctccaaagtgcagttcctgccaaaggatattctgaggagaaacgcattgtattgaaaatagaagctgcatcgttgaaaaatacggtatgggtcagatttttagaatcggtgtaagaataatttaaattaaacgtattgtcattaaaatcaataaccgctttactggcactggctttggtaattgcctgcatgtaagtaacagaagtattatcatccggattggaactccagtcatagccataggctccaaggcccagaataattttttgcggagaggtttgttttacaattttacctgtctgttcttcgatccatttctgagaagaaaccgggccggcatcacttcctgcagaatactcatcataagccatcagcacaaagtaatccacataaggactcagtcttggaatattgtaatcatcattatccgtcataatatccatagtaaccaacagctgattctttttgaaggtttccgaaagttctttcataaaagcgatcagattttcatcagaatcaaggttcatatcttcaaagtcaatattgattcccttgaagtgatattttttacattgtcgggtaatattttgaatcagatgggttcttttttgcggatcattaagagcttttgccaatccttctgaacggaattccctgtcgaagttattactcagcattggcatggcagccacccctgttcttttgatcaccttatatccttccggatctacattggttttcagatcacctgttttgggatcaagaaaaaaccattccggaaaaacaagattcacatgtctgatatttcttttcagagacatcagtgactgaggatcccatgctacataaaatgcagaccggattccgcccggaaactgagcccagtttctgttttggtttttgtatctttctgctcttgccttctcaattttatcaagattggtatggattgttttttcagaaataaagtttctgaaacctttatattctttagaaattttattttcctgaaggtagggtttattagcagtaattacagctttataatcttctttaaaaggaattttaggacttctgtccagtgtcatcatcagacccaaagctagcagaagcagtattcctagaaagataaaaacacggcttccccattgtacacttttccagcgtttcttgctgctggtctgaaaaatctgtttggaattttccacgattttgaaatttattgaatggctttcaaaaagtatgaaaaactgtattaaaattaattaaaaaaaaattaaaaaacaatcttttatctagctgtttataagaaggcttaccaaatcctgaatcaccttttgggaaacaaaattcataaagtctactctttccagatggggcatgtataattttgaggttacctcctgatcatgaattctgatcgtgtagtaaactgttccaacatctttaccgtcttctcctttccccggacccgcaacaccagtcgtagaaagggaaatatgagtatcaaataattgctgacagcctttggccatttcctgtgctacatgttcgctaaccacggtaaactgttctacagtatctttggaaacatttaaaattttaatctttttctccgtagcataggcaaccattcctccaaggaaatattttgaactaccggaaactgaggtgatcatttttgccagttctcctcctgtacagctttctgcagtagaaattgtcagatttctttcggtaagcatttctgccaggattttttcaatcttatcctcagatactgcaatgacgtgtccttctaccaaaggaagcaatttctggatttcttcttctgtctgttgtttcagcagctcttcattatcgcctgaagctgtcagacgaagctttacgcgggtaccgaccggaagataagacaacgcaatattttccggaagtgccagttcccagttttcaattttatcagcaagaatactttcaggaattccaaccacagaaacaatcctggtatggatataatgaagcctgaatcttttctgcagataaggaataatctgatcttttataagcggtttcacctcataaggaactcccggaaggctgtagcacaatttcccgtcctgttccatcatcatacatggagccgtaccgtaatggttctgaaaaacgatggatttagtcggaacaaaagcctgttcgcggtttctttcaagaatatctgctcttccgcgacgttccatatagcctttcaaatggttgaatgtcacctcatccaaagcaatttcatcatcgaaatattcagccaatgcttttttggttttatcatcccgggttggcccaagtcctcctgttgtaatgactagatcgccggtttcaaaggcgttatttaatgcatttttaatcgtatcaatttcgtctgagattgtaagaatctgaataacttttattcctatatttttaagttccgaggcaataaaattagaattggtatctaccgtatttccggaaaggatttcatcaccgatagtaatcagaacagctttttccatatgcttttttgttgcaaaaaattctatgcaaatgacggaaaaatctctggtcacagcaatataaattgattttttctatttttgacgaaattatctaaaactacaataagaattatgtctaaatatgatgacgcttcatggcattatggtggtgactttccggaaggacttcctcagaaaaacagagcaacacatacgggaatgttcctgaactggtgtattcacaataaccttatttctgatgaactgaaagaagatgcggcagaggtaatagaaagagtaaaacgaagagaaatgactggagctgagtttgtcatggaatactgtgatggtaaattttctgaatatgacctgaatgaactcggaaatctttttgcaaaggattattatgcagatgataccgtttttggaaacaggtacagctcatttgctgatgattacgttaatatttttgatgctaaagcagaagaaaatgactatgaatatgaaactttctatcatattgaggatacctacgaaaactatgatctgatgaaacaggttatagatcaccgttttgaagaatggaaagaatacattaacagttaaaaggcaaaagggttaaaaggtaaaagggtaaaaccgtaaaacaaaatactgatctgcctttgacggttttgccgtttcgcaattttactcttttgcttactgctctttattgattatgcctcacccagatcagttcatcggtattatacccgatcttttttgctttctgaatgaaacgctgacgtatgctttccggaatgctggtggtacgggaaagaatccacagatattttaaactgcttcctgcaacaagagcatactgatagtcttcatcaatatctatgacattgtaacctgcccagattggcttaaaaaatgaaactttgagacgggcttctttcggatctttcacaaatttagcttcaccgatagattcattccatacttttttaacgtaatcatagcctttgtttctgacctgaacagtcccatccggattctcagtatattctgccgtcacattctccatatttttctcgaatctgtaatcaaaacgggctatttcataccatctgccaagatattttttaagattaaaattctttacagcagatgctcctctcggaattcttacagaataggaattaaaaacgataagccccagtgctcctaaggaaacgggaagtataattttatgaataattttcatgacaggaatattttggttgttattatagaacgtcaaaaataatgcctttggtctgttaagatacaataaattctatgaaaatactttcaggaaattatctttaaagctgcctgaaacctcaatttctgtatcatcagagagcattactgttccgcttttatgatatgattttacaaatgttgtattgatgatatgagaacggtgaaccctcacaaaaggattttccagaaggtcatcaaaatgtttcagaaaccggcacaccatcttctttgaaccgtctgtaaggtatacctgagtaaagtttccatctgcctgaagtctcacaatatcttctgtttttaccacatcaaatccctgtaaagttggtaagatcaactgctgcttttcaggtttcaatttcagattttcaagaaggattttattccggttgagttcttcttttttctcaagactttccgccactttattaactgcaaggatcaattcctgaatatcgatgggttttaaaatataataacttgccgatttgtttaaagcctgcaaggaatattgtgaaaaagcggtgatgaaaatggtttcataggaaatttctttggtagcttccagaacatcaaaagcgttcccaaagggcatttctacatccagaaagaccagttgaggctgtttttcggtgattaacggaactgcttctttgatattttcagcttcgccaaggatttccacctgcgggcagtatttggtaagatagcttcgcaaaacttctcttgctatgagttcatcatctacaatgacagcttttattttcattacatcggatattaggtggcagtaatcggtttcaggtgcaaattaggaatatttaaccaaccttacaatttgctgatacgagttctccagccatacttttggtcattttttattgcaagaaagatgcaaaagaattattttagggattaaaattaataaaccacaccaaatcatatgaaatcaaagtttcttattctttgctgcatgagtgtattcagtttttctttttcacagatgaaaatcacagaaagagatgatctcagtaagatcaataaaaactggagacttacaaaaacccattccggaacgtacggaatttcagataaaagtggaaaaattattgttcagccagtgtattccaggattaacaaatttggtgagtatgctgatgatctggcactggtaaaaaacatagcgggaacttatggatttattaaccgttctggtactgaaatcattcctgctcattatgaactggactatctggaaaagaatttttccgtgttaaagaaaaaatacatccaatagaaatcacaaatcaatgtggattaaattacttcagattgatctgaatggttaccataacaccgttgctattttccttatcttttactgagcaggtgatctcttttttgtataaatcattcagcaaatgaattctttccagcgtatttttcattcccctgccctcccgcgttttctggtgctgggttttctgttttttgctttcttcgattcctattccgttgtcttcgataaggattttaagatgtgattcacttttctcaaagcttaattttaaaaatcccttatccgttctgtagcggagtccatgccagacagcgttctcaagaaacggctgtatcagcattcccggaaacagaaggctatgcatattcagattttcatccacttcaatttcgtaatcaaatttatcggcaaaacgtgttttttctaaagcaaggtaattctgaagaaggtcaagttcctgctggaacggaataaaatcttctgtagagttctccatcaccccacgcatcagcttagagaatttggtcagatactgattggcctccagctcattattggtagctataaaatgattaacactatttaaactgttaaaaataaaatgaggattcatctctctgcgcagcgactgaagagctattttcttatttttcgtctgaacttttttcaatgttatgaaaatgaaaataatgagcccggtgagcaaaattaacgcaccaatcagactgtagttaaagacatttttctttctgatcagttcatctttaagctctttttctttttccagctgtgagatgcgctgttctgtatcttcaagaactttattgtcaaccagacttcggtctttggaaacgagattcggaagtttccccaaaaagtctctatacagctgaactgaagcatccacatttcctgagattgcataaaggctgtccagtttttttacacttctctgcgcttccagcgtatgacctttatccagagcaatcacatacgcatttttcagaagacctactgcttccttcggatcatttttcttaatatagatatctgccagttcctggatctgattgactttttcctgcgagttttcctttacgaaatcttctttcagcactttctttttggcttcaatagctttttcaaagtttttgttttccacgtataggtcagctaatttctggttgatggccaatgcctgctgaggagcttctctcttcgaaattttataggctgtgttcagattttcttcagcactggaaacatctttctgtttcaggttaacatcggccagctggctgtagctttctgcaagatctccctgctcactttcttttttgctcagattaatattattctgaatggcttctgttttcagttcgggtgtaggcgaagaaagtcttgccacatcattagaattgactgccttacttctttcactgtagcttacctgtgcagccgtgctgtaattgcttatggctggtgttattttattctgtttctcctgtgactgggctaatcttcgggctgctttctcaatattaggtttgtcattgagtttttcatacagctttttagctttggtataatattcttcacttttcggaaagtttccgctgttaaaaaatgtttcaccaatattataataagaatctgcctgtacaggttcatttttagtatccattgcttttttcagcctctttgtttcaacctgtacttcttctacagcaatactgctgttggtagtggtctgggaagatatggtattgccccaaagcaccagtaaaaagatcataaagagtgtaagcgttttcataaaacaaagatatacatatatatagtatgcccaaaaatcattcaccaagtgaaagctccatttcaccaagtcttccgtttttccgcttctgatccatgtaattttacatcagaattaaaaatttaaaaacaggaaattatgaaattgaaacattttttattaatcggaattttaacccttggaagctttgtaaatgctcaggaagtcaagaaaaatgcaattgaagtaacaggtgttgccgaaatggaagtagagccggatgaaatcatcttcagcatcggaataaaagcagataacaaaaatgatctggcagataatgagaaaaagttatttgatatcctgaaaaacgcaggtgtaaagaacgaagatatcaagttcaaatcaatgtatcagaatatctattctaaaacagctaagttttctaagaactatcagtttaaagccagtacaaaatcaagtctcagcaaaatctttgaagacctgaatcagaaatgggtaagcagcctgaatattgctgaggtgaagaataccaaaattgcagatttcagaaaaacagtaaagatcaacgctttgaaagcagccaaagagaaagcagattatttattggaaagtatgggaaaaaagacaggaaatgctcttgaaattgtagagatagaagattacaccagcgatacgattatgcccgtagcttacagaggaaaagcaagcaatatccagctggaaatggctgatgcgccggtagatttctcttttgacaatattgaaaatatcaaactgaaatacagcattaaaacaaaatacgaaatcctttaaaataacagatttaaaagacagttcctttgggagctgttttttatttcattacttcttcccaacccaccaagtcaaacggcagcttcaccaagtttcctgatttcaagcttcaaatagggataattttacttcaggaatttacaataataaggatttaaagatttccgattacaacaaataaccaataaaaaaacaacaatatgacaacgttaaaaatcttagcacttgcagcgggtacagctttattaagctccgggaaatttccggaaaaccatactgtaaacagtaataccggcaatcatttaacggtacaaaagacgacattgattccggtaacctcaaatgtaaaagacaataaaattcaggttgcccttcttctggatacctccaacagtatggacggattgattgatcaggcaaaatccagactgtggaatattgtgaatacgctgacaactcttaaatataacggcaaggctcccgagattgaaattgccctttacgaatatggcaacgacgaaatccatgatgaaaattatattcgtcaggtcactcctcttacccaggatctggatcttgtttcggaaaagctgttcgccttaagaaccaatggcggcagtgaatattgtggtgctgtgatccgtgacgctgctgccaatctgaactgggacagcaatgataaaagtatgaagctgatttatattgcaggaaatgaagcatttgatcagggaaaaataaattatagagaggttgtttcaaaagcaaaaagtaaaaatatttatatcaacactatcttttgtggaagccgggaagagggaatccagacgttctggcaaaatggagcatcactgggaggttgaaaatatttcaatatcgacagtgacagaaaggtactctatattgaaacaccttatgataccagaatttccgaatgtaatgcaaagctgaatgatacttatatctattacggaaatcatggttcagaatacagacttaagcagattacacaggataaaaatgcagaaatgcagtcagcttccaacctggtggaaagagctgttgccaaatccaaaaagaatgcttacaaaaatgatcactgggatctggtagataaagctgaaaaagatgccggatttattgctacggtaaaagaaagtgaactccctgcagagttgaaaggaaaaagcaaagaagaaattcaaaaaatgattgtgacgaagtctgcagcccgggaaaaaatacagaaagaaatagaggaactttccaaaaaacgccagacttatattgattccgaaatgaaaaaaagaggaacagatgattctgacgatttgggaaaagcaattgaaagttctattcttgaactggcaaaaaagaatgggtatagtttgtagttaaagcgggttgaggcccgcttttatgatattcggcacctcttttaataaagtgctctttaacttataattaatttaacttagattcctacggaatgacacactacctggataaatcattatgtcaattgtgccattccgcaggaatctaaataaacctttataccgggcaggctcaaaagagctgcctggtttttgtcttaaccaccccgtcaaaaattctttgaattttgccacccctccacaggatgggaattgagtactgttattagaatatttgtcctagtgctattatgacaatctatcttccaaacttaaaatatcttgataacgggtgctttttattcttcataaataaagaagccatttccattcctgtcacggaaaaagtaattccgtttcctccgaagcccagcacaaaatatgaatttttaaattttttatgttcactgatataaggtaatccgtcttttgtttctccaaaagtccctgcccatacaaaatcaggatagaagtggtaatccggctttattttctttaatgtttttatgatttttttctcttttatatttaagatagcatcacgtttttctgcattataaaagtcttcatcctcacctcccatcaaaagccttccgtcatcagttgtacgcatatagagatagggatcatcggtattccagaccagtgtactggttatatttttaaacttgcttttatcaatttccgaaacgacagcataagtacttttcagggtaacaaagttctccttcagcaggtttttactttcatagcctatacagtaaataatctttttagctttgatctgatatccgctgtctaccgtaacgagattaaaccctttatgctcgtctacttctaccatttcggtcttatcaaatattttcaaccctttctttacattatgctgaaaaagctcatgtgcaaactgaaaagcatcgatacttgctccttgtttagataatatcccgccgtaagtattttcaaatccgaactgttccaaaatctgatcttcagagagccatttcacttcaaatcctgcattttttctcgcctcaaattcttttttcagccatgctacgtctttctttttggaagcataatacaatgatttcttacgtttgaaaccggcatcagaccgtatgagttttgccagcttttctatcttatcaatagcgtcactacaggcgttatagcttaaaacagcacctttttcaccaatttgttctatcagttcatagagcggaacatctatttcgtactgcagcattgaagtggtggcagaagtacttccattacatatttcccgcttatcaataagaatggtgtcatatccgtcttctatcatctgatgagcgatcaggcttcccgtaataccgcctcctacaataagaacatcacatgattcatttgattttaatgaaggataagatgctaacaatccgttttttaaaagccagaaaggttcatttgatttgagatccatattaatattttacactgaaactaacaacatttataccttttttaacaattttcccacaaattatggtgtaattattgttattcttttaaactgaaccaccataaaatattgattatgataactattattccagaagccccggagaatgttgcggcattcaatgcaacgggagaagtaacaaaagaggattttgaaaaactggtaattccgcgtgtaaaagagaaggtagaacagttcggtgagctgaattatttattgtatttggataccgatctggataattttaccatgggtgcgtggcttgaagatttgctgctgggactgaaaaatcttaccaactggaatcgttcggccattgttactgacaaagaaggaatacgtaattttaccagtatcttcagtgttctgatgccgggagagtttaagtctttccccaaagaaaatttatacaatgccctctattggtgcaaaaacggagatgaagtagaggcataaacttatcttatacaaaagaacctgtttcagagaaacaggttctttttttatcttcagttataataaccgtacgcttattgatcacaggaaacacattctgtaacagtttcctcttcattttgagtctgagatctgtacagatacatatatcttatacttacaaccaaaccaataaaggtcatccccactcctaccagtgaaggataattgaatgaatacccgtattccaaaggaattcctccaagaaaagctcccattgcattcgcaatattaaaaccggcctgcataaaagcggcagccatcatttcacttttcggggcagctttcatcatcataatattgatgggcgatgcaatagacattgataaagcaccgcacataaatgtcagtaccaaagcaatatttttatactctgcaaggaagaaaactcctccaagggaaatcatcatcaggaagatcaggagtacacaggtcttttcaggacctaatttatctgaaacaactcctcccacaagatttcctaccaccatacccgctccggcaagaaccattacataagccatctgactgcttttgattccggcaacaatggtcatcagaggggtaatatagcttaaccatgtaaaaagtcctccaaatccaatggctgtaatagccaataccagccatgactgtttatttttaaggaacttcagttcttccatgaaatgagtattctggttggattccagattcggaagccaaagttttaaaaatagaatggcaaaaagtccaatcactgctacgatcgcaaagtacagtctccaatggaaggtatgtccgatgtaggtaaccagaggaaccattgcgagattggcaaccgtaagcccggtaaacatcatggatatataaaatgcttcttttccttttccagccattcttgaagcaaccactgttcctactccgaagaaagcaccatgaggcagtccggacagaaaacggataactaacatactgttgtatccaggagcaattgcagaaagagcgttaaacagtgtaaaaaggatcataaaggccatcaggacctttttaggtggaaattttacggaatatccgatcagaatgggagctccgatcaccacacccatggcataagcagaaatcaaatgaccggcctgtggtattgtaatctgtagtgtttttgctatatcaggtaacagtcccattacggtaaactccgtagttcctattcccaaaccaccgatagccagtggtattattcttctatcaatcttcattatatctaaatcttttctgaattaatttttttaatcacttgttcatttctgttttgaaagtgcaaaattcgaaagaaattttgaaattcacttctctttgaatgataaaaatttgctccatattaacctttttacttaattttaaattcagaaataatcaaaacagaacaagatgaaaatccagaaagaaattattgaatttgaaaaagggaaatcattcaaattgtttgccccttccctgaaaaactgttttttctggcattatcatccggaaattgagttggtatatgtagaagcagtgaatggcatccggcatgttgggaaaaatatttcaggttttacagacagtgatcttctgctgataggctccaatgttcctcatcttaattttgattacggtattcagactgaatgtaaacagcttgtcgtacagatgcgggaaagctttcttcaggatattattcttcctgttcctgaatttgaaaatatcaaagtgcttttagaacgttcttatctcggattatcattctccggagaaaccaaaaatacagttattgaaaagttgcagatcattaaagataaaaactcttttgagtctttgatgggactaattgaaattttacagattctcgcagattcaacggaagtcaaagagcttaataaagaagataccagaatcaaatggtttctgaatgataaaatcagaatgggaaccatctacgattatattcacgaaaattatgacagaaaacctaatgtgaatgaaattgcagaaattgtgagtctgagcactccggctttctgccgttattttaaaaagcagaccaacatgacatttacagattttgttaacaattacaggatcaatcaggctaaaatatttcttctgaaggatcagtctgtaacagaagtctgttttcaggtaggttttgagagtctttcttattttaataaactattcaagcagcatacaggagaaacaccttctgagtttaagaaaaagcatttcagacctattgagatcaatggaaaaattgcccctattaccagggaaacagtttgtaataagtagattttagaccaccccgtcaaaaattcaaagaatttttaccaccctccaaaggatgggaatgatgacagtggttattgtaaagattgccacattcattagctaatcccagtcacctataatccgctacctcctgctaataaaaaacaaaaaaccgctcattgctgaacggtttatattttaatgaatatgtttttctgcgtggtaagaacttcttacaagaggagagctttcaacgtgtctgaaccctaaacttcttgcaaaatctccgaattcatcaaactcttccggagtaatgaatttttttacaggaagatgttttttagtcggttgcagatattgaccaagtgtaattacatctacattggcatttctgatatcttcaatagtctggaaaacctcatctttggtttcacccaatccaagcattactcctgttttggttcttctttgtccggcttctttcagatatcttaatacttcaaggcttctttcgtattttgcctggattctcacttctctggtaagacgttttactgtttccatattgtgagagatcacttccggcgccacttctacgagtctgtcaaggtgttttgtaataccttggaaatccggaatcagagtttccattgtggttcccggagaaattcttctgacagcatttactgtttctccccaaagaatagaacccatatctttcagatcatcgcggtctacagaagtaagaacggcatgtttgatcttcatcaatttgatggatcttgccactttttcaggttcatcccagttgacatcgagaggttttcctgtttttacaccgcagaatccacagcttctggtacagatatttcctaaaatcatgaaagtagctgtaccttcaccccagcattctcccatattcgggcagcttccgctttggcaaatggtatttaatttatatttatcaaccaatgttctcagctctctgtaattctttccggtaggaagttttacgcggatccattttggtttttgaacggtagtgtcttgaactgaattttccatttctaaaattgaagttcaaagttaaggaatttttaatggaaaccatcaaacggaaatattgatgaaactgatcatccgaaattcatttgtatatttatggctccaaaatattcttatgagaacaatattatttcttttattgatggtatgcggagtattctgttttgctcaggaacagctgcaaccggcaggttctacggtcatcgaaacggtagacggagatcttgatggtgacaaaattcctgaaaaagtaattgtttacaataccaaggatacaacagatatgggaaacatacgtgaaattcagatcctgaaaaaagtgaacggaaaatggacgatcctggaaaaatcaaaaaatgcagtgatggaaagccgtgcaggcggtatgatgggagatccttatggagaaacgaaaatagaaaaaggaattctgatcatttcacagaatggaggaagcagctggaaatgggatgtaacagataaataccgatatcagaacggacattttgagttaataggaacttcttccacttcaggaaggccgggagattactggaaggatattgattttaacctttctacagggcagctgaattattcaaaagaggtagaaaatactgctgaatatggtaagtctttaaaagaaacttatatcaaaaaaggtgtaaaaatcaatcttcaaaacagaaatcaggaaaagcaacaaaaaatagttcttccaaaaacaaaagaagaagtgtatttttaaataaaaaccgtggagtttaagttttggctaaagccaattttgaattttaatttttagcgaacgggctaaagcccgttcctattgaatagaattgacttttctgatatttaattatcatcaaattcattattcttcaacaattcggctaagacttttttagcgcgcattacccgtactttggtattcgccaccgaaatacccagttcttcagcaatttccttgatgcttttttcttcaaaaaatctcagtttgataatatcctggtaattggcatccagggattctatggttttgatgattttcttctgttcttcttcggaaatcagaagttcttccggagattttgcatattgatttttaacctcgtcaaggttttcaacggcatcttcagtgtcacggttcttttttctccagaaatcaattacggtattctgggcaatagtcagcacccaggttttaaactgaaaatgaggatcaaacatatccagtttcgaaagtacttttgaaaaaacattgacagtaatttcatcggcatcattttcgtctttcaccttcttcatcacaaatgagaaaacgtccacccaaaaaatattaatgagtttagtctgggccttctggtctttatctttggccttctggatgagcaggaatagctgttcgtcgttcattactaacaaatatagagtatttggggtgaaaaacaaaggataggaagggtaaagtggtaaaaaggcaaaacagcaaaagggcaaaatagcagattaatcatttattgtataatatttgcattgttccaatatagctacaaaaaatcgcttcacaatttaccattaatcttttttgcatttttgcccttttgctgttttgcttttttccccttaatacttctgaatttattatctttgcatcttaaaattttaaagttaaaaatcaatgaattcctttatagaagaactgaaatggcgtggtctttttgccgatatgatgccaggaaccgatgaacaactgaataaagaggtaactactgcatatattggttttgatcctactgccgattctttacatatcggaagtcttatccagataaaaatcttagctcacttccagcagcatggccataagcctattgctttggtaggaggtgctacgggaatgatcggagatccgtcaggaaaatcagcagagagaaatcttctggatgaggaaacccttttacattatgttgactgtttaaagaaccagctttcaaaattcttaaattttgaaggaaacgagccaaacaaagcagagctggttaacaactacgactggatgaagaatatttctttccttgattttgctaaaaatatcgggaagaatatcactgtcaattatatgatggctaaagattctgtaaagaaaagattctcaggagaaggcggtgcagacggaatgagttttacagaattcacctaccagctcatccagggatatgatttccttcacctgtaccagaataataatgtaaagctgcagatgggaggttctgatcagtggggaaatatcacaacaggaacagaactgatccgtagaaaagctcagggtgaagcatttgcattaacggttcctttgatcacaaaagctgatggttccaaattcggaaagtctgagagcggagaaaactactggctggataaaaagaaaacttctccttacaagttctaccagttctggctgaatgctacggatgaggatgctgaaagattcatcaagttctacactttcctaggaaaagaagaaattgaagctttaattgaagagcacaaaacagctccacacgaaagaaaattacagaaaaaacttgcggaagaagtaacggtttgggtacatggaagagaagaatatgaaaaagcactgaaagcttctgaaattcttttcggacgttctacggctgaagatcttgtaagtcttgatgaggaaactttccttgaagtgtttgacggggttccacaaaaagagattgcaaaagctgatgttctgggagtgaatattattgatcttctttctgaaaagtcaggcttcttgaaatctaagagtgaggcacaaagagagattaaaggaaacgccatctcagtcaacaagcaaaaagtaaatgatacttttacagctaatgaaacagatcttattgatggtaaattcttattgttacaaaagggcaaaaaaagctactttattgtcaaagtaggctaatctgaaagaccatataaaaatcggcgctgagatgaatctcagcgccgatttcatgtcctaaataaatttaatattaaaatgtataacttgcagtagccgacaaatactgtccgctggaagttccttctttcttcagttctccatctacccagatctgaactttcaaagttgcagaagcatccggtccgacagcgtttactccaacggttgcgttgtatgctcccggttctgatgttacctcagggctgctccatgttgttccgctaagacttgttgcagtggtagggttaccatcaattccgtacaccgctacctcaatattactgcctgaagaagcgattgctttaaagaccactttatgacttttccctgctccattcacattatcatcatctttactgcatgacgctgtaaatccaatcagcattgttgctattactgcaatgaatgcgcctcttaacagctgattcatactcatttttttcataatcttttgtttaaattttagttactatattgaatattctatgattcatgatttgatatgtgcaaagctatgagcctcatctacgtctatcaatcctgaaaaacaagtaattttttctacctaaattccggtattttttatgctaatttttttaattaaattgagcgtttaaaaaaatatttttcagaattgatctataatgaagagattacttgtcctgttaagcctgtttttatcttttgcgttacaatcccaacaaatcattccgcttaatgaaaaatcatatatagacagcttacaaaacattacaaaaggaaactaccctgatatttcaaaagcaacggcatctttccttttgtccaattatttccgtaacagtgattctgttttaagtaagcaatacctttccaacggaaaaaccctggctcgaaaccagccttttatttcggccaaatattactattacgaaggacaatataatctggacagaaataagaagaaagctgcagcttcctatcagcaggctatccgctctttatttaaatttaaaaatgaagaatccgattttcttcaggcccttgcctggtacagctacggagtttcacaaaaggataaagagggttatgttcctttggttaaaatcatgcttgaaaagagtatcccgctggttgaaaaatatagaaacagcagaaacctgggctttctgtatactcagcttgcagttatccttacttataatgcccagtttaaaaaggctgaaggttacaataataaagccctggaaattcttgaaaaacaatacccgaattctgcagagttatttttcacctatctcaattctgccaacaatttctgctatcaggctaatggagatcaggctgaaaagtatttgaataaagccgaaaaactcatcagatcatatcctgaatcttcatccaatgcctattattattacagcaaaacccttttgtatattacccggcaaaaaaatgaagaagcgctccctgtaatagaaaaaggaagtttttataccagaaagtacaaccagaaccttctggctcaaatgttttatttcaacaagtttgacattttaaagaaacttaaaagatataaggaggctaagactaccctggaagatgttttaacagaaaagtctctggctattgatctgaataacagaaaaaccttttataagcagctatccctgcttagcgaagaattgggagatactaaagaagcgctgctgtgggaacagaaatattctaaacttaacgatagtttgaataccgaaaatgttaagcttgaaatcaataaactcgaaactaaattcaatactgctgaaaaagaaagaaaaatcgcaaccttaaatgctgagaaaaatcaaaaagatcttgaagtcaacaaaaagaattcttatctgtgtggaatgggacttgtcttattgcttgtgctaagtcttctcatctttttgctggttattttcagaaaaaacaaaaaaataaacgagcaaaaactcaatgatattaagcaaaaggaagaattgtcattaaccaaagccattcttgatggtgaggaaagggaaagagaacgtattgcaagggatcttcatgatggtctgggcggcatgctggctggtgtaaagatcaatttttcaacgtggtcttccagtcatttaaacccggaaaaggatcaggagttttataaaattctcggacagctggacaattctgtaagtgagctccgtcatgtagctagaaatttaatgcctgaatcattgcttaattttggtttggaaacagccataaacgacttgtgtgaattttacagcagaaaaaatctcgacattgactttcaggctattgatattgataaaacattacctttaaatatccagcttaatatttaccggattgtacaggagttattagccaatgccgtaaagcatgccgaagccagcagtattttgcttcaatgctcgcaatccggcgataattttctgatcacaattgaagataacggaaaagggtttgataaaaatatagaaaacactacccaaagtatgggtctccgcaacctgaaaaacagagttaattatctgaaaggaaaaatggaaatcaattccgatgatcagggaacagcaattaatatagaactcaacatccatggagaatgaaaaaataaatattgtcattgtagatgatcatcccattgttatcgaagggctgagaatgatgctgaacagccagcccgtttttaacgtagcaggaagttttgcatctggtagggaaactatctattgtattcagtctgagatggtggatattgttcttctggatattacactccctgatgctaacggaacagaactttgcagagaaataaaaaaaatatctccaaatacctcggtaatcatgttcagcaaccgctcagaaaggagcattattatgcagtctatacaaaacggagcaagtggttatcttcttaaaaacacttctattgatgagcttgtgatatgcatcagaggagcactttcaggcgacattgttttctgtaatgaaaccaaacagatcatcagccgtctttcccagaatgatcttcctgttcccaggctgaccaaaagggaaaaacaaattctacagatggtagcacagggaaaaaccagtaatatgattgctgaagaactgtttttaagtcctcttactgtagatacccatcgtaagaacctgcttcagaaattccatgcaaagaactcaacagaattaatcaaccgggctatgcagcaagggatgattgaagaataaaaaagaccgctttaaaggcggtcttttcatatcatgttaaagtaatttacggttctaagaagctgtaatcaattgaagcaaccaatacacctttacctttcttcttcacggttcttgccacttctccatcaatgtacagagtgattgttaattcagaattatcatccggcattgaagcattggcatcaagattcagctgcgcctggctggagtttacaaagaattctccacttgtccagggtgaatttaccggcgtctgaggagtattgtaaattgtattctgagttgtacccacctgagttacaacgcttataatttctcctccggcagttgttttcacttcaaactgaaccacatgatctttaaactcttcatcatcatcttttttacaagaactgaccacggtgattacagaaaataataaaacgaataaaaaagaaagtctaagtaaactttttgaattgtaaaattgcttcatttctccaaatagattttttaatgtttcaaatataagttttttattaatataaaaataatttttatgaaaattttccaataaagatttccaaataatatcaaatcaataaaaagaaaaatgaccggaaaaattcaaaaatatagaccaacggatcaatcattatacataaatcatcctgcagctgaagtttattgtatgaataataaaagttaagattctggatgtaatttaattatatttgctgtatgaatttagattatctagtaagagagccggaaaatattacatccaatacccctattctttttatgcttcatggctatggcagtaatgagcaggatcttttcagtttcagggagacacttccctccgactggatcattgtcagtttcagagctccgcatgatactcaatttgaaggatattcatggtatgacatcaattttaatgatcctgaaaactttatcaatgtttcccaggcaaaggaatctcttaatgcggttctggaaagtatactgaaaatcatcaatcattacggactgatggaaagcaaagcccatttatgtggattcagtcagggaggtatactatgttatgctttggccttgcaacatcctgaacttttcaaccgtgttgcctgcctgagcagctatcccgaggaaaaaatccttgacggtattgtgaaagacaaaaagaaactggaaggacttcgtttctttatttctcatggtactgatgacgctgtgattccattggaatggggaagaaaggctgcagacctcctttatgatcttagctgttatttctctttcagagaatatatgagcggacatggcgtgaaccagaaaaattatatggatctgatggatttcttttccaaataaagaaaccggatttaaaaataacaacaaaaacagcacttcattgcagtttatataaacattccagcttttggaatgtttttttattatgatacagataaatttgctaaattcagtaaatgaaatttagattgcttttactgggattatttctaagcatttttgtaaatgcccagaactcttttgagttggttaataccaaaaaagcagttattccttttcagtttatcaacaatcttatctttattcctattactgtcaacggtgcagagcttacttttctgctggatacgggagtttcagatgccattctctttagtctggaaaataaggagctcaaacttagcaatgttgaaaaagtcaaattttccggtcttggaggtagtgtaagtattgatggtttaaaatctgagcgtaatataggcaaaataggtgatgagattgtcaatacctccatgtctctctatattatcattgatgaagaatttaatatttcgccacatgtaggaattcctgtcaatggagtaatcggttatcattttttcaaagatcatcctatctatatagattatatatccaaaaaaataacagtgtatgaaaatgcagatcttttaaaaaagaaaatcaaaaggtttgaagaatttccaattacaattgaaaaggataagccttatttatatgccggtgtagaaatgacgaatgaaaaaaaagattcaaaactgctgattgaccttggaaacagtgatgccatatggctttttcctacacttattaaaaatttcgtctataacagacctaatattgatgatttccttggccgtggcttcaacggagatatttatggaaaaagaagccgtattcataatttttaccttggagattttaaattcgaaaagccgcttaccgctatgccggatgaattttctatccagcatgtcaatttagtagaaaacagaaaagggtctgtaggtggagaaattatgcgtcgttttacggttatttttgattatcccaataaaaaactgtatcttaagaaaaacagaaattttgacgatccttttcattttaatatgagcggactggacttcaaacaggatggtttggaatggcaggaagacagattaaaaatcgaaacccaaaaatctgctatggttacaactgaagtgtataaagatgcttttcagtataaattcagtttaaaacctatattttctattacaggagtaagaaaagattccccggcttatgaagcaggtctgaaaaaggacgacaaagttattagcatcaatggagaaagaacagcggatatgacacttgaaaaaatagtagaattaatgaaatccaatgaaggacggaatattactatggtcattcgaagaaaaaatgaagagctgacattccgcttcatgcttgaagacccaattccttatcaagaataaaagtatgaaaactgaagaaactaccttagacagaataagaaccaggccaagatttaaaatgtttactcacctcaccaaggaagagtatgctgaaaatctgaaaaagtatatggaagagcataaagatgaattttccggtaacatcaataaagaagtcgccaccatttgggttacaacaaaggatgacagctattggaaaccacggcttgccttacgtgtagaaattgaagatgagcataccgtaataaggggaatattcggtcccagttctgcggtgtggacattctttatgttcctgtatttttctttttctattttctggatgacttttttcaccatgtattacgtggagaaacaaataaaaagcgccgaatacccgtgggcattgagcgcttcttttgttatgttgttttttattcttcttacttatattgctgcgagattcgggcagcataaaggcaaagaagaaatgcttaagcttcgaaggtttgctgaagaatctactttacagtttgaaaagaaaattaattagactgggactctacaggtttttcattctgaatcggtgtagccattgcttttgctgctttgatagaatccactactttttctctgttgctttgttctttcagcattttcggaacttcaggttccagtagtttagtaagttcttcaacagatatattattggcattaggatcatccagcagatttctccatggctttcttccgccccatttataatctccgaataccattactgcagtaccttttgctttggtagtcgctccgccgggattcagaatccaggtatctgcataagaatacagccattgggcatctttcctcaataatcgtaagcatgaatgcgaagcaggatatccgggaagggtatattcatgccatccgattcctccgatattatgaatattgaagttatagggaagtttccattcggtgctcactgtagaaatagccagcttctttttccagttggcaaaagtaagtcctcttgtagtctgagccgtttttttacccatactggtaggtccccattttacaaggcttccgttggaataaactgcaaaagcctgtattggatatgagaagatgacaaactttttcaccccgcttaatacatcaagctgcattggaaatggtgaatacgccatcagggttgtatctatttttgcaggaactaccaaagtgtcagcattccatttgcttttagaatccaatctgtttaaagctaaaatagcggttcgttcttctacactatatttcttgctgaattctgcatatacagaatcccgcatttttttatcttttggaagaacaaaagcattatagaaaccattttcctgcattacaggaggaacagattctttctttacaacaggaacagagtctttctttacagaatctttttctgcctccattgcgtccgaagcagaaactgtatctttaaaagtatcgcttattttttctatttcttttttacatgaaacaagagaaacagcgaataaaaatgcataaagaaaggattttttcacagatatgtttttcataaataaaatcggccgtttagtttggctacccagtacaaatatcagacctaaaattgaatcataaaagagattgttaaaaataccgtaaaaaaacggtgatttcagacatttgctagaatattattcatctttttgttctctagtacttacccattataatggtccttcttagcaactactctccttctgactgatatttaataatttgttaaagatcttatcctcatattatctataattttggtaaaatatcagttatcatgttatacatcattatggtagttgtactacaggcacttattacccttaccctgcttatgtcccttatcagaaacagggagtctgtgctgaatatgcagcttctttatataggagtggttacattggatatgggatatgaatatttcattattcaaaggtttggctatgaatctgttctgtatgaaattcctggaagtcttcgtgttttcaaaggccttattttcctatatatcacaacctatttaattcatgcaaaatggagagataaactcaagtacctcattgttccgttaacgctggtagttattcatcatgctattgcgatctctgcaaagatgcttgatctttcctgggctgacctggccatcagttcttataaatcttattttgtttactacagttactactggcttgccagtcttattttgtgtatttatttactgacaaaataccggaaaaatattactcatcctgcagcaggtaattttcgttatctggttggttatgtattgctgggcgtactggtgttctgggcagtttacaaactgggctggaatactttgatctatcagaaaatctacagccttctgtttctttttcagttcggatggattttgtacgtttatattgtaacgtaccagcacaagctgcagcagcaaaatataaccagtctttctgttcccagagaaacctatcagtacaaagacctttcaaaaatagattttgaagtggtacaaaatgccattatttccttctatcaggagagtcatgattatctggatgaggagtttactttagaccagctttccggccgtctgaaaataagcaaggcagatttaagcatcacctttaataagcatcttcattccaattttcacgaatacaccaacagacaccgtattcagcactttaagaaaatcttacaggaggatccttcagccagcgtaacagatcttgcttttcaatgtggttttaagtcaaaatctaccttttataaatattttaaaatggagtttaactgccttccttctcagcttgttcattagttacaataatttaatattagcaactcactgatttacaatatggttctccgcgaacttaagagaaatagttgcataaaatttaaatgaactaaaacttttgcaggagccgacatctttgcatcaaactttataaggatgtcacgagaaagactttttttaacaaaagcagcattttttcttcttgggcctttggcctttgcacaaactaccgtccacgggacagtagtagacagccagggaaatcttcccaatgccctggtttatattgaaaacagcggacagaaggttacttccgatactgatggttcctttgttcttaataatgtttatgatggcagttataagcttgttgtagaatataaagggtatgacagtgtttatattcctttcaccgtaacggataaaaaggaagtgaatctcggattgattaaattcggagctaaattcaaagaaaacaatcttcaggaggtaattgtcaacagtgtatacaaagcatcaaaggccagggcgattactatgaaaaaaaattccaacaccattacagaggtactttctgccgatgccatcgggaaactgccggaccgtaatgctgcggatgccgtacagcggatgcagggagtatctattgaaagggatatgggtgaaggacgttttgtagcggtaagaggtacacctatacaatggactgcttctaccctgaatggaaacagaatgccaagtgccagcggtgataatgccaaccgcggagttcagatggacatctttccttcggaacttattcagaatgtacgtctgtctaaggctcttactccggatcttgacggcgatgccattggcggaaatgtggattttatcacgaaaacttcacccaacaaagaaacccttgccatcagtatggcctcgggctacgtcaacatgtccaaatcccctacctacaatacttccgttgtgtatgggaataaaatcactgataagctgaaattcattacctcagcagtgatctgggaacgttctacagctatagatcagatgagaaatatctacaactatgggctgaaagataaaacggcttcttattctattaaccagttacagcttcgtgattatttggcgaaccgcagaactttggggttcaatttaggattggattatgagatagacagcaggaataaattatatgcaaaaggtctgtacagtcaatataaagacggccagtcggtaagggaaacctatttcaattttgacagtaaaaatgtgctgcttcaggcccgccatgcagattatcttactgatttatattctatgcagctgggaggtaaccaccaggtgggacagcgtatgcaggtggattggtccttgtctaaggcgcgttcggagtttaaatttaattctccagacaatcttgatccttatgaaagaggatatcctatagtgaatttcatacaaccaatgacctatggaaatttatctgctgacggaagaaagtatatggcaatggatgcgccggatggtattggggataccggaaaatatactctgccttataaccagcaggccgtctcagcagataagctaagacttaaccagattatcctgagccagaaccgtaacagtgaaacagatctcagagggcaggttgatattaaatataaagttaccaacaattttgagctaaaattcggaacaaaatataacaacaaaaataaaattgtaaacagtaccctgcttgtctggatgcccaaatcatcactgggaattcccggagctccggtcacttatctgaatcagcttgagcgtgaaaattttccttataaaggtggtttcatgaatcctttaggcaatctttataatgctgttatcattgatcagattacaaacggacagattgaccagatgtacaattcttccacacaaaacagtttaggattgatgcaggtgagcagcaaggaaagcaactccaatattaccagctcctacaaaggtactgaaaacgtatgggcagcttacctgatgggaacctggaaaatttccgatcagatccagatattgggaggattcagaaatgaatataatgatgttaccttctggggcaaaaaagtagtttctgataaaaacaataaaacggaagatattaaagacacaaaaacttacaatgtagtcctgccaatggtaaatatgaaatggaatatcagcagtgaccgcattctgagagtggcttatacccgatcttttgcaagacctgatttcaatgacctgaatcccggaactattgtgaatgatattaccaataccatcacccagggaaatacccaacttgatcccacattttcaaataattttgatcttatgtttgagaattatttcggaaaactggatctgataacggccggggtattttataaggatatcaccaatcttatctataaagaccagtctgtggtagatcttgcaggaagaacctatactttcacggcccctaaaaaccttgaaggagcaaagctttttggttttgaattcgggatatccaaacgttttgaaaatctgcccggtttcctgaaaaatattggctttgaaggaaattatacgtacatctcttctaaaatgaatatgccggtctatgaaaacggacagcagacaggaaccatgacgaccactatccctaatcaggcgaagcatattttcaataccattctcttctatgaaacgagtaagctgatgatccgtatagccggaaattataaaggaaactatgtaagtgaaatcagagcggctgcaggtgcagaccattatcagtattttgataaaaactttacagtagatctttccacttcttatagccttacaaagaaagtccgtctttttattgagcttaacaatatcttcaatgaacccaaccgctattatatgggcactaaggaccgcgtagaaaatatttcttactcaggaatacgcggacagctgggattcaatttcaatttttaatcaaaaatttttattcatatgaaaaagtatatatatggagctgcattgtgtatgacagcacttatacaggcacaggataaatgccagaatgtaagaatcaaccagctgcagattttaggaacgcataattcatatgctcagccggctgatcccagagtactggaactggtgactccaatcatcaaagggatgatgcagaaatacagcagtatgatgtctgaggaacaaaaggccaagtttaaagaatatcatccctacggaatggatttgaaagaagggctaaattataatcatcccgatttcacagagcaactcaatgccaatctgagaggtctggaaatagatgtttattatgatccggaaggtaacagattcagccatcctgcaacctatgaaattttaaaaactaaaggagtaaatgatctggctccattgaataccaaaggactggatcagcctggattcaaagtactgcatatggtagatatcgacttcaggacgcactaccctactttaaaagatgcccttattgctcttaaaacatggtctgaccagcatcccggacacacccccgtttttataatgattgaagccaaagactcaggtttcccaattcttgaaaacagtaccaaagttcttccatttgataaaaaagcttatgatgaactggatgaagagattgtaaaatatctgggagaggataagattatcactccaatggaagtgcagggtaatttcaaaacgctgaaagaagctgttacccacaacaactggccaaagcttaatgacagtaagggaaaattcatttttatgctgcttcccggaagcgccggaaccctttcttccaaaaataatccttatctgattgatggctcattaaaggaaagaattatgttccttaacagtgaaccggatgattcttttgcagggttcatattaagagataatgctattgtgagacaaaaagaaatacaggctttggtaaagcaaggttatatggtaagaacaagatccgatattgaaacctacgaagctaaaactaatgatttcacaaggtccaaagcagctttcagcagtggagctcaagtcatttccaccgattttttccgagcgggcaatacctatggtaccccttattttgtacaacctcctcagggaaaagattattttaataatcctttaaattcttcctgtagataatcaatattctgacaaaattcttatgacaaaaaaagtcttctatttctagaagacttttcgcgatccggacgggactcgaacccgcgacctccgccgtgacagggcggcattctaaccagctgaactaccggatcaattaaaaattaatgtttttaactggcgcaaatatatagatttttttaaattttccaaagaaaccgatttcttttctttcaaaactatctgtaaaatacagattttcaaagataaaaatttaagatataactgctattaaatacccttttaccaaattttacttataaatcaagaaagccgattataaaaacacacacaaaatcaacattcttgttacttttcattctaagatgataagtttcttagtactatttaaggatatttttttgttattatcctagaactgaatattctttcttactgggaaatacctctatcataactttttcaattctttctctttcctcatcagataaattagatcctgaaggcagacacaagctattttcgaaaagagtttcggctacttttcctccatagtatggtgcatcttcaaatacaggctgcaaatgcatcggcttccagataggtctggattcaatattgtcttccagaaatgccaaacgtaaatcttcgcgggattttgatgtttttgttgaatctattgtaatgacagataaccaatgattactgtaaaaatcagagtttggctccgaaagtaattcaactccttctatttttttacaaacttcagagtaaaaatcgtgcatttttctgcgcccctctactctttctttcaatacttccatttgcccacgtccaataccagcactgatattactcattctatagttatatccgatatgcgaatgctgataatgtggagcttcatcccttgcctgtgtagaaaggaatacaattttatccttatcttcctgagaatggcataccagagctccacctcctgatgtcgtaattattttattaccattaaatgataaaataccaaagtgcccaaaagtaccacatgcctttcctttatattgagaacctaatgattctgcagcatcctcaattaagggaatgttatattctctggcaattgataaaatttcatccatttttgccggcataccatatagattgacaacaataatagcttttggttttttaccttttgtaattctatcatcaatagcctccttcaaagctacaggacacatgttccatgtatctttttcagaatctataaaaacgggcgtagctcctaaataaacaataggattggcagaagctgagaatgtcatagactgacatattacttcatcaccataaccaacattgcactccactaaagccaaatgtaatgcagcagttcctgaggaaagtgcagcgactttaactttttcatttaggaatttttccaaatccttttcaaagccatcaacatttggtcctaaaggcgctatccaattggcgtcaaacgcttcattaatatactttaattcatttcctcccatatggggggaggacaaccatactcttgatttcataatctaaatttttaaacttctactttttattattttccctggattgcctacaacagtacaaccatccggtatatcactgataataactgcaccggcaccaatagtgcaccatttcccgattgtaattccctgtattacacttgctccgattcctatgtgggttccttcccctacatatacattacctcccaatgccgcatttggagatatgtgtacaaaatcttcaagggtacaatcatgatcaattgatgcatttgtattaatgatacagtgttttcctatttttactaatgcattaatagtaacacctggcatcacaatagttccttcccctatctttactcttttggatacaattgctttaggatgaaaaagcgtaacataattgaacagctctccctgctcaactattcttttccgaaccttattgttccctatagaaataacgacatcaatgtcatgtggcggaatttcgttaagaacaggatagtttaatactttctctttcattaaattttcatcaataaaagcctcaatattataaccgctctcttcagccacttcagccacaaccttaccatgaccacttgctccgtataaatacatgctttgtctacgttttaattaattatttcctttaaaagcttctactgtagcttgatctacctggtttattccttctcttattattaccttttttatagtaagaaggattaccttacaatctactgccaaagacagattatctacgtaccatacgtccagctcaaatttctttgtccaagagattgcatttcttccgttcacctgtgcccaacctgtaatcccgggacgtaccgtatgcctgcgtctctgagtttcgttatataaagacagatattgtggcaacaaagggcgtggtcctataatcgccatatctcctttcaatacattaatcaattgcggaagctcatccagagaagttttccgtatgaaacttcccacagatgttaagcgttctgcatccggcaaataattcccatttgtgtcttttttatcattcatagtcttaaacttaatgatattgaatatcttctcgtttaatcccggtcttgcctgaacaaaaaacggtttaccctgattggcaaagtacaataagatcattacaattataaatacgggggccagtataataagcgctattaacgctatcaaaaaatcaaaaagtcgttttaaaaaaaacttatacacgatattctctttctttaatcaatttgttgtattcgcttaatatagcattccagataactgattgctcaaacctatcttcaatcattgggcgggcattcttttttagtgcttcataataatctctgtctgagatcatttttcccatttctttttgaagcctttcactatcttttaccggaataattactccattctggttttctataataatttcattgcatccgttgatatcagaaacaatactgggcaattccattgctccggcctgcatgactacattagggaatccttcgcgataactaggaaagactaatgcatcggaaatcgcaaaataagggcgcacatctttttgaaatcctacagagatgatatcccggttagtttcaatttcttttaatgtatccggagataatggatccaattcctgttccaatggacctaccagtaataattttgaacgctgctggttttcgtttttatttaaagctgaaaaagcttttatcagttcattaattcccttatctcctaccaaacgtcctacaaagacaaaaacaaaatcccagtcttctatctttaattcttttttcagtagaatcttctgatcttctgaaacttgtccaggagaaaagtaattcagatcaattccatttacatttccgttagcaattacttttaagggctttgacgttattttgtaatcgatcaaatcctttttaacgccatgtccttcaggataaatatgggtagcagacttgcaaagcaaccggtccattcctataagcaacttctgtataacaccttttctggtaggaaaaataagtcctgtaaaggtgtgaatccgtataggaactccggcaattttacctgccagcatagtcaaaaggccagctttgggggtaatagaatgtacaataaccggcttttctttttttaaaaccttatatagccgatagagagaggcaagatctttaacaggactgattcctctttccatgtctacaccgatagtctgtattccttccctttgccttacttcgtcaagcaactgaccttcagaagaaatccctacgatttcatagaattcgcttaggaatttcaattgtcctttcaacaatacgtttaaagacagtggtactgttgatgtccgaataactttcatatcaattaatatagagattgaatatcttttattaatctgtttctactctctgtgaccaatctcatagactgatccagctttgattttatctgatcgtactctgaaatagccttatcaaacattttaatcagcaattccggctgtacatcctgaatctgaacaacataatcatcaagattaaaatctcccatgattcccaaagctttgttacctccgtatcctatagcaatggagggaaccagagaagttaatgagaatataatggaatgaaaacgtgtacctacgaaaaagtagaagttggaatacactgctttcagcacatcgcatgatagattttcattaatccagatcatattcggatcctgaactatatttaacagatccctgattgcgttacggtcatcttcatgggaattaggtccaagagactgattgcacaaagccactttataacctttatccaataggtactttgtaagttttgccacagaatcgatatatttcttgtacaaaacctcaggattggaaagtcccggaaaacgccaaggacgaatcgtaatcccaacaattttatcctctacagacagattatatttctgtaatatttttaatgcttcatcctgactgcctttttcaaggaaaaacccaaggtccatttctacaggaatatttttttcaagtaactgccctaagctttttgcagaaacattttcacgggcatatatcagatccagcttattgaagacagagcgtacctgctgcttcacagttagtcctataaaaggtccgtatgagttaggtaaaaagactacttttttccccaatgctttagctaatctgacgtagaacagaaaataccacatcaggtaaggcgcagttttctctccataggcatgaataaagcctcctccttttacaaaaatagttttcgcatcgtgaaactgtttaacagtctggtaagttttatcatcaaatgatttctttactttctcaagatcgttacatatcttaattaaatatcttgtgtttttaaaatctataccggcatttctgatctgctttaaaagttcaagttttgattcttttatatgctcatcagatttatgctgtcccctgcgggggtgtttcaatatattatccaataatttaaagccatgctcctcagattgtttacatagtaattctctttcttcagcattctcacctgcatccaatatatacacctcatcataaagcccggtatctttggccaatctccagctttcccaaacgagagcctggtcacctttatttaaatctgttactccgggtactattatagcgttcatcctaatttaattttccttgtttaatcctgttcgtattttgctttaccttataattgatatagacattcagcgctataccaaaaggaatggctatgaatgtgtatagcttattgggtgagcccttgaaaaaattccattttttggcaaaaaggctcgatgatatatagtgtattgaatttttcaatattacttttttattgatcccatacttcattttcacttttctgtattccatgaatgagttgggactgtttttatatcttttatagagcccattggacagcccgtcctgctggtactctataatacagtatacttcatctgaaaggagaaatttataatcctgatcaatcagcgtaaatatccagcttacttcatgaaagatttcattttcaaaataaggatatggcaaatactttttataaacctctgtatcaaagatgtatttcttatctccttttattttataatagtctaccagttctgaatatgtagattctttgatatccggtaaatattctcccgccacactaccatcctggtaagcatctaaacctataactcctgcagaattggcttttttattcgttttccagaaattcagtattttttctaccgcatcatatggcatataatcatcagaatctatacaggtaaacaattctgtgtcaatataattcaaagccaatatctgtgctgccagcttgcctttgttcttctgataataatactggatatcaaccttattttcttcaatccatatttcaacttgggcacgtgtattgtcacttgagccatcatccacaataatccatttaaagtctgaggaactttggctgcataaggactcataaagcctgacaagggtttttgccctattgaatgttggtgtaaaaaccgttattgccttcatatgttccctagttttttaaagattttatcaaattcttccacctggtttttcttatcataattatgaacgataagtgctctcccattatctgcgatgaattgatataattttttatcattataaagtttatgaatcgcatcataataatcgtccacatgattgtgtgtagcaatataccctgtaaaattattcaggatatagtctgtaactcctccaacagggttggcaataacaggcattccaaatgccagagcctccataatgacacgtggcaatccttctgtatcagaagggtgtataagaatatcactgttcttaaaaatactgtacggatctttctgattaagaagaatctctatgtggtcatccagcttatattgagtaatatcatttctgattttcttcagaaaattatctgaaaccggtgtatcatacacggctcccatcagaatcattttaaagttgatctggttatcctttaatttcttagctagcgcaatagacagatcctgaccttttgctggtaaaaagcccccacaatgcaagatcactattggatcgcctccttttcttacttctctttcctttttatactgatctactttagttacatcaatagcgtttggaactacaaaaattttctccaagggcgcaagaccacctgtaaaaatagcctgtctggtagactgtgaaacgccgataaaataatcagaattatatttaaacatcagctttttaaggaagccgattgaattatatgcaaaccagcctctggcaaaataagcaatcttgtaatcttttcctttctttaagattgaattagttttgatattattaacaatgaccacatctggtttaaaagtattttgaaatttcttaaactctttctgcaacctgatccaatccaataaaaacaaaatgatatttgtacctattttaaagggattttttgagctgaaaatagcaataggactatcatttttctttaaaatatgtatcggtattctattggcctgtacatcttccacaaattcactgcaacttccccagaaatctacaattgccgaattatgcccctcttcatttagtcgtcttgccaactctatagtacttttacgggcacctccatggatctgaacggcttcaaggaaaattatattcattttatatcactttcattattaatatataataaaaattgagttataagtttttaaagctaactgatcaataaaataattacaatattatctcggcactacgccataatatattactattatttaaataaaaaaaaggattttttttcagatctgtgtgttcaatgatcaaatgtgacaaagtaaatttatctttaaaataatatatttacgcaaacaaataattacaataattatattatggataagtttttcactatatataacaaatatacaaaattttaatatgtcacaaacgtttgaatcaaagttaacatttatttataactctcttaaattatattattttatatcgctgcctttattattcttataatcagacaaaaattgatttacattattattagaacttcttgatacggctgacttattaaagttcatattatctaatatcaggtttacgtcattctttttcccttcatagttcctgataaatgatttaccaggtaaattataattactattacttatttcaatttttcctttaagaggttgtaaataattcaatttattcctagtaatgcttaatcctaatgcaatacctgaactgatatcctggtgattatttattttgattgaaattggcttattagtcccatttaagtttccagttgaaataataattccatgaacagcattattttttgtgataatactatctaataccacattcgttatttcattatttttcgaatttggttcaatatcaattccactttgcggattatgcccactggtattggtaattttagtgttttttacataaatattgatccctgaaattattgaaataccatttcttctgttgtcatctataattccacctttaatagtgatgtcttttggaacagtttgttcctgaccaatatatattccatcaccccaaaattttgaaactgaaggtttgaacaactgaatattattacttgattttattgacactccatttccccattccccttcatttgattgatgattatacttatctcccacaatgtttaagtaaaagatatttacattactaacattgtatatattaatcaacttataagcaggtttattactgcttttcaggataatttttgagtttggctggaataaaatatcctgatttgaacgtaaatccagtcctttatcagaaactagtattggaaaatccgggaagacaagttttgtattttcattaagtgccttttgaataaaatccgtgtagtctgtccctcctttcttatctgcattcttaggcaaataattttcaacattaacagcatttttaaagtattgattttttatatcaataaattctttagtacttgtattttggcctgaacaggcaaaacattgaaatacggcgaaaagtattataattaatttatccatttctttagtatatttttatttgttgctagtgtcagaatataaaataataaaacataggtaagcttggtaagtggaactacaaggttacttctggagatataaatactgaatgaaaaaaataataaatatacagctaccaataaaaaattggtactgctataacctaatacataaacctctaatttcttggttagataaccaaataaaataaaaatgataataactccaaagacgccaaagtcaagataaacgtctgcaacagcactggttcctactccccaccttgcatttggacctaaagacatatatgttaagaatacagatgaagaaaaattggttgcatctatacctaattttgagttcaataaattattcaatccagggataataactgaaaaattttgaaacataaataaaccaaaaaaatgcccgtgtactgctggtactttattaacagccacactaattgtgagaacagaagttgctaattctttggtcattggaagaatagaatccggataatacgtgttttcaattttagaattaattgcagaatccagcgtcacaccagtccttcttatcattccaagtattgtcattaccatggatccgacaataaagattgaaataagtttagtagaagatatttttacatcattcagatatatatatccaaaaaaaagagctaaagaaagataaataatgggacctctatcaccactaaacataattaacagtaagtaggcaacaaaaaaaagtaaactatatccatattgtttcaggtaaggtatgaatttagatttcctgccattattaataataacaaataatattaatgctataaaagaggtctcatataatagcattgagtatcctaaaaaaaatgaggtttttctacctgaaccataagtattagcatttagaaaagacgcattaatctgagaaagaaagaaaacaaaagaaagaacatttattacttttaaggcacgaacatctataaactttcttacatcaactccgtgctttctaataacttttctcgattggaatagactggttccaaataaatagctatttaatgcaatagaagcacataaaagcgttttcaaaatcacagccggtcgtataaataagtaacgattacttggttctaaataacctaatgccagatcaacaaaaggctgaaaagtaacaatcagaaatcctatcaaaaatagaacagaaaatttaattttattgttttttaaattgacattctcatctttatctaaaaaagcaaagcttaacaaagaaattgtgtttaaaacaataaataaccacaaaaaatctttgtcatagtaatcgggatactttttagtaacagaaaagtatatctcgaataataatattaggaaaataattactctattcagcattaaaaaacagttaattaaacttaatctttgattttatttctaaaaccatttctttatttataaaaaataccagacctaaaatcaagtaaataattacaaccgcaatggaacctaagataaaattggtcataccactcagattaaaaatcataatgaatttgcgagcaacaaatcccgacagaccagcgatacaaacaattggtaaaatgtctttcgcctgatttttaaatttatatgatgtaatcttattcacataaatcatattgataatacatccgaataaattggcaataactatagaaaataatagtacatttaaatcaaagctaattgcactaaagattatgatgattccaataattttcttgagcacctcagactgtaaaatagctttaccattgcctgtggattttagtatatttcgacttaccgtatcaataataagccctacagaacttaaacataatatattgagcatttcagccgatttactccactgtttccctaatatcagaaaaaccacttcgtctgaaaattcaaataaaatgataaataaaggaaaagaaattaaaagtattaatttcatcaataaagatgattttttctcaaattctttctgatcagatattttacttagtaaaggaaacacaatactatctcctaatgctctgaatatattaatcgggaaatctactagcttctttgcctgatagtaaaatccagtaactaataaagaataaacttttgctattaatgaagaaaccccttcattaaatatcactattaataatgatgaagcaaaaatcttacttccaaagccataaagttcgccaaatgattttttataaaactctattttcggcttatactttactacattaaaaataaaaatacaaaaaaacagattataacataactgctgggaaattagtgcccaaaccccaaatccgtaaaatgccaaacttactgaaataattactgaaatcagtaaggcggcaatactaattattgtttgttttttaaatttcagatctctgattaagtgtactttctgggttaatgaaaaaccacttattattatatttaatcctacaatccttgttaaatttatcagttcttcatttttataaaatgaagcaataagcggtgcacaaacaaaaagaataatataaagaatacagctacaggctaaattaaaagtaaatatagtattgtaatcttcattggatacatcttttttcttaactaatgcacctcctaaacccgattcaacaatcatctgcgaaaaggaaataaaaatagacaagataccgattaaaccaaaatccgatggtgttaaaagccttgctaaaacaatagtagaaaaaaaataaactccactatatccaaacttctctaaagatacccaaaataaacttgtaaatgtttgcgattttaaaaccttatttatcataataatttgactgcattaaacatagtatctctaaaggttattgattacaaatcatatattttattataatctggaatcacattcttccagtactcccttcacatcataaataattcctccttcattcaggtaattattcaaatttactcccataaattctttgtgggcaaccgtaagaataattgcatcaaatttctcttccggaatttcattgacaaccgaaagattgtactcatgctttacttcttcaggtttagcccatggatcaaaggtagtaacatgtaaagaataatcttcaagagcctgaataacatctacagcttttgtattacgtacatccggacaattttctttaaatgttattcctaagttcaatattttggcaccattaattgagatcttctttttgatcatcgtttttacaagctgtgaagccacatattgtcccatagagtcattaagacggcgtccagctaatataatctccggatgatatccgttctcctgagctttctgggccaggtaatatggatctactccaatacaatgacctcccaccaatcccggtttgaatggtagaaagttccatttggttcctgccgcttccaataccgcatgggtatcaatttctaaaaggttaaaaattttagccagctcattgacaaaagcaatattgatatctctctgtgaattttcaattactttagctgcttctgcaattttaatcgttggagctaaatgagttccggctacaattacagatttatataaggtatctactacttttccgatttccggtgtagaacctgaggtaactttaagaattttctctactgtgtgctccttatctcccggattgattctttccggtgaatatcctgcatagaaatcctgattgaatttgaatcctgaaactttttccagaacaggaatacattcttcttctgtagctcccggatataccgtagattcatagataacaatgtctcctttggatagtaccttacctacagtttctgaagatttgtataaaggagtaagatccggacggttatgtttatcaacaggggtaggaactgtaacgatatagatattggcatccttaatatcattgatgtctgctgaacagtacaatcccttctctccgttctgattaaaagggctctggtgttttaaaaccgctttcagtacgtcgttttccacttccagagtactgtcagtacctgtatttaattcttcaatccttttctgattgatatcgaaacctacaaccggatattttgttgcaaataatcttgctaaaggcagacctacatatcctaatccgataacggcaattttatattgtttttccacaaagaatcgatttaaacttgtttttattttaaattttcccaataccagctgatagcttcttttaatcctttttctatcgtatggcttggcttataacctaataatttttctgctttttcaacagatgccagagagtgaggaatatctcctacacggttcggaccatgaacaactttcacatcaccaatcttctcatcgaattcacttaaatactttttaagataccctacaagatcattcaatgtagtacggtctcctactgctgtattataaacggtatttattgcttcaggattttcagtaagcatcgcaagctcattcatctgaataacattatcaatgtaggtaaagtcacgtgaataatcccctgttccgtttattgtaggagattcatgattgattaactgttttacaaacaaaggaattacagcggcataagctccgtttggatcctgtctgcgaccgaaaacattaaaatatcttaagccaatacatttcataccgtaagtttttccaaatacatcagcatataattcattgacatatttagtgatggcataaggtgataatggccttcctatcacatcctctactttaggtaatgattcagaatctccgtaagtagaagatgatgcagcatatacaaaacgttttacattagcatcacgggctgcaaccagcatgttcaaaaatcctgatacatttacatcgttacttgtaattgggtccttaatagatcttggaactgaaccaagtgctgcctggtgcagaatataatccacattttctacagcctccttacaaacttccaaatcacggatatccccttcaatgagtttatagttaggattttcaaggaaaggttcaatattatgacggtgccctgttgcaaaattatctaagcacaccacataatagcctttgtttaaaaagtactccgttaagttagagccaataaagcctgctccacctgtaattaaaattttattcatttttatgatttgaaaattttactccaccaacttttcttggcctttgtctggctgtaaccataaccatagctatagttgtatccatatccacctgctcgtttcgaaacatcattaattacaaaggatacattggaaagttttgaatctcttaccagatcatttgcaaaatcaatcaggatattttttgatactcccgatcttactacatacaatgttgcatctgcggtatctgcaatacttaatgtgtctgaaacaagcatcaatggtgcagagtcaataataatataagtatattgagaagacatctgctcaataagcttctggtaacgtccgttggaaagtagttcctgaggatttggaggaatagctcctgcatagataacatcacatgaaggattggtcgttgaagtatggataagctcctcaacctttactgattcatcatataaaaactcagtaagaccttttcttttaacaggttcgttatcatacctctgaatctgaggattcctgatatcagatccaatcagaagtgcccttgcatttttattagcgatggtaagtgcgagattcacagataccagggtttttccttctcctttcacggaagaagtaaccataataactttagctgaatcctttaccggtaatacaaattttaaattggaaacaagaaccctgaatgcttctgccaattctgaaaaatcgtttttctgtaccaaatgattttcagaatcagtaagtgaaggaatatccaccaatacaccaagacctgaacgttccttaatatcctccctactgtagattttatcatccagcaggaatagcagatagaaaatagcaaatggaattaatattcccaggaataaagctgcaggaagaataatttcttttttaggagataccggtaaatcttctgtgaatgcagggtttacaatttttgcttttggaacatctacagaaagattaattgcattttcctctcttttttgaagaagaaataaaaataattgctctttaaggttttgctggcgttctattcctctatatactttagactgcccgggaaccttttcaatcatattattattcgtattgatctggttctggagctgagaaataccagtctgaactgtttgcttctgttcacggatattatcacggataacttcctttaaagaagcgatttccttgttcatttctataacagcagggttttcgttggtagcctgtttaagggttttatttctactgataaccaatgaattgtattgagaaatagattgttcaagtgaaggattcaaaccaaggttggatggcataagctggttattgcctttcgaagcttctcctgaaagtgagttcaaaagatcaagctgagcctgctgctgaagaagaagcttggtgttgtcacttgtattctgtagtgccagttcagcctgtgcctgaaggtcgacaatacggttacggttctgaaaatcctctttctgattttctactcctgaaagatctttcgtaattacttccagccttttatcaatgaatacctgtgtattctgagcctgtagatttttatctctttgcccatctaaattatactgcttagttacttcattaaggatggcttcagacttttcaggaagagagcctattagactaatatccattagcatcgctttctcatccggcaaattaacttggattgttttttccagcttttttaccttttcaataggatttgaaaagacaattttgtaatccgacttcacattataacgcggatttttttgaaatagcactgtcccgaaatctaacagtacaggagtgttaaattttcccttaacaacattctttttcttttcattatgaatgttaaactcgtctccttttatatctgttaatgtataagcagctgaaacaattttttctttcgtatagcttaatatctttgcagtaataggagctttactaaatagctgcgaatctttaatttctcctgcactataatactcaacattcaggttaagattcttcacaacctgcatcaatataggacgcgaattcactacagcagcctcacttttcagttcatcagcattccctaaaccaattccgagattatcaagatctgaaagggctgaagaaaggtcattttgttttttatcaaatttaagggtagtcttcgtctgatacttaggaacactatacctaagataaataaaagcaagcgctacacagagtataatggaggctataaaccaaggccatttatacaaatattggaaaatggttttctttaaatttaatttatcctccttaggttgaagttctatctgctgcatattttatcttcgtgttaaagcaataataagggtaccagctgtcagtaaagcaccaatgatctggaatgtaagagctctgttaggattcgagttagcctgaacttgtttatttttgtctggctgtacatataatatgtcattctgtttcatataatagtacggcgaacttacaatatcagatctcgtaaggtcaacattaacaatctgatcggttccatcctctcctgtacggataagtttcacattagtacgatctccgaaatccgtcatatctcctgcaagtccaagcgcctggaaaatattgattttctgagaaacactttctttctgccccggttcctttacttcacctaaaatacttacattgaaatttttaagcgtaatagtcaccaatggatctgttagatattttttaaggcgtgattccagctcctgttttagttgtacctgtgtcattcctttagtatatacatttcctaaaaccggaaaagagatataaccttcttcattcacaaggtattcacttggttgtacatattggttaattcctgtagtgctttcgctccctactttatttacagtattaagattaaaaggttttacagcaatttcatcaagcgcagatacaagaatcagaagaacatctccttcctgaatatgtaagccctgaaacttggcttttgcaacctcctcttccatattatgctttgacatatatatcatattctgcttcggtctgcatgataataaagtaaccgataacagtactatatatgcaataatagttttattcatatgttattattcttatctacttgtgttattatttaggtttacctaattgatttcaatcttatttaaatatattgcaacaaaagcttactatatcatttaaatactttaaagcgtactttaaatcctcatttcaaaatcaattctttctctagcaattttcattccgtttaaaaacaaaacggcgaaattattgttttaatattatcttttttatttctataattctctaattttaactatatgcttcattttcagatattctgttattgcatgttaatttaaatggccccaattatttttttatcattcatcagttcaatttcctcaattcaggtatgatctgatcattttcttataacggagattgttctcacaaattttctctttaaaaaattcagctgtcagtttgaaaaaaatatcagaaaagcaatgaaaaatgagaacaagcggaatagcaaactttatcactgaaaatatattttcattttgaagcctaatcaaatcactttgtatatccaggctagaaagggaaaaatataaaaaaaaggaaagaaggaaactaactgaaatactgatgagaaaaacctgccacctggacatataccgtaaaactttgattttaaaaatactccccatatacaataaatctaaaactccctttccattaattcaacaaccagtggcttttattattgaacgaaggtaacaattattattaatatttttaatactatatattaattttatttaaaatatgactgcaatatctgaatgttgtgaattaagtttttgaaaagtttttatttcgagatgctgaaaaacttataaacaaaaaaaatactgcaaaattatattttacagtattttatactactttgatatcgcagctgcgatccggacgggactcgaacccgcgacctccgccgtgacagggcggcattctaaccagctgaactaccggatcaattttttaataagaaattgagaaaacttccgcgatccggacgggactcgaacccgcgacctccgccgtgacagggcggcattctaaccagctgaactaccggatcaattttttaataagaaattgagaaaacttctgcgatccggacgggactcgaacccgcgacctccgccgtgacagggcggcattctaaccagctgaactaccggatcaattttttaataagaaattgagaaaactttctgcgatccggacgggactcgaacccgcgacctccgccgtgacagggcggcattctaaccagctgaactaccggatcattttttaaagaacgtcgtttctttttcgtggttgcaaaattacacctttttttgttatctgcaaattattttagaaaaaaagccttccaatactggaaggcattcattatcaaacttattttttttataagtgagcgcttaatttttcagcgattacctcttttggagctacacctactaatttatctactacttctccgtttttaaagataagaactgtaggaatatttctgataccatactgcatagagatttcctggttgttatccacatctactttcccaactactgctttaccttcaaaatctgatgctacttcttcaatgattggtcctaaagttctgcaaggtccgcaccatactgcccagaagtctactaataccggtttgtctgattttaaaaccgtatcctgaaatgagctgtctgtaatttctaaagccatttttgtttcttttattttattaatattattttcttttaatcctcttatcggatgttcaaaattacgatttttagagcacaagactatctatgctcaacattagttttttctatagtgtaatcttttgaaatttctttcagtgcattgactaatgcatcaatatccgatttggtcgtcatatggctgaaagagatacgcaatggcgtacagtggtccatttcgtcttcagaaagcaccatcatcattaccattgaaggttttgacgctcctgaagagcatgcacttccctgagaaattgcaattcctttcatatccagctgaagtcctatcaatggatttttataaggcagtaatgcacttaaaaccgtataaagactgttttccttttcagcacttcttccattgaactttattccttcaatttctgttgaaagcctttcaattgcataatctttgatatcctgcatatggcgggtatattcctccatatgattcagagaaagctccaatgctttccccagccctacaataccgcaaacattttcagtccccgctctaaggcttctttcctgaggtcctccggtgataattccttttaatcctgttgcctttctgataaatgcaaatccggcaccttttggtccgtgaaacttatgggcactacaggaagcaaagtctacagggatatcagagaaatcaaggttcatatgagccattgtctgcacggtatccgagtggaaaagcgcattatgctctttgcacagttgggcaacttgtttaagattaatgatatttccgatttcattgttggcatgcattaagcttaccagtgtttttttatctgatgcttttaaaagctcttctaatttagcaagatcaatatctcctttttcattcggacggatatagtttacttctactccttttctgcttttcatatccagaatactttcagaaacacatttgtgttccagaggagagctgatgattctttctaccccaaggtgttctaccgaggatttgatgatcatattgttggattcggttccgcaggaagtgaaaatgatttcagccggagttacatgaagatagtctgcaacctgtcttcttacattttcaataaggatttttgcttcctgtccaaagctgtgcgttgaagacgggtttccgaaattcatcttcatagtgccaaccattgcatctataacttcttctgcaagcggagtggttgcggcattatctaaatatactttatccattattattttgaatattttaattctacggagttaaactgataatctgaaggaacagtgaaaataaaccaagggttggaaatcacctgaatttccattccaccggatggcgctccggccggaacttccacatataaaattttattttttacagacacacttttaatctcgtcaatggtatgacttcctgatctgaaagttcccagattgtataaaacaacttttttatttttaggaaattgcgggtatttgatgtaagatccatctccttccgggcctataatgccgaaacttcctttaattgtattacgaaaatctgcttcttccttaataattctaaaacctgcctgtgctgcacctccctgtgactgggatacaataagttctgcgtcatgctgattatcagcactcttttgagaggatgtagctgcacagctcatgaagattactgcacatgcaattgacagacttttcatttttacaattttatctcccaaaattaatgaaaaaattggtaatgtccttcatttgcccatttcaacattggccgatctccggaagtatctccaaatgcaataattttatcgtactttgaatcgttgatttcttctttaattcttatcagtttttctttcccgttacagtttttccctacaaaatttcctgtgaaaactccgttcttaaactctgctcgcgtagaaaccagctccattttaagttcttcagcaaaaggttttacccagatatccaaggaagcggttaccaataaactctgtgtattattcctatcgatattttttataaagtctaatgcattctcccttacgattttaggataatgctgttcaaaaaattgcttagacttctgttcaattttttcctggctttgtccttttaaaatagagccgataaaacttttcttcactttttcagtttcagccagtttcagcttcagcagaataaagagcggtacatgtctcaaaaattgtatacggtattttgtagaatcgtagaatttaagatacataaacattgtatctttatacgtcagggttccgtcaaaatcaaaacaatacaattttttcatttttaaagctttaattttttgaatataaactcagggatattcctgataatcatcataataatactccaaaccggcaaaacatatgccacatttttctcctttttgaaggctttataaatacaggcagctgcctgttttggagtcgctgtcaatttaggattcaaaggcagaccttctgtcatcttagttgccataaacccgggctttattgtaagcacatgaacttttttatcaaaaagataattcctcaaaccactcagataagcggtgaaggcagcttttgcacttccatagataaagttgctctgcctccctctatcacctgctactgatgaaaggccaatgattgttcctgatcttctgctttcaaatttatgggcaaaataattcattacaggaaccagttttgaataattaatgtcaatgatacgttccgtattcctgttatcatacaatccttcttctgttccttcccctaaatatcctacggcacaaaataatacatttgaattgatatgatcaaatctgttgtaatcaatttctttcgtcagatccagatcaatgacttctgcctgctgcagaaactttacatcaatatgtcttgcaaaacgctctgtagtttctttatttgaggtaaaaagataaattttttcaaacttttctccttcctgaagtgctttttccacaaaagcctgtgccacttcggatgtacttcccagaactatcattatgaattattatttatgattcttttgtgctgtaatgacacaaatttagggttttgaatatttttgaggtaacttgttagcgatgatctgctcatactgtctttggtaaggtaaatccttcctccgaactcctgaacaatagcatccagctgatctaccagctttttcaactttgaattaactttaaaatccagcgccaatgtatacccttctacagggaatgagttgtaagcctgcgggttatttttcccaaaaagttttaaaacagctaagaaagatccgtttccgcttttagcaattgtttcaaggattcttttcattccctcttttcctgtttctttagggattaccatctgatactggataaaaccggattttccatagattttattccagtcattgattgcatcgagagggtaaaaaaacgtctcgtaatcgatgaagttttttacttcttttttagattgctttttataatacagccagttgaaaatttttacagtaagcgcattcaatacaaaccccggaaaataaaacggaactgtaggagaaaatttcttcttcagcctcaaaggagtttttgaaaagttctgtggaagctcgtgctggaaagcatgctctcctctcatcaggatacttctgccaatattttttcctttctgaagacagtcaatccatgcaacggtataggtccagttttcactttcgtcaaacagtctgaatatctcatccaggttgtctgcttttatgctttcctggcggatataagcagattctatatttttaagtttaaattttgctgtaagaataattcccgtaagtcccatcccaccaatggttgcccagaatctgtctgaattttcttcccgggaacaggtaataatttcaccattctcggtcataagtttaaattcaatgacatattctgaaaagcatccttccgcgtgatgatttttcccgtgaacatctgaagcaatagcacctcctactgatacaaattttgtcccgggagtaacataaagaaagtatccttgcggaacagctatttccagcacatctgaaagcagcactccggattcacactctattataccgtttaaacggtcaaagctgatgaatttatttaatttcttcgttgaaaatatggattctcccagtgaagcatccccataacatcttccgtttcctcttgcaataatctcgttgtggctgagtacaaattcttttatttttttgaaactgtcctcagatctcatttctttctctactaccgggaaatttccccagttggtaactttctgtgtgaaattaggcttcatttcttaaaataaatttgaattaaaaatgcaactacccaaagtaataaagtaacctgtatataacggtctctgtaaacaatttttgtaggagactccgttctgttgtaaacaagcgtctgctgaaggtatcttaacaatgcgaacactacgaaaattaccgtataaaaaactctttcatgaaatctttcctgaacttccggagacagggtaaacatcaggtagcatactatggccagcgtaatagaaatggataaggcaatatctgcaaactgcacgttatagccatccaatgcctttcttgtttttcctgaaacttgagcattgataagttcacctcttcttttcccgattgccagtaccaacgccaatacaaatgtcaaaagaatcgcccattgcgaaatactgattccagtaatgtaaccacctgccagaacccgtaatacaaatcctatggcaataataaaaatatcaataataggtacatgcttaagcctgaatgtataggcaagattcattaccacataaaatccgatgatggttgcaaacttccaaagtatttcatggaaataaagttgcgtaaagaatacaagaccgatatcagcaatgataaggcctataagaatgcctatcgcttttgattttgaaatagctccgctagccagcggtcttctccttttttcagggtgctttttgtctgcttcaatatcattataatcattcaggatatatacaacactggcagcaagggaaaatattaagaaggcaaaaatgctcttaataagcagatccatattggtaatattacctgaaaaaaacagagggacaaatacaaaaaggtttttcacccattgctccacacggagcagctttaaatatttcttcatttatgttatttcaaatacaaaaataataaattcaaaattgccagcataaaaatacaaaaaaaaccgccggggcggtcttttacgaaaatatttatatattaaattaactattgcccttgtttggcatcattaatcattttttcattagctgtaatagcaaactctactcttctgtttttagctcttccttcttctgtatcattgcttgctacaggcattgcttcaccttcaccttttgtaaacattctgcttgatgcaattcctttccctgttaaatatgcttttacagcatcagctctcctttgagaaagtttaagattgtaatcatctgaacctttgctgtccgtatgaccatagatattgatattagtatccgggttattagccaatacttcagctaatttatcaaggttggtctgtgcaacagaagtaaggtttgaagaatcgaaagcgaagttaacgatactttcattcatggttactttaataccatctcctactctttctacctgagcacccggtaaagtttctttaatatctcttgcctgcttatccattttgttaccgataacgttacctgcaacaccaccgataatacctcccaatactgctcctatggctccgtttcctcctttacctacattgttaccaaggatacctcccagtactgctcctgatgcaacacctactgcggtacctctttgttggtgatttgaattctgaaccgcttcacagctcgtcaataataatgctgatgacaagaaaagggctcctacgtatgtttttgtaaatttcattttttctgatcttttatgttgataaattatttcattcccgttctctggaagttgtaaactacttttacattacttccttcaaaaggaacatcttgctcaagtgaaaactgatctgttgactgattagtcaaggtaaggctgtaacctactgtattttgttttgcttttgtacctgaagcaatttttttaaacataaacgtgttaccgtcttttacttcaaatttgataggctgtgtaattgccgggcaatttccaccaccgtttaaagtataagctcctgtccagttattaggaatcaatctccagtgacttcctacgaagcactgtgcgtctgcaccttcgtcaaaaggtttaattttataccctttatcgtaatctatgctcacaatctgccagtctcctttcattttcaggaaatctgctctttgattttgagatgtagctgctttgttaacagaggaacacgaaactgcaaaaagtgatgttcccaacatccctgcaagtagtaactttttcattttgttgtttattattttgttactataaagttacaaaaaaccgtgccaaaatttaaaataaaaaataaaaagtccgaaaaaattcggactctttatggtttctccttaaatacaggaagataaattattttttaacagccttttttacggatttcgaaggcttggtactgcctgatttcttgccgttatagaaattagtataagcatattccgcagcttttttcagatcgataactccgccagcctgtgattgctctgcaaatccgtttgcagtactcggattgctgcttttcacaagtgcctcaataatctggtacggcttcagctccggcatataagccaataaaacggctgctgctccagctactacaggagaagccatagaagttccctgaaggtatttgtattcattcttaggaacggtagaataaatttcttctccgggagcgaaaacattcaccatttttttattgtaattggagaaatcagctctcagtgcattattcttattggtacttgctcctactacaaggacgttgctcacgaatggtttttcatcagtaacgtttttaaaattagtaggatatgccagatgctctgcgacatcctcattttcattacctgctgcctttactaaaagcacacctttgtcttctgcatatttaaaagcatcccaaactacatttttacctggtgaaacaggcttaccaaagctcatatttaagactttagcaccgttatccactgcatatctgatagcattggcaacatctttatctctttcgtctccattcggtacggttcttacagacatgatcttggctacttttgaagcaacaccgtactggacttcttttccctgcggaagtcctgcgataattcctgcaacgtgagtcccgtgttccgcatccggtccttcgtaatggttattaccataaattttttcagaatagtcgtcatagttatctcctacaatttcctttctcggatcatatgaaaggtcatattgttttgcagcaggagcaaagtgatcaatagcgtccttcatttcctccttcatctttttttcaaactctgcagctgattttcctttgaattccgggctttgcgaaatctgacctaagaaatccaatgcaatggcatccctttgatctgtaggggctttgatggacgcaatagtttcagcggttacaggcttaccattcaataactttaccatattaggaatcaattcgttcagcatagaataagtcctgaagttctgctgcgcctcaacacttttcttattaaacatgtctttggccttcatatacatatcaaactcatccttcatcttagcctggttggctttattctttgcagaatcatctccttcgaagataggcttatatttggcaacaacccttgttacttccatattatcgatatcaatatcaccgtttttacctcctatgaagttccatccgtgtacatcatcaatgtatccgtttccatcgtcatctttaccgtttcccgggacttcattagggttggaccataggttttttaccaatccggggtggtctacctgcactccactgtccagtactcccaccactacggttttaggcttcagccctttagattccaagtatttataagcatttgctgtatttattccatatacttttgaagttgcaaaatctttatgataccatgtcatcagatctttatcttcgttgggatcaatacttttagctttagactcctgtgcaaaagagaaactaaaacctgctaaaaaaactgcagctaataatacctttttcatatgttgatatttaatttttaaagagatacgccaatcgccattatcatttgttttacatctgaaagtttatcaacagcgactgtaacctaatattgttgttttatatttttaatatacaccagtgattccgggcctttattacaaatcaggtcaagaaccgacaggtcttccaaaaatccgaatttatcagaaaacgtctggtaatattcttccatctgaaattctgaaggaagttttgccgaaaacttttccctgaaattgatgctttcaggatttttgatatattcttcattcaaagagtgtgccttttccgttttcagtatctgttggatgacttctatccctttaaggttaaaatcaagaaggaacttttctttaaggtcaaatatttttctgaatttatcttcgtagtactcaaaataaggggagctctggtacgctgttttgatagatttccagtgaagtgttctccagtcttcgcggtaagagatttcaatatctttaaattctcttttcccgttatgatggataggaattattaatgacaattttccgttcgcgccgtagatatttgcacggtttctgtaagtctgcttcgggaagttttcaaactgttcaaatacaatttcattctcaggattcaaaaacactgagaaccatgagattgggggcatgtaaaatgccggcaataatacattcgtcatattcataatgcaaaaatgaagtattttttcaaatacttcattctattttaagtttaatttttctattaatcgtcttcagtttttttctttctgaacaatttcatgaaatactcccatccgaagaacagaatcagaatcatagctgcaatccaccagtaagaggttttattagcttctcctgtattggttgctttaaacattctttcccaacggattttgaatggtgcctgataagtagaactgttgtccgcaaatgcaccctgaaggctcatccaagtaaacattggttttccaacgatattttcttcaggaacgaaaccaaagaatctggcatccagtgatgcatctctgttgtccccgatcatcatataataatcctgctgaatggtatattgactggcttcctttccgttgatgaagatttttccgttctttttttccaggctgttatgctcgtactcagaaatgatccactggtacattggaagagtttcctgattgatggtaaccacatctccttttttagggattctaaccgggccataccaatcctgattccaaggtttgttgatcgggaagatagattgggttgtatcaattttagttttcgcttcgtctctgtaatatactgctgcttctcccttaggcgaaatttcttccttcatatcaataacgtgaggaagttctttaatttctttagcaattttatccgttaagccctggaacccataaaggaaacctccattattctgctgtacttcctgaaccggtaaaaatccataagctttatataaagtagggatatccaattgtgcatccgtagttacaatatatctgtgctgtacttcctggtctcccaaaacggtttctggctttccattaacgaaaagtcttccggctctcatttcgaaagtatcacctgctgttgccacacatctttttacataaggatcttttctgtcgatcgctgtatgtacggaatcctgaggatagttgaaaaccaccacatcatttttctgcggcttgttgaattgtaaaattcttgtataaggaagctttacagcatctacgtaagatttcggatcatctttcgggttccctttctgccctgtatccataatggttccctgaaggaaaggtattgctaccggacgcatcggaagtctgtatccgtagctccatttgtttacaaaaaggaagtcacctaccaataatgttctttccattgatcctgttggaattccgaaaggctgggttacaaaaacgtggatgatggtagcaaaaactacagcaaaggtaatagaaccaatgaatgtatctttcttcttatcatttttctcttcatctgtaaggaacaggtcatttgcattttcatcttctaactctacatctttggaatagttgattactgccatgtaaataaacggcagaatcaccgtaagaatctgatctttgaaaagcgttttcccaaactttttcaccagataaaggtggaaaacagacatcatgattggccctactattggaagataggacaggattgcccaccatttcgggtgttttgtctccttcagaatgatgaaataattatagaaagggataaaagcaaataaagggctgtaccccattttcttgaacagtttccaagatgaaatccccatcaatacggatagtatgaggacatatactgtataagttaaaaaataattcataaattttttgtgcctattcttatgatataaatgataaatgatgagtaataaatgataaaagcagtccgctgtttacaattcactattcatcattttctgtcttattggtctgcaatttacagaatttgttacaaattaaagtcccaaaacgtctttcattccgaagtttccttttttatctttaatccattcggcagctactacagctcccaatgcaaaaccgttcctgttgaatgcggtatgcttgatctcgatttcatctacttcacttctgtaatatacactgtgggttcccggaacctcatcttcacgtattgcaaagataccaagctgtttaccttctgtttcttccagcttccaggcatcaaatttcgggttattttgaataatcccctccgcgatggaaattgcagttccactaggcgcatcttttttatggatgtggtgaatttcttccagctggcaagagtattcatctacattcttcatcagatctgcaagcttttcgttcagagcaaaaaataggttgactcccaaactaaaattggaaccgtataagaaagctgtatcattatccacagctaatttttcaatttcagcttttttctcaagccaccctgtagttccgcagatcacaggtattttgttttcaagacaagctttgatgttttcaaaagccacttccggtagtgaaaattcaatcacaacatccggattattaagattttcagcagttggagtttccttcagacgggcaactacttcatgacctctcttctgtgcgatctcatcaatgatcttacccattttaccgtaaccaactaatgctattttcatataatcttttttattttttcctgcattcaatatggttttcctgcagagatgttgttttttaaaatctgtaacttaaactgaatccagtttttggtgcgctataaccatactggtcctgaataaccgatggtttaaaaaccaaatccggatcatgacggctttcataaaggtgtgcatctactacagcgtctacaatattcagaatatagatcaatcctgtaatagcaatggcataatccctttgtcttttggctctgtcctgtgcatttcctaaagctcttttgtctaaccacggatggctgtccacaaattcattaggagttccgttcagttttgccacataatattcacggtattttttatactggttatcattccatacagcaatacctactcctgcccctacagctccccagacaatcggaatcttccaatactttttattataaaactgtcccaatcctggtaaaacagcagaatacaatcctgccctcgtagggttcagttttatggtttttgcagtgggaccattggctttttcaagatcttcaatgatctttgcttctgttttgcctggttttaccacacggggttcttctttcggaggagtttccatccgaacggtatcgataggtttgacttgtgaataggccagtgcagcaatacacaagaaaagtgtgaaaaatattttcttcattatttaatatgggataaaatatattccagctcttcttcatttttgaagtccagaacaattttaccttttttaccatttccagaagctttgatttccacttttacatccaggatgtcagcgatggtcttctgggcttttttataattattggaaagctccacttttgcttttttagcagcaggagactttggattcttcaatgctgcagctgcctgctctgcctgacgaacgtttaatttttctttgataataagttcaaacaacacctgctgatcttcttcgctttcaagacttatgatagctcttccgtgtcctgcagaaatttcaccgcttctgatggcattctgaatatccggatttagtcttaaaagtctgatcgagttggtaatggtacttctgtccttccctactctctggctcagtgtttcctgagtaagcccgatctcttccaaaagcctatgataggtcaaagcaatttcaatagcatcaagatcctctctctggatattttcaacaagagccatctcaagaagctcttggtcatttaccagacggatataggcaggaatcgttgttaaaccggcaattttagttgccctgtaacgtctttccccggaaatgatttcaaacttttcaccgtcttttctcagggtaatcggctgaatcacgcctaagtttttaattgactgtgcaagttcgtttaatgctttttcatcaaaataagttctcggctgcgtcgggttcggatagatatcttcaagcgcaacttctacaatattccctacaaacttatctgctccttcatcagtagcggagttgatcgttgctttggattctgcacttaaaatggcgcccaagccgcgtcccatagctctttttttgtccttcatagatataattgataaatgatgtttgaaaagtgatgacaggcattcactctggccatttattattaatttaattctttattaagttttcattcttcaaaagaacttcttcagctaactgaatatactgaacagctcctttactttccgcatcataattcaggatactttccccgaaacttggtgcttcactcaatcttacgtttctgctgataatggtttcaaaaaccatttccgggaaatgtagatttacttcttccactacctgattggataatctcagacgactatcatacatggtaagaagaagaccttctattccaagatctttattatggatcttctgaacgtttttaacggtgttcaaaagttttccaagcccttctaatgcaaaatactcgcactggatcggaataattacagaatctgctgccgtaagggcatttaccgtgataagacctaaactcggtgcacagtcgatgataatataatcataatcatctcttacactggctaatgcttttttcagcatatactcacggtcttccttgtctaccaattcaatttctgcagctacaaggtcaatgtgcgatggaataatatccaggttcggagttgctgtccttttgatacaaacccttgtatctgcactatgctccagcagattatatgtagaatactgaacatcctcaacacccaatccggatgttgcattcgcctgaggatcagcatcaataattaatattcttttttccaatactcctaatgctgctgccaaatttacagcggtggtagttttaccaacacctcctttttgattagcaatacctatgatttttgccattattagaactttaagattcaaaaatacacttttttctttgctctcggtaagcagggaaaatcaaaattgagttaaaatattgttaataagcaatttaacgataaaaaaaattatccacaaaaaaaattctttgtggataactatttgaaatttacttttacatgttaattatcaaatttcatggagatcggaaatttgaaataacttcttacgtattctccttttttgtttttggctggaatccattttcctttactggaaattgatttaatagttctcattgcctcactgttaaaatcggcgttggttccgttagcttttacccctgagatggttccgtccatttctacaataaaggtaactgtcgtttttactacatcttctgattcaaatcctgaaccgtcgaagctgttcattactttatttctgaaggagtcaattccgccaggatagctggcttctactcccaattctcctgcttcagcaattttatttttgtccaccgggtcagcaattacaggtggaggtgttgtgattacaggtccttgtcctactgttactgttggaacattaggtgtattaggtataaccggatctcctttaaaattgtccttaaaacctgctactgcatcatcaggaacaggatcttttttcacattatcctgagctgtacttgatggtgtaggcactgtactgtcaaaagtctttgtattgggagctgtttcaggttttaccggagtaatttttaccggaggtgcaaccggatcgtcaggaattaatactggcggaggaagtacatatccttcacctgttgtagtttctacaggcttcaatgcagaaattacaaacggcgtaatagatacagccgccattaaacttgctcctataaaaagtgctttggttaatattctatctgattcgtttcttaatacataggcaccatagtctttattgcggtgctcgaacaggacttcgttaaaccgaaattcctggttttggttatgttgtttcatcactactactatttaaactgttaaaaatttgattattagttttattgttcttatcgataagtactgtttcaatatcaaaacatctgccaaaattttatcaaaacaacataatattagaaaattttatgataaagtttaaattttaacatttataaatagaaagtttatgcaagaaataggagttatttcttctaaagtaagtgggggaacaaacttatgacctcttataaaaacaaaaaaagagaccatcacgatagcctctttttatttttatgttgtaagaaatgttagaataattcttttctgatgatgttctgacttctttcaggacctacagaaactaaataaacattgattcctaagtatttttcaataaactcgatgtatttctgagccgtgtcaggaagttcatcatagcttcttgcttttgtaatatcttcgctccaacctggtaaatcctggtagattggttcgtagttgtataatttctcagttgaagaagtgaaataatcgatgatttttccgtcttcagttttgtaatgggttactactttaaggttttcaattcctgtaagaacgtcaagcttagtgatcacaaggttgttgattccgttgatcatacaagcatgctttaaagaaacaaggtctaaccagcctgttcttcttggtcttcctgtagtcgcaccgaattcaccaccgatctgtctgattttttcacccagctcattatctaattcagaagggaaaggtccgtttcctactcttgtacagtaagcttttgctacaccgataagattttgaagtgaagttggcggaactcctgctcctgaacaaacaccacctgtagatggagaagatgaagttacatatggataagttccgaagtcgatatcaagcattaacgcctgtgctccttcgaataaaacgtttttaccgtctctgattgcttcgttcagctctaattcggtatcaacgattctgtcctgaagctgctttccgatgactaaatattcattgtagatttcttcaacatctaaagccggtttcccgtaatatttttcaaaaagagaattctttacttttaagttcttctcgattttatctcttaaaatttctggatttaaaagatctaccattctgatcccgactcttgcaattttatcttcataacaaggtccgattccttttttggtagttccgatctgagttcctccgtgctcctcttcacggtaagtatccaaaaggatgtggtaaggcatgatcacatgcgctcttctgctgataaagatatgatctgttctcaagcccttgctctcgatctgacctacttctttaatgaaagacttagggtttaccactactccgttcgcaatgatacatttccctttgcattgaagaactcctgaaggaagaaggtgtagaacgaatttctcatcccctacataaaccgtgtgaccagcattgtctccaccctggaaacgcactacatagtccgattttgctgataaaacatccgtgatttttcctttgccttcatctccgtactgaagacctacaactacataagttgacatattttacttttgtttttagattcgtgcaaaattacttttaaaaaaaatgacggccaaattatagaggatatttattttaagttggggtgaaaatcatgaggttgaatattatttcatttctatattttcactttcacacctatataaaatggattatatttactataaatttatacaatgaaaattaaaattctgattttacttttaacaatgcctcttttctacgtgaatgctcagaatacagtcaatgattatttaaatatatcaggtcccattaagttgaatcaaaaggaatataagctcgtatggagctcacatcctaatgaaaattatttcaaacaggaatatatcagttcaaatgaaaacatcaatagatacaacagtatggtattgatcgattttgtaaaaggtgatttcaatatcaaggatgttgttgatcaaaaagtagctgaattgcaggaaatgaaaaaaaccaacccggttatcaattatcagatttttgaaaataaggaagagtatattttagattttcttatcagtgaaaattcaaaaaatggcaaagagatactgattgcagaacgaaatatttatcgctacaaaattattagtaatgagaagaataagggcgttcttctttttgcattgagtgaaagaggatatccggaaaatatggattctttctttaataatttaaaaagcaacacttcaaaattaattgaagcggttggaaattataagcacccagatattgaaataaaataatattccaattgtatgaattcatcccaaaaatcaaactatctgttctcaaaaatagaccccaattcccacctcttctacactttattttccccggaaacagcaaaagccaccctgctcattgttcacggtatgcaggaacacagcggaagatatgcagagattgcagaatattttgcagctcatgggattgctgtattgacgtatgatcacttggggcacggaaactcggtaaaggagaaaaaagacattggtttcttccagcttgaaaaaccggatgaaagacttgttgcagacgcggaaatgatggctgatcatcttgcagaacaatacccggatgttccccattttattctgggacattctatgggatcttttataacacgatgtcttcttcaaaaggtaagcagtaagtttgcaggagctgtcattacaggaaccggcggacctttaccgggaatagactttttaagaggttacttatctttagcgacagcaattgcacctcgtcatcgtacttttttgaattctgtttttacaagtgtcaataacaagcattttaaaaaggataaagatttcagtgataccagctggctcagtgtaaatcctgaaaacagaaagaagtttgaacaggatgacctctgcggaattccgtttacccataatgctttttataccttatttactatctataaaaaagctacatcaaggaactgggcttcttccgttccgaaatcatttccatttttatttgtaagcgggcagaatgacccgatcggtgattttggaaaaggcgtaatacatacggtcaacaacttaaaagctgatggttttcagaatgtagacgtaaagatctatccggaaatgcgccatgagattctgaatgaggaaatacgggaagaggtactgaacgggatttataactggattataacaaaatcatgaggctccatattttcggagcttcaggttccggcgttaccactttaggaagagcattgtctgaaaaactcaatattgaatacttcgacagtgatgattttttctggcttaaaactgaaattccttttacagaaaaacagaatcctgaaataaggaacactattgtttcggataaacttcataccattgagaactggattttcggaggttctattattcattggggtgaaaatgtatttccggtatttgacctgattgtatttctctatcttcctcctgaaatcagaatggaaagattgagaaaaagggaatatgaaagatatggtgatgaaattttcactcagccggaaaaagctcaaaaatatcaggaattcatggaatgggctaaagattatgattacaataccgggattgccaccaggactttaaaggctcatctggaatggctgtctgagatgaacactcctttgattgagatttcaggggattatgaactacaacaaaagatggatatggttctggatgcagtcaacaggaaaggagaaaaataaaaagcaaaatcccggttatagtcagccgggatttttatgataagttttggctcctatgtttgcaaaagaataaatttacatacaaagcaaaaggggtgagagaacagttttggctaaataactcaggaagtatattgtgctttagaaatgtcctcacttctttattccttttagatggacagattttgaagaaagtagggtaaaaatcaaagaccttcaccctacgcaagctaactcaaggtcgcttttataaatataaatgtataaaaaatatttggaagttaacacagaatctaaagccaatggaattttggttattatttttaaacgggctaaagcccgcctctactgaatatctcattgattctgcacaaatacagaatacaagcattaatccagcgctaattcccggtctatgccaatttcttccagaaaaacttcatcatgggaaatcaccaacaaggttccatgatagtctttgatggaatgggtaaggatttccacgttctgaaggtcaaggttattggtaggttcatcaagaatgatcatgtcaggagctttattgctgatggaaagtccgcagagaagcaaccgtaagcgctctcctccgctcagcatcccgcattttttgtcccaggtatctttcccgaataaaaatctggacagtaatgttttgacttcagattcctgcatggcgctgtcattgaaagtctgtacaaaatcatacagcgttgagtcattatcaatcagagaatattcctgatcaatatagatactgttgaatccggacctgcttatctgtccttccgaaggctctatttttcccagcagaagttttatcagtgtagtttttccggaaccattttctcctttaatcgagatactgtctccactccggatctcaagactaaggttttccttccaaagtttctgttctccataactgaagttgatattttcagcagtaatcaggattttccctgaatgtagaccggaatcattaaaattcactttcatctgatcagaatttcttaccgatgaacgaagatcccttaattcatgtgaaataccgctgattttctccgtatgaaccgattgtaatttcgaagaatttttctctgcattattcctgagagtattcatcataattcttgccactccggatttttcctgtttccccttccctcttgcatcgagcttttgctttcgttctaatgtttcccgttctttttcctttgctttcttcaacgcccgttctttagcatgaatatcattatgcaaagcttcttcttctactgctttctgttctgcgtaaaaatcatagtttcctccataggctgcaattccctgattgcttaattcgaaaatggcatcaacaagattaagtaatgtacggtcatgacttacgatcacaacggttgcatctgttttgtcaataagatcatacaacagctttctcccctccatatccagatgattggtaggctcatccaatataatcatctcaggctgattaatctggattccggcaagaaaaactttggtcttctggcctccgcttaagccttccagtttccgggtaagttcaaaatcgctaagcccccaaagttccagggcatgccggcatcgttcctcaatatcccaatcgtcattgagtgtttcaaaataaatttcatctacctccccgctggtaattttttcgagagcatgtagcttctgatctattttcagacattcggcaatcgtaaaatgattgaaattcccgaacatctggggtacataaaaaacctccccctgaaggctgatattgccacttaaaggatgtatttcacctgcgattattttcagcagggtagattttcccataccgttgcttcccactaaagcagatttggtatgagattgtattgttaagttggtatgattaaatagaagatcccctcccggaaacccaaaggatatattttgcagtaaaatcatgatttctttcttaataaaggttaaacaccgataacatggtggtcatcgtttgatcaaatcggaaagaaattatatcctacatctctgtatttttgggttttgaaagaacaaagatagcacaaataccggattaaacacaaaaagattttaatgaaaaatctaaaatccgtaactttgcctcctactaaaaattttatggaaagcattaaagttcacgacaaaactttcgttccttatttaaaggatgccgaaattcaggagattgtaaaagagacagcgttaagaatttatgaagattacaaggatgaagttcctgttttcattggcgttttaaatggagttattatgttcttctctgatcttttaaaatattacccgggggaatgcgaaattgccttcattcaaatgagttcttatgtaggaactgagtctacagggattgtttatcagaaaatggaactgactaaagatgtgaaagaccgtcacatcattcttgtagaagatatcgttgatacaggaaatacggttgaaagtcttttcaaatattttaaagaaacacaacgtcctaaatctgtaaaactggcaagtttcttactgaaacctgaagtttataaaaaagatttcaaactggattatatcgggaaagaaattccaaacaaatttgtacttggatacggacttgattatgatgagttaggaagaaacctgccgaatctgtatcagctggaagaaggacaaatcaaccattaaagtgctgttggctattagctggtagcttttagcttaaaattatataaagaaataaatttaataataacttaaaaaagctgaaagcaaaatgccaattgccggaagcgaatcaacattatgataaacattgttctgttcggccctccaggaagtggaaaaggaacgcaagcccagaatctgatcgaaaaattcaatttaaaacaggtttcaacaggtgatcttttcagatataacatgaaaaacgacactgaacttggaaaactggctaaatcatacatcgataagggagaattggttccggatcaggtaacaacagatatgctgatcgatgagatcaaaaaacctactgataccaatggttttatctttgacggatatccaagaacgactgctcagacagaagctttggaaaaaatcgttaaagaagtattacatgacgaaatagacatctgtctttcattggtagtagaggataaaattttggtggagagacttctgaaaagaggtgaaaccagcggaagatcagatgacagcaatgtagagatcatcgaaaacagaattaaagaatattataccaaaacagcagaagttgccgagctttataagcagcagggtaaatatgtagaggtaaacggtgttggagaaattgatgaaatttcccaaaaacttttcgctgaggtagagaaaattaaataatcgggaatgagtaagggatacaaaataacgtcccgcaacccgcaacacaaactatatgtctaactttgtagattacgtaaagatccattgtaaaagcggacacgggggtgctggttctgcccaccttcgccgtgaaaagtatattcctaaaggtggtcctgacggtggcgacggaggtcgtggaggtcacatcatcatgaaaggaaatgccaacgaatggactttgcttccccttcgatacacccgtcacgtaaaagctgaacgtggtgaaaacggaggaaaaaaccagcttacgggagctttcggagctgatgtttatattgaagttccggtaggaactattgccaaaaatgaagaaggcgaaattatcggtgaaattttagaagatggacaggaaatcattctgatgcatggtggtaaaggaggtttgggaaatgagcacttcaaatcttctaccaatcagaccccaagatatgcacagccaggtcttccgggagaagagggttatatcgttttcgagcttaaaattttggctgacgtagggctggttggatttccgaatgccggaaaatctacacttctggcatctgtttctgcggcaaaacccaaaattgccaactatgcttttaccacactgactcctaaccttggaattgtagattacagaaattacaaatcatttgtaatggctgatattccggggattattgaaggagcagctgaaggaaaaggcttaggacacagattcctgagacatattgaaagaaactctatcttattgttcttaattccggctgattccgaaaatcatttccaggagtttaaaattcttgagaatgaattaaaagaatacaatcctgaattactggataaagatttcatcatttctgtttcaaaatccgatcttctggatgatgaactgaaaaaagaaattgcagcagaatttcctgagaacagacagccgttgttcttctcgggggttaccggtgaaggtcttatggaactgaaagatgccatctggaaacaattgcacggataaaattgtacagtgagttacttttatagtaactgcatcataaaaaaaacagcctcagatttctctgaggctgtttttatttataaaatggcccttattgaaatcaacttaacagatttatccctttatatttaacataaaaacaaaaaaacattttatcttttggaacaattattgaagtgaccctttgaaattgaaaagctatgaaatatttactaggcctttgtgcattgatctttttattttcctgtaacacttctcagaaagtaaattccagatattctaccattgaatatgaagcgactccatgttttggattctgccctgtttttaaaatgacaattaatccggacagaactgctgtttttgaggcagaacattttaattttaatgataagccttcaaaggatgaattttccaagccacgtgaaggcacttttaaaggaaccatcaaagaagaagattataatcaattaatcagcttgctggatgggcttaatgtaaaaggtttaaatgataaatacggagagcacaatattacggatcttccaacctcatatttaagaattaaatttgctgacggaacttcaaaaaatgtagaagattatgggaaacgcggaagtgagaagctttcggaagtctataagttttttgagaatctaagaaaaaaccagcaatggactaaggtgaaataagccttataaaaatatttaaactatctttgccataataattccttcttctgggaggaattattattttacagaactattaaccattcaaaagaacatgaaaaagaacatttttttcgctctggcatttgttttatcaacaataagtaatgcacaaacaacttccgaatcgatgagctttggggtaaaaggaggatatacattatccagcatgaaattctttaacacacagctcgattcaaaatcttatttctacatcggaatcctggccgagcagccattgtcctctaagtttggtttgcaggccgaagtattatatacccaactgggaggtaaagacgcttatccctggtatgagttggtaggcaatgaagtggtaaacatgggtaacatgcactttaattataaattcaaccagatacaggttcccatttcagtaaaatattatattgtcccagagctttctgcttctgtagggatgaacttaggatttaatatttcatccaaagtaaaaatgaatactgtttttgatgaggctgaaacacacaattacgaatctttaaaaaccttgaatttatttccatttctaggtgcagaatataagattaatcagaagttttttgttgacgccaggtacaatttcaattttatagaaatgaataaaaataatgcggttcctgttaaaataggatttctgcaggctggtgtaggatatagatttaaataaactgcagatatttaacagaaaaaatggcggctcatattcgggctgccatttctgtttttcaataggcaataagtctacaaaagcggaatgagatacttaaaaatatttaaactacctttgcacaatgtaattctttcagactgaaggaatttttatttaaattttaaaataattcatttgaattttacagacttaaacttaatagaacctattgcaaaagcaattcaggagcaaggttacacgactcctactcctatccaggaaagatctattcctgatatattagacggcagagactttttaggctgcgcacagacaggaacaggtaaaacagcggctttttctattcctattctacagaatttatccaaaaataaaattcccaataaacatataaaagcactaatccttactcccaccagagaactggccattcagattgaggaaaacattaatgcttatggtaaatatcttccgttaaagcaacttgttattttcggaggagtaaaacaaggaaatcaggaagctgcattgaaaaaaggagttgatattctggtagcaacaccgggaaggcttttagacttcattgcacagggaatcatcagcctgaaaaaccttgaaatctttgttcttgatgaagcagacagaatgctggacatgggatttgtgcacgatgtaaaaagagtcattaaacttttaccacagagaagacaaactttatttttttcagcaacgatgccgggtgaaattcagaaactggctaactcaattctgaataatcctgtaaaagtagaagtaactccggtttcatctacagcagatactatcaaacaatctgtatattttgtagaaaaagacaataaactgaatctgctttctcatattctgaaaaatgatatttcagactctgttttggtttttgccagaacaaagcacggtgcggataagatttccagaaaattacagaaagacaatatttctgcagaagctatccatggcaataagtctcagaacgcaagacagaatgctttgaataactttaaatccggtaaaacaagagttctggtagcgacggatattgcagccagaggaattgatatcgacgaactgaaattcgtaatcaattttgagctttccgatgtttctgaaacctatgtacaccgaatcggaagaacaggaagggccggagctgaaggcacctccatttcttttgtagacggccttgatcttttaaacttaaagaacacagaaaagctgatcgggaagaaaatccccgtggttaaagaccatcctttccatacggatgatctggttgcacagaagagagattccaataacaaaccagttcctgccgggggtgaaaaacctaaagcaggcaacaataataattcaagatcaggtaaaaaccgtaaaaagccttcaccaacggcttcagtaggatttaaaaaacctaagaataagaatttcaccagaaagaaataaaagacaaacccctttcaatattggaaggggttttatttatcttgtcattaaattgtattacttaaaaagtttctttgcattttcagttgtagtacggtctatttcagaaaagtcttttccataaatattcaccagttttccggctacgagatcaagatatgaactttcgtttctttttcccctgtgaggaaccggagccagatatggagaatcagtttccagaacaattttatctaatggaatttcatgcagaaactgatctatctttccgtttttgaaagtcactactccaccgatgcctaaaataaaattaagatcaatagcatgctgcgcctgttcaagattccccgaaaaacaatggaaaattcctctcagtttcggatgcttttttctttccagtacctcaaaagtttcatcaaaactttctctcgtgtgaatcacgatcggaagatctttttctattgcccaatcgatctgctgttcaaaagctttcacctgaatatccaaagttgttttatcccagtagagatcaattccgatttctcctattgcaggaaaatgcctctgatcgagataatttttcacaatttcaagttctttctcccaggattccggttttacataacatggatgcaaacccatcattgaaaaaatctgtcccggatattccgtttccagctgcaacattttttcatgggattcagagtcaatggcaggaaggtaaaattctgtaattcctttatctaaagctctctggatagcttcttttcggtcttcatcgaattcttctgcgtatagatgtgtatgtgtatcaatcattttatttaaatttcaacagatcttcataaggattttccagtcccagcaataatccgaaagccggttctgtttttatacccttttttttcagttctattattttttgtttaaattcttctcctttttcctgtaatattttgtattcagcaatcatatgaaggtatgcattctgctcagttgtcggtttattctgtccaaaaatctctatgggaaattcatccaccatgaaatttaatgtaatgcatttttcaccatttatgataggatattcaactttcgtttccacgttgtgaggaataaacctgctgaacatcaaatcatccagaaaatcttcttcgaagtctaaatcaacctcaaaaataagatccagatcacttccttctatgtcaatttcaataggaacagttcctgccaaaataggtgaataagcttttaatttttcaaaaatatgatactttgttagaatattataagcttttttctgcctttcatttccgtttttcaaatagtcaatctttgtaaaatcaggcatttagaatattttatgttttactttcctacgctgattttctattctttgatccagcttttctctgaactcaataaattttgggtctttcttatcattggtcttatgctccagggccttgataattttaaaattttctttgataaaatccttggtttcatcagaaaaataagcatttccaaatttctcgaaaatataattaacagcctgcgtactgggatgaatcatatcttctttataaaaacggtaatcccgcagatcatccattaaaatttcataaacgggcagataatggcagtcttcgaacatcgaaatcgattcgtgaattgctgtaatcagtttggatttacttaactggttttctaccattccatccttggtatgccttacaggtgaaactgtaaacaggatctgtactccttctttacagatgtctttaagatccagaatggtctggtaaattgagctggtcagttcctggtgggaaagcagtcttttttcaaaaaacttctgtggaattttgtgacagttggcaaccagtttatttttcggcagaaattcataaataaatgatgacccataggtaatgatgatccagtcggcttcctgaagaaaggcatttcccgcttcaatggcgctgttaattttatctaaggtctgatgaatatagcgggtatcaaaactggtgtggtggtccagagaaatatattcatcattgtaagtaatcagttcctcttcttcataaaatgcagaatcatgtaatctgttgactgcattattgatagaataaggattgaaaatggtcccaaaaggattatttaaagtctgaagctgcccgtcctgcagtaagtctgtcatttcagaggcaaaacatgaacctatcgaaaatattttatcttcaatctcaatctttttacctgatgcggggatatcaacttctgtcctgaatttcatttataagggattaggatttaggtatcaggactcaggccaactaattcctaagccctaattcctataaccttattttaactttctcttctcaacaaataatttgccagttcgataaaaggttttttcttctcttccggtacatctattttctgaagatagctttgtccgatttcattatgcttttcgatcaggcgcaatgccttctcatctacttttgttcttctgaaaatcttttcaactccgtataccttatctacattttcagtttttttggaataccagtaatccagctcttttctttcttcatctgtagcgtgttctcttgccagcagatacagaacggttttcttgttttcataaatatctccggcatgctttttcccgaattgtgcctgatctccgaatacatcaagataatcatccataatctggaaggcaattccaatatgttttccgaaattgaaaatcgctttggcatctttgaagtctgcttttgcaatcaaagctccgatctcaaatgaagaagcactcagaacaccggtcttgtatgtaatcattctgatataatcgtcaaaagtaacatccttctgggtttcaaagttgatatcatactgctgtccttcacataataaaaggcctgtgtgggtaaatattctgatacatgccttgaagatttcaggttcaagatcttcaaaaaatttatacgctttaagcatcagtccgtccccggaaaggattccaacattaagaccatgcagggtatgaatagttggcttatttcttctcaaaggcgcctcatccataatatcgtcatgaatcagcgtaaaattatggaaaaactcgatggccagtgcaggcttaattgcttctttaagatctcctccgaacatctcacatgccataagcaccataatgggacgaagacgttttccaccatgggaaataatataattcatcggctcatatagttccgaaggtttatctttaaaagtatatttcgtgatagcgtccgcaacaatctgctggtatctgtctaaaaattccataaaatcttataatttgaacaaaaatacgatttttcaaggctttataaaacaaaaaactttgcccttttggacaaagtttatatgataatatgagttatatcttaagataagaaagtcaccacaagataggtaattcctgctacaatagctgagattggaattgtcaatacccaagcccaaagaaggcttaccgtaatcccccatctaacagctgaaactctttttgtcaagcctaccccgatgatagaacctgtaattgtatgggttgtagatacaggaataccgaagtggtctgtgatgaataaagtaatagcacctgcagtttctgcacttactccttctaatgaagttactttagtaattttggttcccattgttttgatgattttccaaccaccgctcatggttcctaaaccaatggcaaggaatgaaaccaaaggaacccagatataatgctgagcaaaataatcaaaacgttctgcagaaggaatattcagatactgaacatcctgaagcatgttaacgtgataataaattactgctgcaccaatgatccccattactttctgtgcatcattcaaaccgtgtcccaagctgaataaagctgaagaagccaattgcagccttttgaaagactggtctgctttgtgcgggtttgatcttttataaaggtgtataataatcagtgtaatgataacggagataatcatccctataatcggagccatgaaaatgaacaggaagataggaattactttatcaaacttcaccacactctgatgtgttacctgattgaaagcttctttaatggtgccccatgttccaaggtccggctgggctgctgccacatcatgatagtccatcatgaaagcatgcataagagcagctccaaggaaaccaccgatcagcgtatgtgatgatgatgatgggattccgaaccaccatgtcagcaggttccaggcaatagctgccacaagaccggaaagtataacttcaagggtgataaaattctcgttaactgttttggcaattgtattaccgattttgaattctccaataatataagcagcaatgaagaacgctgcaaagttccaaagcgccgcccaaagtacagcctggaatggagttaaaacttttgtagaaactatagttgcaattgagttggcagcatcatggaaaccattgatataatcgaagataagagccagcgcaataataactatcagtaaaataggaaattccattttttgctatgtattaggcgtatttaatcatgatgttctcaatcgtattggcaacatcttctgctttgtccgttacaacttcaaggtagttcaatacagatgaaactttaataatgttgatggcatcattggtttcaaataattctaccattgaattggaaagcaggtcgtccgcaatattctcaatagagttcaccttaatacaagcttctttcacctgttccatatttttaaaccctttaaggtttttcatcgcattctgaatttcaagacatgctttgtgaatcaataaggagaagtctgaataagccttcatctcaggtgatttataaaggaaaatatattttgtggatgcgtagatataatcagcaatatcatcaagtcctgttgccagcgtgtggatatcctcgcggtcaaaaggtgtaatgaaatttttccctaattctacgaaaatttcgtgtgtaagttcatcattcttgtgttcgaagtcactcattttcttcaacattgaatcatcattaagatcgaaatccttgattcctgtgttgaattcttctgacattgcaactagattttcagttactttttcgaaaagtacaaagaagattttatcttttggttgaaaagcgtggaaaatattaccaattcccattttttagtatttataattcgagtgcaaatttcttaaaaaaggattgtacgtgaaactatataacattaagttttgttaacattcgcttaacaactgattatcaaacaaaaaaaccggcataaatgccggttttatatggttttgaaagagattagtttgctacttcagctctcatatcttttcctttaaatttcatggattgaatattgctcaaaacattgtctttgaacgatttttcaacttcgaagaaagagaatttctctaagatttcaatatcaccgatttcagctcttttcttgctttttccgccagcagtagctttattgataatatctaaaacatcaagtttctttaaatggtcttttttaccaaggttgaagaagaatcttaccatgttttcatctcttcttcttggctttccaccacgctccctgtctcttcctctgtctctgtcgcggccacgatctctgtctctgtcacgtcggtctcttcttgagtaatcatcatctctgctgcttaatttttgctcaacaaggtcatgcttgtctttgtagtataaagcaagatctttcagctggaactgcagaagctggtgtaccagttcttcttttgtaaagttgctcagatccgggattaaactgtcatcaaattcaaaaagatcttcgtgctccgtcaataatttttcgaatacacctcctacctgagctttgataatatcatcccctgtaggaattgttctttcatgaatttcaatttttgttgcagatttaatctgtttcagttttctgctttcttccggcttgatcagagccatagaaataccgtcttttccggctctacctgttcttccgcttctgtgaacgaatacttcaggatcatccggtaaagagaagtgaataacgtgagtcagtgagtttacatctaatcctcttgccgcaacgtctgtcgctacaagaatatcaatgtttttcaatctgaatttcttcattaccgtatctctctgcgcctgagaaaggtctccgtgaagagcatctgctgcatatccgttctgcattaagaaatcagcaacctcctgagtttccattctcgttctgcagaagatgatagaatactggttagggttggcatcgattaatcttttcaatgcttcttttttctggcggtaccctaccacatagtattcatgcgtaatgttcttcttcacttcgttgatagaacctacagaaatacggtgaggttttgtaaggtaatttttggaaattctttccacttctttattcatcgttgcagagaataagaaagtctgttttgtttccggagtttcgcttagaatggtttccaattcatctttgaatcccattgaaagcatttcatcagcttcgtctaatactaaccaatgaatggcagaaaagtctaatgcctttctgttgataagatcaattactcttcccggagttcccacaatgatttgcggtttatccttcaaagatctcatttgctctacaatactacttccaccataaaccgcagtagttttgatgtctttcatgtacttagagtaattctttatgtctttagaaatctgaagacataattcccgtgtcggacaaagcaccaataattggattttgcgactcgtatcgtcaatcatatccaaaatcggaagcgaaaacgctgctgttttgcctgtccctgtctgcgcaagtgcgatcaagtcgcgaatatctgaaagaataaaagggatagtctgtttttggatttctgttgggctttcgtaacccagttcgccaattgccttaaggatatcaggacttaaattggtttccgtaaataaattcattaactattttaaaatttttgcaaagatacaataaatatttgatttgtttttgaataaatttttaaatatgcaaacttaaattcacaatcttttaatgtatttttaatttttggaaaattaaacctaaaaaaacatgctttgagttaaaaacttgctaaacattatttttttttattaaattggattgattttttctgtgttatttatgaattttcaaaaataaagccatgaaaagcaaatttttctttttgatattctcatgcatagccattgaaatatttgctcagacacctcattatccacccgcctggacattggaaaactgtatcgaatatgcaaaagcaaataatatttccattaattctttacggctttcaaaaaattcggccgaacaggatcttctccaggcaaaagaagcaaaatatcccaatttaagcggaactatttcacaaggactttttgccctcaacggaagtaacggacttcatatgaccggtgcacagacacaaagtataggagccaattcatctatgacactttatcatgccaactatatcaaaaacaacgaagcttcaaaaaatctcctggtacagatggctgacctttcagtacaggaagcccagaacagcatcacccttaccattgcacaggcttatctgaatatcctgatgaatcaggaaaacatcatttctcttgaaaatgtactgaaaacaacacaaactcagttaaaacaaggagaccagctatacaaagcaggaagcctttctaaattaaattatcttcagatacaatcacaggttgcccaggatcagtataacctgaccgctgcccaaaacaatcttcggaccaatactgttaatctgaaacaaatcctgcagcttccttcagattatgattttcagatcgtaaaacccgacagcattatggttgacaaccagctgaagcctctgcaggatgtacaaaacctcgcacaagatcaacgtcctgaagtaaaatatggagaactgaacgtagaaaattccaatacaaatctgaaaatggccagagcctccattcagcctacattgagtctgacaggaaatattttcaccaattactctaacggaaacggaaattattttaatcagctgggaaacaatttctacatgcctatcggcttaagccttggcattccgatttacaacaacagaatttataagacacagattgagaaatcaaagattgccattgaacaggccaatcttgacttactgaataccagaacggttcttaaccaacagatagagcaatcttatatcaatcttcagaatgcactgtctcaatatgattctgcctttaagcagatggacatcagtaagcaaagctatgatatcgtcaacgctcaaatgaaaataggaagtattgactatgtgcagcttcaacagcagagattgctttatatacagtctgttcagaattatctgcaggccaaatatactgcagttcttaacaagcagatctacgaattttacgcaggtaaccctataaatctaaagtaaactatgaacacaaagaataaaaaatggttatactgggttgtgggcggcatcattgcaataggtgcagtctggtttttcttcatccgggaaaaagaaataaaaatccagcttgagaccataaaacctgaaatgggagacatatccaattccattactgctacaggaaccattcagcctgtcgatactgttgcggtaggtactcaggtatcaggaattatcaaaaacatttatgtggatttcaattctaccgtaaaaaagggacagttactggctactttagatcctgatctattgaagtttcagtcagaacagatcaaagccaacctgcaaaatgcaaaaagtaatcttgcttacaacgaaatcaatatcaacagacaatctcagttgtacaaagttggagcgatcagcaaagcagattatgataatgccacaaatcagtacaatgcagcaaaagcacaggtaaatgctgtaactgcacagctttctaccgccgataaaaacctgtcattgactaatatctattctccaattgacggaactgttctcaacagaaatgtaagtgagggacagaccgtagcttcaagcttcagcactcctaccctgttcagtattgccaaggatcttaccaaaatgagggtacgggcctcagtagatgaagcagatatcgggaatgtaaaagtgggtcagaaagcaacatttaccgtagatgcttttccggatgaaacttttgacggtgaagtgtccgaagttcgtcttcaccccaccgtttcatcaaatgtagtgaactataccaccatcatcaatgtagataattccagcttaaaactaaaaccgggaatgacagcaaacattacgatttacacacaggttttaaacaatgttatgaaaattcctgtggcagcaaccagcttccggccagacagtcttgtgatcaaaaaatacaaagttaattctccgtttgccaatggtaaaaagcgcgaaaaaggacaatggaaaaaacaggataaaggaaccgaaaataaaagtgaagcagccgtctggattattgctaaagacagtactatttcccggaaaaaaataaaaacaggaatggacaatgataccgaaatacaggtaatatcaggattaaataaaaatgacaatattatcaccggttataaagttctttcaaaaaaaacttccggcggacaggctaaaagcccattcatgcctcaaagaagaggtggcggaaataacagaaacagcggcggcggtggcggcggaccaagatagcttaaattgtaaaggactatcaaactcaaccagattaaccagcaaccagcaaaacaaaaaagccatggcagaaaaaattctggagatcacagatctgaaaagagagttcaggatgggcgaagaagttgttcatgcactgaaaggcgtcacatttaccgtagaaaaaggagaatttgtaaccattatgggaagcagcggatccggaaaatctacccttctaaatattattggctgtcttgacaagccatccggcggcgattatatcctggatggcgttaatattaagaaccttgaccgtgatgagctggctgttctcagaaatcagaaaataggttttgtattccaggcttacaatcttcttccaagaacgactgcaaaagaaaatgtagagctgcctctcctctacaattctaaaatatctaccgaagagcgtcataaaagagctatagatgccttaactgctgtaaaacttgaaagcaggattgatcatctccctaatcaaatgtccggaggacaacaacaaagggtagctattgccagagctttggtaaatgaacctgtaatgattcttgcagatgaagccacaggaaacctggataccagaacctcctatgaaattatggctttaatgcaggatctgcatcagcaggggcgaacaattgtttttgtaacacatgaacccgacattgccacctttagcagcagaacagtgaccctccgcgatgggaaagtgatcaaagacattcagaatgacaatataaagtctgccaaagaggctttggaaaaccttccggtaaatgatgattataaataatatcaaactgaaaatttattaccatgaacttttcaaaccttttcagaattgcatggaaagctcttttacggaataagcttcgtgcatttttaactatgcttggtattattatcggcgttgcttctgtaatcgccatgactgccattggtgaaggttcaaaaaaaagcatcagcgatcagctttcttctatgggatccaatatgatcactatccggccgtccagtaatgtgaatgtttccggaggtgccagaatcggtgcttcaggattacagactctgagacctcaggatgcggacgccatttcaaaaggagcagcagatgtttcttatgtctctcctgcagtgcagactaacggacaatcgatcaacggccctaataactggccaactcaattacagggagtgaatgaagaatattttaacatccgggactggggcatttccgaggggaatcttttcaccaagaaagacgtcacctcatccaataaagtctgtcttttggggcaaactgtttacaacagtttatttcccaatggtgaagatgctgtaggaagtattataaggtttaacaaagttcctatgaaagtcattggaatccttgctccaaaaggatctaatgcattcgggcaggatcaggatgatgtgattattgctccgttcaataccgttcagagaagatttttgggaattacctatgttcagacgatttatgcagcgtcatcgaatgaaaatacatcgcagcaggcgacagaccaggtatctgagatcctgagaaaacagcacaaactgccagccgacggaagcaatgatgatttcagtgtgagaacccaggctgaactgatctccactatgagttctaccagtcagcttctgaccgtacttttatcagcgattgccggtatttctcttgttgtggggggaatcggaattatgaatattatgtatgtatcggtaacggaaagaaccaaagaaattggactgagaatgtctatcggcgccagaggtaaagatattctgtatcaattccttattgaagcgatattgatcagtattaccggcggaattcttggcgtacttttagggatactgtcttcggaactcgttacattttttctttcgtggccaacatttattacagagtcatcaattataatctcttttatcgtctgtgccgtgacgggagtctttttcggatattatcctgctttgaaagcttcaaaacttgatcctattgaagctttaagatatgaatagtttttgtacatttgaatgataggctttcagattcagatttagatttcgaggcttagcaacaacaaaataaacacccaatacaatatgtccgcaagcatttcttccaagacgtttgattttttaaaaaaattaaataaaaacaataaccgcgaatggtttaatgagaataaaaatctctatacggaagctcagcagaatgtagtttcatttttagatgaactaattaaggaaatgtctggttttgatgaagagcttgccaagattgacagtaaaaaagcattattcagaatttacagggacacccgtttctcaaaagacaaatcaccttacaaaaccaatttcggagcttctctgggaatgggtaaaggaaatcagaaaggaggctattacctgcacatggaacccggaaaatcttttctggcaggaggaatttatatgcccgaatcttctgtactgaaagaagtccgtaaagaaatttcgctgtatggggatgatttccttaaaattctcaacaataaagaattcaaaaaacactttcctgaacttgaccaggacgacaaactgaaaaaaattcctcaaggtttcgaaaaagaagatcccatgggagaatatcttaagcttaaaaatttcatcgtgatatattctgtgaaggatgatgaagtgctggataaaaatgctgtgaaaaatatgaccaaaattttcaaactgatgaaacctttcaatgatttcctgaatgctccttttctttgatacctgagttttttgaatccggatccctcaggtcttccaggacaaacgacataattcagcaaattctgctttgcagtacttttggtaaagtttcaaaaataaacggctattttgttactttaaaaactcactaaaattcaaacggttacaaaacatttttttacaatctctactgaaattcaacgtattataattaacattttttaagaaaagttttacatttttatgtatctttgctgttcgccaaaaagcctacaatgtctttataccaaaaaattgcagaaaaactacagtatataagtccgaatttctacaaaaaaagatattttaaaactttaaataatcttagtaaaaataatttttcggagcgtaatgtagaaccggaactggtatggattaaagaatacctttctaaaaatgcagtgatattagacattggtgccaatgtgggaaccttcctgtatcagctggaaaacgcactggatcatgaaaacatttatggttttgagcccaataagaaactttaccgaagactgaaaaggctgtttccggcaatgcatatccttcctctggcactttctgatgaaaacagaattgcagagttcaaagtacctgtcattaatggaaaaacgattgcttcacgcggtactttaaacacttcttataaagaaaaaggggaagagaaaagctatacggagagagtaaaggttatcaagctggacgaatgggctgcactggaacatttcaacagacttgatttcatcaaaatagacgtagaaggaaatgaaataaaaacattgtccggagcgagagaaaccatcagacgatttcagccgactttaatggtcgaaatggaacaaagacaccacgacacccctatctggaatgaaatatccgaagtaatgaactggggatacgaagccaaatacctgaacagaaacagctttatgctggaaaatcttacagaagatattataacacaaaatacaaacgacgaaaaaaataaaactcagtacatcaacaatattatttttatacctaaaaacatttaaaacaactttatgagtgtagtagcgagacaaggcttcaaatattccattatcggttatattggttttttgctgggcaccgtttccgcaatattcatatttccgaatgattttgaattttatggaaagctgcgctacattcttcccaccgcagaaatgctggttccttttgttgtattgggtatctcctattcgaatgtaaagttttttcacaccgtggaaagagatggcaaaaagcagaatatgctgtcactgtcactgcttactgtttttatcaattttcttattttcacagtggtatttttcttacttccttatttttatccgaagttcaggcattctgaggcatggaagatcaaagaaatgattcttccgctgatcttaatcctttcattttgtgctatttttaataaatacacttccaattataagagaattgtagtttccaatattttcgataatctgtttccgaaaatagccaatctcggagcattctgtctttttttctttgctttatcccagaatatcaatgcggcaatatcacaaaaaattgcgtttgctttcttttttggaattttctttttgatgctgttgggctacatttattacaccaataagcttgaaaagattcagctggattttaatacagattattttaagaagaataatttctggaaagagtttttcaattacagtttcttcggatttctagggactttcgggaattacctggccatcaacagttttatgatcggggaatttatgggaatggaagaagtaggaatttactcggttttatatgctcttatttcactgatttctattccacaactgggattgttcaatatttctgctcctatcattaataaaacactggcagacggagatatggtagaactggacagattccataagaaaacatctttaacactgtatttcctgggtgcggttttattttcctgtattatggtagggtttccttacctgacgcaatttatgcccaagaacggaaccatgctcagagaatatgagcctgtggtatggatctggggttctgctgtattaatagaccttgccaccggcttcaatggaaatattatttcactgtcaaaatattacagattcaatattctggttatgcttttactggctgggttaacgatcggactgaattattatttcattaaaaacacggatctcaaactgatcggaattgccttatctacagcgatctcccttacgatctacaatgtggtgaaaatcgttttcaattatattgtctttaaggtttcgcctttgagtattgaaatgatttttgtttccatcatatgtacgctggcaattacagtagccattgttcttccaaactttaacagcaatctgcttaatcttgtttataaacccgcagttgtcttactgttgatttatattggaaatcatttcacaaatatcttccctgttgaagattatctgaatataagatttattaagagtgtgtttaagattaaataatcacttcccagattgaaatagtgagaggaggcgtcggagattcagagtaagctgtataaaaactgctccagttttttctgaatttctttcctgccatatgttttgtaaaaatcaaatgaggtttctgaaagtgcagttagctgatcaataacattttctttctcaggaataataaaatcaagttttgaaggataatttcccggaaaaacagctaactttccgtaagcgacagcatcgccaaggttccccgtcattttagtcacaccataagtttctttcatgctgaaaaattccgtttcctgctgaatcggacaccataaaacatctgctttctgcatccatctttcaaaatcttcagatgaaactctttcagaaaaataagtgatttcaatatttccaggcaatttttcagacaactgtacgagttgttttaattcatgcccagttgcttttccaaggaaaacaaacttataaggtttatcagtcttcagattctgaatagttttaaaaatatagtcataatcccttcttttttgagatactccgccgggaataagtacaatgaaattttcattttttgttttgtcaaaatcccttgtataaaatagcggtagaaactgatacttttctgagattaaagcttcatccaataccaaaagagatccggaagtctgatatacctttgttttgtagaatagcccttctttaaaccatagttttaatctgaaaacaacgtctcctttgaaaacgctttttatcagatcaaattttgatgctttgataaaattaaggttatgggaaatgaccgctgtattatacttttttgttattgctaaaaatgtgttaaaataacggtgaaccgttccaataacaacgaggtcataatctttcccttttaactgatccagaatcatcgagctgtctgataaaaatacaggctcatcactatgattaatctgatctttaattctttttgaaaaataatagtctactgaaaactccagagaacctttcataatatccatgaaagccttggcaatttctgcgtgggtgtctatttctatgtaagctatttttttcacgatgggagttacattcttaagtttcggctaaagccgatggattttttttgattaaatgggttaaagccctatttaatttttccaacaatgattcatgaagccttctacaattcctggatttacacttcttacaacttcagccatttcttcttcagcattttccaacgttgatcatttacagctttctgttcttcttttgtaattttcaattccagtttctttgatctgcagccttcataagacttaacaatgtctaagaaaaaaccgacagacttgcttttcatcgcttcttttgaagcggcaatatatgcaagaaacctgttcagcccaaggaaataaaaatatcttccgtaataatcggcaggacgtattgtgtaatcagctccttttactttgatcagctttacatggagttcagataaaacaacttccttccatcccagattttcaagcaatatggaatcaatattatcccagcccagtgtttcccttaatcctcccatctgcataaaacattctttacgataagccttcatagggcctcttacatgatgcttattggaatttccttcatatacccatttgccgtctttttctatgtacagaagtcctcctaccaaaccatattttgggttattggcaaaagctgtttctacagtttccagataattatccggaagaataatatcggcatcaaatttacagatgatatcaaaatcattcagggactgagtctgaagtccgcttttaaaagcataaacaacttttgagcccggctgatgttctgacttctgaagagtaacggtttcaaaacgggaatccgcttccgtatatttcctgatgacttcaggtgttctgtctgtagaaccgtcattcacgaccaccactttaaaatccttgctgctttgctgctgtaaagaatcaagagtaaaggagaggttgtcttcttcgttatgagcaggaattatgattaaaaacctcacgggaatgataaattgatgaatgatgaatgagtaatgatcaatgataagaacccactaagagcatcaattatcactgatcattaatcgtttataaatttatttgttatgcggtttcagcatgtttttcggatcaaggatctcatccagtttttcctgggaaagaattcctttttccaacacaaggttgtaaacgctttttccggtttccaatgcttcttttgcaatctgtgtagactgtttgtatccgatataaggattcaatgccgttacaattccgatgctgtgttttaccatattcaggcaaacttctttgttggctgtaattccaaccacgcatttctcacgaagggtatccaaagcattacaaaggaaattgatgttttccataatagcatgggaaagtaccggttccattacattcagctgcaattgacctgcctcagcggcaaaagttacggtaagatcatttccgaatactttgaaacaaacctggttcaccacttccggaatcacaggattcactttgccaggcataatagaagatcccggctgcattggtggaaggttaatttcaaaaagacccgctctcggacctgatgaaagcaatcttaaatcgttacagattttagatagtttaacagctaaacgttttgttgcagaagaatagattacataagatcctgtatcaggagtagcttctaccaaatccggtgcagaaacaatcgggaatcctgtaatctgggctaagtttttagcacaaagagtggcataacctaccggagcatttaatcccgttccgatagctgttgctcccatattcacttccacaaaaaggctggcattgttattcagcttggaaatttcttcttcgagagtggcagcataggcttcaaactcctgtcccaaagtcataggaacagcgtcctgaagctgtgtacgtcccattttgatcacatcatgaaactcctgtccttttgcacggaaagccgcaataattttttccagtctttccaccagtccgatattcatctgaagcaatcccattttgatcgctgtaggataagcatcattggtagactgtgaaaggttgatatggtcattaggtgaacagaattcgtattctcccttattttttcctaatttttccaacacgatattggcaatcacttcgttggcattcatgttgatggaagtccctgccccaccctggatcatatctaccggaaactggtcatgatatttcccttctacaatttcatcacacgcttctgctatcttgaaatacaggttttcgtctaaaagccccagttcatagttggtttttgctgctgcttttttaacaaaagccagccctcttataaacttcggatacgaagacaaaagctgtcctgaaattttaaaattgttgatagctcgttgtgtttgaaccccataataagcgtctaaaggcacattaagttcgcccaataaatcactttcttttctgaaattttccattacagatattttactgtttttgatcgtttaaagatagcaaaaacgcatctaaccgatgcgttttaatctgaattattttaccggatatttttgatttaacgcctgcagtattgcccatgtttcggcatccatgattccgtcataattctgtggacggaaatgatactggaatgcctcaattgttttcttggtggcgtcatcccattgtccgttggaatcaagtgcatatccgaatttctgcagtgaagtctgaataaggaagataaagccaggctcattatattttgcggtaatgtctgcctgagcagcttcaagataagtttgcttagctgcttcgtcataccacattccaatctggtattcgtcatacagctttttccatgggaacataggtcccggatcctgctttcttgtaggagcaatatctgaatggccaagcacattggtaggctgaatctgatatcttgttacaatatctttaaccaatgccgctacttttttcacctgatcgtcactaaaaggagcaaatgttcttttacccgtagcatctgtcgtatatcctgtatttacaatttcaataccgatagaagtatcattaaggtttttgtcgtttctccaagcacttactcctgcatgataagagcgtttgttctcatctaccagctggtaaatctcattatctcctgtattatttaccagataatgcgcactcactgcctgctgggtaagaactgtaattgatttgtcgtccggaagtgcggtataatgtaatattaagtaacgctgtctgaagttctgggcaatggccggaaaataggtcttcactactttatatccggctggttttgcagatacaatagaaccataacttgccgtgttatcattttttgttggatctgctatattggtagtaaaaaagtcgaccccatgatcagataccacttttggttttggagcaaccggaggtgttgtctgaactgttggtttcgcctgtgttaccggggttttcggtttgtacgtattttttttcacattttgttgggaagtacatgaaaaaacaaatgtgcttaatccgatgatatataatgtcttacgcatcagtttgatttttggatgatttattacttcaaaaatacacaaaattttcttgaattttatttggtaaataaagaaatctgttctatatttgcactcgcaataacggaacaacgatcattaaaaaataaacaaaaaggagggttgccggagtggttaacggagcagtttgctaaactgtcgacgcgaaagtgtcgcaagggttcgaatcccttaccctccgctcttctatatattcggggcgtagcgtagtccggtcatcgcgcctggtttgggaccaggaggtcgcaggttcgaatcctgccgccccgactttttaatgtgcttattaactaagcgggaatcaacttttaagggtgcgtagctcagctggatagagcatctgccttctaagcagacggtcaaaggttcgaatcctttcgcgctcacaaaaaacctcacaatttttattgtgaggttttttgtttttattaacttcatacaaattgatctgcacgatttattttcatagaaaatcttgaactttttgtttatattagttctatgtgctattgttatatactacattctaaatctttggataaattctatattggacattcctcagagcctttacaggaaaggttaagaaaacatttatcagatcataaaggatatacttcaaaggctaaagattggattgtagtacattttgaaaattttgactcaaaatcctcagtatataaaagggagagagaaattaaggcatggaaaagtaaatccagaattcagaaactcatacaaacgacacacgggatagagcatcccgatttgtaatcgggacggtcaaaggttcgaatcctttcgcgctcacaaaaaacctcacaatttttattgtgaggttttttgtttttattaccttcatacaaattgctctgcacgatttattttcatagaaaatcttgaactttttgtttatattagttctatgtgctattgttatatacttcattctaaatctttggataaattctatgttggacattcctcagagcctttacaggaaaggttaagaaaacatttatcagatcataaaggatatacttcaaaggctaaagattggattgtagtacattttgaaaattttgactcaaaatcctcagcatataaaagggagagagaaattaaggcatggaaaagtaaatccagaattcagaaactcatacaaacgacacacgggatagagcatcccgatttgtaatcgggacggtcaaaggttcgaatcctttcgcgctcacaaaaaacctcacaatttttattgtgaggttttttgtttttatttactctataaaatattcaccatccactgatcaaaacgatttttatattttcccggccgcatgaatcaggatatccggttctttgatcggatttaagctaaaattctctctctttcagaagaaacaatcagtatatttgtaataggacttattgtatttaaatgttgacagatcaatttggaaggagcataaactatctccggcttgctattgtagaccggtgtaatctccgatgtacttactgtatgccggaaaacggtcttagctggatcaagcaaaatgaactcatgactgacgaagaaatgctcagaatctgttcggtatttacagaaatgggggtcgataaaatcaggataacaggaggagaacctttcgtccgtaaaaacagtattgagcttatccaaaatatatcacaattagccggacttactgatctcagcatcaccaccaatggtcttcttaccggacaacatattccacgactaaaagaatacggaataaaatctgtcaatctaagtcttgacacccttgataaagagcggtttttcaaaattacaagaagaaacagctttgataaggtgatgaaaacgttagatagtctcctgcagtatgatataaaagtaaaaatcaacacagtggtgatggaaggggaaaatattgaggacattattcctttagtaatgcttacaaaaaatcttccggtagatgtccgttttattgaggaaatgccttttaacggaagtgaaactgatatttccctaaaatggaatttcacacagatctacagctatatcaaagatcattttcctgaaattcaaaagacaaatgatcctaaaagttcaacatcatacaattataagattcctggctttacaggaagtataggaatcattgcagcttatacccgttcattttgtggagactgcaacagaataagaatcacgccttccggtatcctcagaacctgtttgtatgaaggaaccggtatcaacctgaaggatgaaatccgtatgggaagaacaaatgaagagctgaaaagtatcattaccggcagcatacacaaaaaaccgaaagacggctgggaagctcagaaactgagtttaaagccatcacaaatacatcagtcaatggcaacaataggagggtaattatggaaatgatcagtgtacagcaggcagaagacatcatcttttctcaaatcagaaatttcgggacagaagaaattttctatgaaaatgccacaggacgaattttagcagaaaatattctggcagaccgtgatttgccgccttttgacaggccaacggtagatggaattgccatcagttttaaatcctatgaaaggggaattcgtgactttaccatcaaagctgtacaggcagcaggagaatctccactttccattgatgatgaaaaggaatgtatagaaattatgaccggagcagcactgcactcttcagtggatactgtaatacgctatgaagatattctgatcaataacaatgttgcgggcattaatattgatatgaaaaaaggacagaatatccatctgaaaggaaaggataaaaaggcaggagaaatacttgtaaaagccaatcaggtcatcacaccatctattctcgggattgcttcgtctgtgggaaaaacatctttaaaggtaaaaaaacttcccagagtcgccattatttccaccggagacgaaatggttccgcctgaacatactcctaccccattccaactgagacgttccaacggaattactatacaatctgttttgaaaaaatataaaattgatgctgactggctgcattggaatgatgattttgaattgataaaaaaggaattatcccaatgtattgacagttatgatattctactgatgagcggcggggtttctatgggaaaattcgattatttgcccaaagcctgtgaagagctgggaataaaaaagctttttcacaaaataaaacagaggccgggaaaacctttctggtttggaaaaagccaaaacgaaaaattggtttttgcattccctggaaacccggtttccgtattcatgtgcctgcaccggtattttattccctggcttgaaaaatctttggaaatccgggaaaaacctcaatatgccgttttacaaaatgatattgattttcccttttcgttacaatattttgcccaggtaaaactcagcatgaatccatcaggacaattaatcgcagaatcagtaaataccaatggttccggagatttttctcatcttgcggaaaccgatgcatttatagaacttcctctggaaaaaactgtgtttaagaaaggcgaagtctataaaatctggagatataatttttaatgtaatcatgacaaatttttcacatcttaataaaaaagaacagcccggtatggtgaatgtaggcggtaaaaaagctacccaccggaaagccactgccaaagccattgtggtgcttcctgaatatattctggaagcgcttcaaaaagatgattttaaaactaaaaaaggttctgttttccaaaccgctatcattgcagggataatggctgcaaaaaaaacgggagaattgattcctctctgccatcctattggtatggacaactgtgaaatagatattgaaattaatgctcaaaatgaaattgaaatctattgtactgcggagatcgaagctaaaacaggcatcgaaatggaagcattgacaggcgcatctgttgccgcacttaccatttatgatatgtgcaaagccatgagtcatgacatcgtaatcaaagaaatacaactcatcgaaaaatccggaggaaaaaatgatttcaaaagagactgatgttccccaattaaacgggctggtactggcaggaggaaaaagccagagaatggggaaccctaaagataaaatcaactggcatggcaaagagcagcggtattatgcggctgatcttttagctccattttgtgatgaggtttttatttcctgcagacaagaccagctggaaaattttgatccaaattacaatgcccttactgatacttttctgaatatgggacctttcggcggaattctttcggcattgcgcttacaaagagatacggcatggttagtcgttgcctgtgatttacctttattggatgaaaaatcgttagagtttttaattgagaacaggaatatagaaaaagcagccaccacttacgaaagtccttttgacggattaccggaaccattaattactatctgggagcccaaaagctatcctttgctcctcaattttttaggatcaggaattacctgcccaagaaaagttcttatcaacagtgatacattgatcctgaaaccaggcaacccggattctttaatgaatgtgaatactcctgaagacagggaaaaagcccaggaaattttaagaaaacagatttaacagaaacagatgagtaacccgcttgaacgttatcattgccagatggctttacccggatttggagcttcgtctcaggaacttcttaaaaacgctaaagtcctgattgtaggtatgggagggcttggctgtccttcggcacaatatcttacttcttcaggcataggaacaattggtcttgccgataacgataccgtctctgaaagcaatcttcaccgccagattttatatgctccggaagatatcggaaaatcaaaagttgatattgctactaaaaagttacaacagcaaaatccatcggtaaacattattccgttcaatttccgggtaacctctgaaaatgtcatggatttgatttctcaatttgatctgattattgaaggaacagataattttgaaacaaaatgtctcctgaatgacgcatgtgtactgacgggaaaacctttggtatatggtgctatttaccaatacgaaggccaggtaagcatctggaatgttatacagaaagatggcacttattcccctaattaccgtgatgttttcccgaatgcggaagaatcacaggtaccgaactgcagagaaggaggcgtactacctacactggcaggaatagtcggatgtatgctggctaatgaagctataaaatattttacacatcccgaagattcactggcaggaaaactctggatgatgaatgtgctgaacggcaaaacccagattatcagattaagaaaaacttccgtgcagattacaggtttgcctcagaccatagaaaccattacgtttgagcagctgatgcaagaaaaggatcattttgaaatcatagatgtccgtacaccacaggaacatgatgattttaatatcgggggaatcaattttcctgtagaagaattacagaaccattcagattatatttcgggttgtgacagacctattttagtttactgtctatccgggaaacgcagtgcagaagcggtgagaaaaattaaaaatatctttcctcagaagaaagtgtattctttaaaagatggtattcaaaaatataagcatacatgacagtaatttatgaattaagagaagcaacaatcactttcgcttttcgacattaatcaataatattctgagccattttctgagaaacagcaatatgttctcccaccatctcatgaacggtttcatcaatcatgacacacatactgttaagggctaaatcattcgcatctgttccaaacggttcctcaatttcgtcagctattgcttcaaacgcaacaaatgtataggctacaaataccacaataagtggtgtaaaccatccgagcgaatccaccagtccgaaaggtaacagaaagcaataaatgtataccgtccggtgcagtaaaaccctgtagctgtaaggaatgggagttgaaataattctctcacagcctccaagaatatcagacagtttatcaaaattttcatcaaagcgggcctgctggatagaatccagggaaccttcatcttttaaattctgtacccattctgcaagcaggcgcatcattacagccggtttatattttgattcagcaacaattttcagctgatcttcatcaagtctggattttaagtcttcataagcatctgttcctctaagctgatgtttcaacgcaaaaacaaaggccccaagcagctgcacaaaattatgaactgaagcctgatcatcttttatatttttcagcgtgatggcctggcgggtcagtgccctggaagtattcagcagagcgccccacagttttcgcccttcccagaatctgtcatagctggcattgtttctgaatccgaggaataaagccagtacaaagccgaacaaggtaagtggtgccggatttagcggaactttaaacgagagaatgattccatgaaaataggttaccagtaaagaaagaattaaaagcaatcccaaacggggaagcagggcgggcaaaacagagccatgccacacaaaaagcattctgaaccagtgttccttttttcttatgatcattgctgaatgataatttattcaaatactatattttatggttgttcgagacttgttccggaagctgcaactacatgatcatcaatctttttaaaaacagcaggatcatgctttcggattttgatacggacatatttggaagccggcatattggcaccgttcaccacgttattgatagataccagtacattagtttccgggaaatacgtcatggtacttttctgaggaataggatattttacaacaatgaaaagtggtgcaatcctttcaattccatcatcataattgaaaaggtctacgtgatctccttctttgaggcctgctttttcaatatctttttcattcatcattacgactcttctttcattgaaaatcccgcggtagcggtcattcaaaccataaacaaccgtattgaactggtcatgtgttctggtggttcccattaaatattcgtcttctgcaagcgaattatctggtacggcagttatattgaaagccgcttttccggggtaaaattcgctgttgaatttcccatctcttggtccgttcggaagataaaaacctcctttctgcactaccctttcgttataattttcaaatcctggaatgcattgttcaatatcattacgaacagcatcataactgttgataaatttgtcccaatccactacggaacgttttcctaaaaccgcttttgccattctgcaggccacatgagtttcgttgatcagatgttttgaaataggatcgagaactcctcttgaccattccacaacgcccattgaattttccgtacttacgtgttgaagctcaccgtttactatatctttttcacttctggaaattaccggtaagatcaaggcttcttttccatggataaggtgacctctatttaattttacagaaacaattactgacatttctaattttcgcattgcctctgctgtaaaagttgtatccggtgcggcagaaaggaagtttcctcccatgcagaacataaatttcactttaccctcatgcattgctttaagcgcgtttacaacgtcatatcctccttttctgggtactttaaaaccgtaatattcctccagtttatccaattgctcagttgttggatgatgattgataagtaacgtcctgtttccctgtacattactatggccccgaacaggacacgctcctcctcccttgattcctatgctccctttcatcagcaggatattcacaatattgtaaatcatttccaccccgttgtgctgctgtgtaattcccattccccaacaaatgatgatccgttttctggaggcaatcatctgtgcagcttctcttagattctcaacaggaatgccacattcttccgataagaaattcaggtcataccgttttaattcttcaaccaattcattgaagccggcagttttatccgtaataaaatcatggtcaagaacttttcccgggtttttggcttcttcttccagtacgagaatttgcagtgcttttaaaagcgccatatctccattaatttttacagggagatacagatctgacaattcataaggcttattgagcaaggcacggatttcctgaggattcctgaaacctttcaatccggcttcaggaagcggattaaccgctataatttttgccccgtttttctttcctttagttaatgcggaaagcattctcggagaattggttcccggattttgtcctatgatcatgatcaggtccgcatcgtaaaaatcttccagctttacggttcccttcccaattcctatgcttctggaaagtgcgtaaccggaagtctcgtggcacatattggaacagtccggaaaattattggtcccgaattcacgggcaaataactggtagacccaggtcgcttcattacttgttcttcctgatgtataaaaaatagcttcatcaggcgaatctaatgcatttagtttttctgcaatttttttaaaggcatcatcccagcttatcggctgataatgtgttcctcccttcggtaaatacatgggttctgccagtcttcccaactggctgatttcaaaatctgtcagctttgctaaatcatacaccgccttttctctgaaaaactctgctccgatcttttttgaggtagcttcttctgccagggcctttgcaccgttttcacaatactcacccagtctggaacgttcatcatccggatccggccatgcacaactcggacaatcgaaaccgtcaaactgattcatactgaaaagggctcttcctccgcgaagaacagaggcattaagcaccaactgatccaatgaatgaatcactgcaggaacacctgctgcccaggccttgggtggtttcagctttagatcctgaagtttatagggtggttctgcagaaggtaatctgctgctttcttttttattgaatacatctttgttttccatgatttccaggtttaaaaaaatgaaaaaatcagcatttcaggttcggattgggataattgtcgctttggtcttccaaagtattatcaatgcatacaaagtctttttctattaagagtttaatttttccggtctgcccttcaaaaccgactctgtctgtggaaatccactctgttatcattaatgcaggcattttcagaactattctgttttcgatgaaaactgctgaaagctctgtatcttccgttctttcaatcgcgtaaataaacggacggtctacaaattctgtaaagcttgaaatgataccgtcttcccccaattttgccacttcggactgggtaagacgaaatctgactgtattatctttaattcttattttcataataaattttcaatgttaaaatggctgccggaatggtaaatattaaaacggttgtcccggagaaagcccagtaaagtaatatcaaattctttggacagatccactgccaggcttgaaggagcgcctattgccgcaacaatggaaattcctgccattgccgctttctgaataagttcaaaactggctcttccgctcagaagcaaaattttattgttcaaaggaagcaaaccggcagatagtgcatatcctatgagtttgtccaaagcattatgtcttcccacatcttcgcgcagtgccagaaggtttccttccagatcaaagataccggaagcatgtatacctcctgtagcactgaaattattctggaatgactgcagtttttcagacaactgatatagcgtttccagggaaacttctgtattttcttttgtatggttacggaaagcgcttactgttcttatagattctatggacccttttccacatacaccacagctggaagtggtataaaagttccggtcagccttcatcagttcaggaacaaaaccttctgcaagctcaacaatgataacattttcattatttctggaacattctgcctgtggagaatatatgcttttaatctgttcacggccggaaataatcccttctgtgaataaaaacccttcagcaagttctgcatcatttccgggagtccgcatggttacagaaatatttttagactcttttttaccttcagcgctgtaagaaaccctgatttccagaggttcttctacagagatatcatctgtataagggaaactgctgctttccctgactttgatgatttctatctgctttacagatttatttgacaacagatttgctttcatgatataatgactggcctagtaaaggtacaaaattttattcctaaaattatgggtgtgctgaaacccactcttcaccatcttcaaaaatttcttttttccagataggaacggtcttttttatattttcaatcataaagctgcaggcatcgaaaaccgcatttctatgcccgtcacttaccacaatgatcacggcagcatcaccgggaaacaagactcccgtgcggtggtgaacaacaatattcttcactgaaaataaggaaatggctttatctgctattttctgtatttccttcacggccatagattgatagcattcatattccagacgggtaacagatttacctttggtatgattccgtacggttcctacaaatgacgctattcctccgcatgcaggatcggagccaagggcaaagcaatctgtaagatcaagtatttgttctgttatttttatatcaaccatatctattagccaccgcttaccggagggattattgctatttcgttagtcactgttatgatctgatcatcttctgcatattcatcgtcaacggcaataaaataggattttaattttttcagttccggaaagtctttttccagaagctccttgagtgctttgacacttgctccttcatgtatttctatttctttttctgaagttccgaaaatatctttcgttattccgaatgccagtattttaagtttcatttttatatgtagcttattaccaatattttattaaaacgtttattccggctatcaaaaccagaacagccgtcattcttttgatgactaaaggattccatttcagggacatcctggaaccgatctgcccgccaatgaacacggcaaaacataaactcatgattctgaaataatccatatctgcagacagcttagataactggccaaagattcctgatattgaatttaccaatatgaatacacttgacgccgctgcaattttccgtggggtatcccatttcatgaggtttaacaatggggaaagaaaaattccgccgccaatgcctaccaatcctgataaaaacccgattcctcctcctaaaaagctgttttttaaaagagatgcttcgccgtattcctgaagattttctccattttttgcttctgtctttatccaaagcaacaatgcagccatgattaaggtggcacctaataccaggaaaaaagtttcctggcttatttttaaaacagctcccaggtatgccatgggaacacttacaagggtaagcggcagtattttcttccaatcaatctgcttatttctgatataaatgaatacgcctcctattactacaataacattacagataagtgctgttaaccgtatttcctgataaggaagactgtacattgccagaacagcaaggtaactggatcctccaccaaatcccacagaagaataaatgaaagcgatgattaaaaaaaagaaaaagatttcccaatgccccatattttttgcagaattaattttcttacaataatactcatttttaaggcgtcattcagggttatcacttaaaagtttctgttataatttgtgagaataatgttgcagattgttttttaaggatggaagatggaagcctgaggatggaagttactattggacctatcaataaagagttaaccaatacttatttctattctcaaacttctttagccaaagatttacactgcttcttttgtttttgttacgctcttagcagcctcgattttcttagtattcctaagttcacgcttcattttacggtagtcccagggagcaatggcattactatcctgccaaagtcctatttttttctgctgtgcagcttcctgcagttttcccaaagaggcatctttggaataggaaaaataccaccatcccaatcctgctttgataagctctttggaaaggtatttcccatcgtcataatacactttcgcaatggatcttccataacggtctgtagtggtttcaaaaaagcttacggttttcccaaaaacctgagcagaagtaaactgttttgcatttttaccaaacgcctgcccattttctggacaatcgacttctgccagcctcagctttttttgctgattgccttttaacagtaaagtaatggtatctccgtctgaaattttgatcacttttccggtcgtctgtgaatataggaatacagggaaaagtacgtacagcagcattaatcgtttcatggggcaaatataaggattagtggggctttttaattaaaaaacctcacgttttgcgaggttttttatattatcaaatttaaattatttgatttttttcacctcaaagttgggagaatttacgaagtgagcgaaataatcttagtattctcgcgcgatttttaatattcagaaatttaaaatccagaagtccacattaggttatttaaagtaaatttactaactataaaatcatcagggtaatttttaaatccatctttcttcttacaactttcaataactttatcagttgtttttttatctaaaaaaactccaataattctctcatcatctaagaaggtattaatagtataagtatggctgacttgaaaaatatattgtaggttcaattcttttattgatctactttcctcacaaattatatcttctttaattaaataatctcgtccaatttctcctacaacactatcaaatcctttttcccaatcaatactatttaattcatacttcctaataaccattccattaggatactctttaaacccaggcagagccaaagctttttctttgtccttctctaacttttccaaatcatcataatatcctagaaattttctgttagtgtgagtctcatcggtatagatatgctcaagtgcatatacaaagtaattcataatatatttatttctttttaggtgggttttgaaatgatctatcaccccatttctttattccttgatattccgagccaggccctacatctgcttttgttttattccattctccttttccatattgttgatccattaatcgcttagcaaaattttccattcatctatttttattaaaatatctgtactggcatattcccataaaaaaagaataaacttttcggtcaggaaaaaaatcacccatttgaataccgtcctcatgattataaaacaaccataaacttttatatttaagttctttacaattgaaaaatcttaacaaataataactgttcgaatctatatagtatgtcataaaaaattactgtttgttttcttgaaatcactgcgaaatcattttgaacgcttttccaatgcaggaatgtaaattgtatagaaatattctttttccattttttataattttagagcaaaccaccatgaacaaacagtttaaatttttaaaaaataaaaaaaggaataaaaaaacgaaaaattttccctcatttttaaaataagttaagtcaatggttattaacctggtaaaggtaataaaaaagttttcatgaaaaattaattaaaaattattctcaattttatttttttatttgaaaaagtattgtacctttgcaaccgcaaaaacgaagtaaaactcgttactgatgacaccctcggggcgtagcgtagtccggtcatcgcgcctggtttgggaccaggaggtcgcaggttcgaatcctgccgccccgactgttttaatagttttttcaaaattatttaatgggtgcgtagctcagctggatagagcatctgccttctaagcagacggtcaaaggttcgaatcctttcgcgctcacttaaagacttactggaaacagtgagtctttttttgcttatcactcaaaatcattgacagccaaaaaattgagcatcccggttttaatcgggacggccaaaggttcgaatcctttcgcgctcacttaaagacttactggaaacagtaagtcttttttgtttttatctcattattaaaaatcttttgcagctaaaaaatagagcatcccgattttaatcgggacggtcaaaggtgcgaatcctttcgcgctcacttaaagacctactggaagcagtgagtcttttttgcttatcactcaaaattatttacagctaaaaatagagcatcccgattttaatcgggacggtcaaaggttcgaatcctttcgcgctcacttaaagacttactggaaacagtgagtcttttttgtttatcactcaaaataattgacagctaaaaaatagagcatcccgattttaatcgggacggtcaaaggttcgaatcctttcgcgctcacttaaagacttactggaaacagtgagtcttttttgtttttatctcattattaaaaatcttttgcagcaaaaaaatggatcaggcgcaaaactgcgctcaaagtttttaatctagaacaaaaaaaccactgataaagcggtctggatattcatattttacttggaattacagcacaaaactatctttcaatagccgtgctgcatttagccacaaaccgctcaaacttacggtctttattgtgcaagaccggtccgtgaccaaaacagataatggaaggattcaattctgctaacttttggagtgatttgatatttctctgctgatccgaggtgaacatgtttggcggaaggtgcagaccggcaactgtagtgagcaagttcatgtttgttgaagcatcaccaatgatcagtacaccatcccgttcacggaataaagaaatatggccagccgagtgtccgggcgtctctattacccggaagtttcctatagtatcattttcaacgaccgtcttatcaactttatgtccctgaccggcccaatatttttgctgaagctttgctacccaatgttgtggtgttggatagtcgattgttaccatacctgtttctgttcttagcacttcgttaggatgacatagcaaaggaattccgaactctgcgcatatctgatcgctgcagccctgatgatctgcatgtgcatgcgtcagaatgtgttgataaacaggaattttcccgatagctttttttacagtagtgtatgagctccgtattcctgagtctaccaatataccttcgataatataactgttgatactgtttcgtggcatcagtggaatatggaatacttcgggagcaatttgacgtaacatagttttttttgtgcaaatctacagcgattatcggaactgcataaggacatttgtcctataatgcgttaggtttatgaatctgtccctttgctcgtgtaagcgatcgttgtgtaatgcccagatacgatgcaagatcctgtgtgcttacgcgtcgtacaagcattggttcgttaaaaaggacatgatggtatttatccaaagctgacttattattataattcagcagataactttccttttgattatactcctgctccatcacggatctgataactccgttccatgaagtaaccttctcaatcaaatgtcgatagtcagagtagctgattctatagatgacactatcttctatagttctgatactccttctggatttttcctgtgccacaaactccggaaataaggtggcaaattcattttcaaatttgaaacaggtaatattttcctttccttcttcatcaacagcatatgcttttacagcgccactaacgataaacccaatataacggcagacttcatcctcacgaataaaaaaatcaccttttttcaggctgaccggtttgaaaaactgtgaagaaaagttgatttcctctgctgacagctctcctgtagagtataggtaattttcaaatgcgttagtcatttcaatttttttcgtctttttttcttattcaaatctaacaattattatacactcatccacatccttttttagtttaatacacattaccagaaatgaactttcctgttgctgaccgttactgtcctatttcgtcaatcaatcaaattgtcataaatttgtctgactctattctaaaccaatgaaaaatctcaccttcattatcgcaggcggtcttttggccctgactacatcatgcaaaactccggcttcggtttcaaaggccaccgttcaacatacaccttaccaaaatcttggacttcacgggaaaatatatggtgccttttatcagcagcgggcggctgaatatgaagctttatgccttcaggcttataatattgcaaagcttcgtttagacgaggccctggcacagaaatcagaaaaaccgctggctattgtttcagatattgatgaaactttccttgacaattcgtattatgcagttgagcgttcaaaaacaggcaaagggtatgatcaggccacatgggaagaatggacagcaaaaggcattgcaacacctctcaccggttctcaggaattttatcagtatgcagcaagcaaaggtattcaggttttctatgtgaccaaccgtaaggagcaggaacgtgcaggtacattaaagaatctgaaaaaatacaattttcctcttcaaaatgactcccatcttattcttcgtacgaaagaaagcagtaaagagaaccgaagacaggacattgctaaaaattacaatattgttttattattaggtgataatcttgccgacttctccagcctgtttgataataaaacagaagctgaacgttctgcagcagtaaagagttccgcagatgattttggtaaaaaattcatcattattccaaatgtaggatatggcgactgggaatcatcattttatcattacaaatatgattataccaatcaacagaaagattctatgatgtataatgcggtaaaggccaatccttagaaatcagaaataaaaattaattcttatagcaatacaacattttgacaaaatttgtttttttgtcaaaatgttgtatttttgtatccatattttaagaaatgtcatctcaaaccgaacaagaccaactttcacatcaaatcctggaaactgcttcagggctgtatctgaagtatggcctgaagaaagtgactatggatgatatttccaaagctgttggtaaaagccgaacgtctatttattactattataaaaaccgcgaggaagttttccaggctgttctggccaatctgatcagggaagttatttcagagattgatgccaatatgaagaaaagaaacacgtttgaaggaaaaattgaggagttttgtctttccaaaattaaaacttctgaagaaaggtcttcatttttcagagctattgaagcaggaatggataatgaagaaaaatcaaaacatattaccgatgcccacaataggatgatggaagcagagagaagtctgctgctcaatttattttcaacaagtatcagcagccatgaaatcccggatgtctctattgaagagcaggaaatcattatttttatcctgcagagcagtatcagaggtataagacgtgaaatgggtttaaaaaacaattttgaaaatttaaatacaacagtaaccactttgacatcaatggttattaaacatatcagttaaaattttttatccaaattttgacgtttttacattatttgtcaaaaagtttattttgaaatatgaacaaattaagtaatatcagcacattccgggcgttcagaagtacaaattatacgttgtacttttttgggcgttctgtatcgcaatttggaacctggatgcagcgtacagcagtagtatgggttgtgtacagcatgactcaatctgcgtttatgcttgggctgaccatttttgcggagcagtttccatcttttttattctcagcattcggaggcgtagctgccgatcggtataaccgatataaaatcatacagatcactcagattttatcattaatacaggcttctttactggctttcctggtcatgacaggacaccagaatatctggagttttatcatattaagtgtttttctgggcatcatcaatgcttatgatgttccggcgcgtcaggcgatgatcaacgaagtggtaacagatgatgatgatcttccgagtgccctttctctgagtgcggcgatggcaagtattgcaaaattagcaggtcctgccctatccgggatcattctgcaaaaattcggagcaggaacctgttttctgatcaatgcagccagttttgcagcagtaatggtttccatttccctgatgaaaataaagattgtttctaaaaagccaactaaaaaaggaactttcacggaactggccgaaggtttcagatatctgaaaaaagaaccttctatcagtcttgtaataatcatgctgagtattacgggtttactgatcttaccttatgacacgttaataccggtttatgctaaggaaattttcaaaggagatgccaagacattcggttatatatcaagttttattggtatcggagctgttttgggcactgtatttctggcttcgttaaagaaaggagcatccatgagaaatattcttatcctgagtacaattatcctgagtatggggctgattcttttttcatatgccaccaacttctactggtctatgttctttgctgcactgacgggattgggaggcgttgcacagtttaccacctgtaatattattgtacaatctgaagtcattccggaaatgcgttcccgggcaataagtattcttctgaccgctatattcggaatgctgcctttgggaagtgtactgattgggtttgtttcggagagaataggtgctccaaaaaccttattgctggaaggaattgcaggaattctaattgccgttgttttcaggaacttattatttaagaagaataaaacaaaagctgtcaacaaagaattgcttgaaaaatctgaggaacaatttatcaataaagtataataacaatggaaaaaacaaacacagcattactggtaatggacatgcagtcggctatcgtcaacacattacctgatacaacggcgttgatctctactaccaaagaggttatccggaccgcaagaaaccgtaatattcctgtcatttatattactgtaagcttcagacagggaatgccggagatcagtgcaaataataaagccttttctactataaaaacccgcatggcagatattgatatgaaagaatgggcaacaattcatccggagctagctcctgaaaaagatgatattgttataaacaaacgaagattcagtgcttttacaggaagtgatcttgaagttgtccttcgtggactggatattcagcatctggtgctgacaggtgtatcaaccagcggcgttattttatctaccttaagagaagctgcggataaagactatcagcttacagtaattgaagattgttgtaaagatagtgacgaagaggtacaccgcgtgctgatgaataaagtgttcccaagacaggccgatattactgctgcaagtgactggataaagtaaataagaaaaagacaatcatcttttgcttattttggttatctttaagtaaagaatacgaagaagatcattaaaaaatggagaggcttaccaataatactgattaatcattttaaaaacattaaaatatgtggtgggtatatgcaattctttcagctttttttgcttcattgaccgcaatttttgctaaaattggaatcacaggggtaaactcaaatctggcaacagccataagaagtgttattattttactggtagcctggggaattgttttcgcacgaagtgaatacaagggaatccctgcactttccagacataatctgatctacattgccgtttccggaatggcaacaggactttcatggatattttactttaaggctctgcaaatcggaaaggtaacgcaggttgccccggtagataaattaagtgtagcgctgactattgtcctttctgttgtatttctcggagaatcactcacactaaaaaccgctataggagcactattgatcattgctggtacagtactcttaatttttgaataaaagcacacagatcatcttatccgtttcattgggttaaaataccgtttcaagtgtctatttcgctgaatcagcacaaattttgcccattgagagaacagtacatactacttttacactgtaaacataaccgaaaggccattggattatcttaattagtatgtaaaacattggttaaggatcaataaaaatctttttgtgcactttaattccttgcagcctttaatggctcaactatacacttaatcatgtttgggtaggattggcttgttccagtcctattttttatgcttaaatctattgtaagagcataaagttctagtaaagaagaaaaccgctgtaaggacaacggttttcatgtattgagaataaatactattatttaagtttataggaacttccgttccacaggtaggttttggaagattgttttttcttttccctgtctttctcatctacctccatatcttccactttaaggataaatgcattgggtattcctcctttatcattaggaaaaacaaattcttcgctatgataaaaagcgccggcatcccccacattcatcaattgtggaagagcaatgagttttttatctttaaaaagaacatactgatcatagccggcaattccacacgcttcaccagaaactcctgctttaagggtgaattcaacgttttgcagtttgtggctgctttctatattgaaagatccggagctaagctcttctccttttccggtatcaaaatacacctcattaatgagtgtatttccctccatcacttttattccggcaatgttctgtttttcgatctcattaaattctttgttcttcctgtcaattgttttggaaagtccgaaaagaaaatcatatccgtttttgttacggtatcctacacaaaggttaccgccccagacgtatccttctaaagtattgtcacctttctgataagatattttataccagtttgcggctctttctcctaatttcagaacgccttcttcctttttaagaatcattacctgctgattggcctgaagtgaatctgcaatcttgccattcactcccggatccagtcttacacgggtccaatctgtaaagatcttctgtgctttattttcttcgaaaccaaagattccatctgcatatgcttcattttcctgagcggcaaaaaactgcagcatcagtaagaataaagctgtccataacgttttcatatttatattttgttttgtgtgttatttttcaagcagaagacttacccattcttcacgctgcaactgttttttcagctcaagtccgctttctctacatacttccagaatatcatctacatcaaagaaacacaatcctgaaagcaataatttccctccgtcattcaatactgaaacataagtcgggatatctgaaataaggatatttctgttgatattggccaggataatatcataattctctttgcctaagttttcagcagttccctgttcaatatccagttctacattgtttcttactgcgttttctttggagttttctactgaccattcgtcgatatcaatagcttttgtatcccctgctccctgctgttttgcataaatggccaatacagaagttccgcatcccatatccaatactttcttcccattgaaatcaatatccatcatctgctggatcatcagatgggtagtaggatggtgtcccgttccgaaagacattttaggttggataataatttcatgcattcccggtacagattcatgaaactctgctctgatcaatactttatcatcgatattgataggagagaaattcttttcccattcttcgttccagttgatatttggcatttcgtcgaaggaatattcaatttttacgttttcattttcaaagatcggaagagccttcagctgatcttcgttaaataaatctgtctggatatatcctaaaattccgtcaatttcttctgtaaagctgtcaaaacctatttctataagctctgccattaaaatctcattccagggttgtaatggagaaattttgaaattgaattctaaataattttgcatgtgaataatttgctgcaaaaatactaatgttatcacggttaaaaaaatgatggagtaaattttggctgaaaccggggatttttatgtttttttgaatggatgaaagctaatctcattgaataaatgcgatgggaaagtttattgcataatttttcccaaggatgatacagatagatgatcatattcaatagaggcgggctttagcccgtcttcagaatcaatacaatgccattggctttagccaaaacctataaaaaaacttgaaaataaatattaggattgttttttgaaagactaaaaattctaagttttggctaaagccatacagtacacggtaaaaagaaagcgggctaaagcccgctcctattaatttttataattcaaggcagagtaatagttctttgcagaaaaatagtaaactttaaaccttgaactttgaattttaaaaccttattatggattcgtagagaatatagaaccgtttgcgatcagcgctcttctgttcattttcaggatatctcttacccattctgcaaaatcttccggttgtaatactttatcaggatttccgtctgtaagaccgccctggatactcatatctgaagcaattgtacttggagtcagggtgatgacacggatattctgttttcgccattctgccatcatggattgcgacagagatacaacagcagcttttgaagcggcgtatgcagacatattcggacctcctttcaaacctgctgtagaagctacgttgacaatatctccttctcctttagatttcataaatggatagactgccttagctgcgtaatatacaccgaacagattggttttgataacctgttcccatgtttcagaaggcatttcttcaatacttccgaagtctcctattcctgcattgttgatcagaatatcaatccctcccaattgttctgctaaagattcaattccagcttttacctgaatttcattgtccacagaaaaaacggcgtatgctgaatttacccccagccttttgatttcttcaaccgtcattttaagattttcttcgtttcttcctgtaatggcaacgtttactccttcattggccaaagctaatgctacagcttttcccagtcctcttccaccacctgttacgatggcattttttccgtttatattcatagtaatgatacttttcttgatacaaagttacgaaagaacatttttatgaagcggtgaaaacacggatttaacttatattttattcaactacaaaagtcacaaaaggtttcatttaaaaacacctgagtcctcttaagtaagtttaaaaagataccacagaaaagatcacataagatgaagatcaaagattttcactgaaaaaacttaagtgtttgaaacttctgtggtgtatctatgcttcattaaacattaaaaccagctcatgagaaccggtttcaaaatctaaaaaaggtatagtaaaaaagtaaaaagcttaaggaatctggattggattctgtacttcaaactcttctgaagcggagaattcatttccatacatgtcaacagcctttacctcaactttatgttttcccaatgataatttcttaggaaaatcagcttcccagatatgttttgacatttcaggattggaaggtcttcttcccgggaaaattttctctgtggaatcccatttgaaaacggaaagggcaaaattcgggtcgatggtttcgtcatattccatttcttcccattttccaccgtctattctatattctactttgtcttttttgcttcccatgaagaaattagccagcacttttgctgaagttcttgaggaaggaatcactttcggaacatataatttgatctgataatcttccggctttccggctgttttgtatttcactttatactgattgtctgtaaagctgataaaagaatatccttttgcagttccgtctctcatcgtagaggtgggaagtcctgcatcatccggtgttcctgagtaccagtctccgcaagtagttcctacgttatattcgtgcaattccttgattccgttccagcctgctttttttccatagaaaatctgttgctgaatgtgtgtatgtgccgacagcagcaaaacattctggaacgggtttaagaaatcaaataatttctggcggtccgcatttctgaagttgtcttcattgttatgctccagcggaatgtggaaagagatgacgatcagtttatttttatcaaccagtttcagatcgttttcaacaaaccgaagctgatcttcacggaatccaccccagtatcctttgccatctcttgggtccggatagagaatatcatctaaaatgatgaaatgtacatttccgtaattgaaagaataattggcagggccaaaattggattcgaatgtttcatcggaaagcttatcttcttttgcatcatagttcatgtcatgatttcccatcacattataccaaggcaatccgacttctttcatcacctctgcgtaaggtttctgaaggcttaggttatctcctaccaaatctcccagacttattcccaatactgcatttttcttcgtattctttacttcgtttacgattcctcttttgaagtaatccagttctttttctgtgtaaggctgcggatcaccgaaaacaagaatgtcaaaatttttgtcttctttttgctgataaagcggaaagttcagttcttttggaagatctcctgtaggagccactcctttgtatttaaaatctgccggagaacctttgggtttatgatggtaatagaattgcggaagattatttgcgtttaaagcagtctgatatcctgaaggcttgattacaaaaacagtctgatcttcctgaaccggaagactgtatctgccgtttttatccgtaagaactacctgaacaccattagaaacagctaccccttcaattcctttttcccggttttctttcttttgatttttgttactgtcttcgaatacatatcctgaaacagaagcttgtgagaaagccattgctgaaaccaacagacaaggcataatgcattttatattgatactcattatttttaatttttaaattattttaatctttaaatttcagttatttattccaccacattttcacgttaatattgtctcctcccattgattgtacagccgcgttataattatccgtattcatcacttttgtagccgtaggatacatgaatctcacaggcatttgtccgccgttctgaagacctccgttattaggaagcaccggtagttttgtacgtctgtattcataccattgctggtgatcaacaaaaaacagggaaatgtacttctgaagcataattttttccagagaaccgtcataggctactttcggattgctgaaataattggcaggaactgttgccccccactgttcaataatagattttactccggtttcgtagtaagtttgctgatttcctgcaataattcctttattaaccaattctgccaggataaactgcacttcagaataggtcatgattaaaatttttaaaggggctttcgccaggttttggttaaggttggaaggctgatagttgaaagacgttcctaaagcgtatcctgaaggagctcctttataaccaagatcttctcctgacgttgctttagctttagtgaaaaacatgctcagtcttggatcattgttatctctcatagcatttacaaagaattcacctgctgccctgtacgctgtaaaatcctgtggacgggctattggcggcaagtaaggagatatccccgaaagcggaagcaccgcgctgtctgtattattctgaaaaataggatattgagcaggattattaactatttcctggattctttcgtatacatttacttctccgtttcggtttagaattctggtcagtaaccttaatgaaagggagttacagaatttcttccatcctaaaattccggtctgactattggtgttggcattataaaacagatctgtttccgttaacgcctgattggtattgaataatgagttagctgttttcagatcatttaacaactgaatgtagacatctttctgcttatcatattttggtcttaaaatattttcttctactcttaaggcttcggataaaggtatatcaccaaaagcatcagtaagattggaggcaatccatgcattcaggaccattgaaatagccagataattattattctgttcttttgccgcatattttctgagatcacttacctgcttaagccatctgtatgaagtattccagtagccgttaccacttttttcgtccatataatatctgctgtaggaatttccttcattgggaaagtctaaagcgatctgcatgatatcaaatgtaaaatcatctgctctgttatagccataacttcccatttcatactgtataggcgcaagaaggcttccaacggaaggatctttaatcttactcgtatctgtattcatttcctcgaatgttctgtcacaggattgaagcatgaaaacggaaattaccaaggctagatttataattaattttttcatttttaaagattttagaatttaagatttaactgaaaaccaattgttcttgctgttggaagctgtcccatctccacccccggagtgatggttgcgttatccagtgtagctacttcgggatcaaacatcgggaacttggtccacatccataagttctttccgaaaatggcgatggtaagatcatccagtcctatagattttatggtttctttggggaaggaataagcgattcttgcatctcttagtttaataaaatctgtgctgaagctgttggtttccacgttggctctcctgtagtaatctccgtaataggatgataccagaactccttttgtgttgggactgaaggttccgtcaggattctgaacaacgccttctcctacaatcattccgccaggattatctcttcccggaagggtagatttcagcttgccctgctcagacattttatgatgtgactgtgaatacgcgatcccaccatattgcccatcaaaagagaaactgattgtaaagtttttaattcggaaatcattctgaagaccggctctccatttcgggaatgcatttcctactttttcaatatctgcaggtcttgccggaagtccgttgtctccgtaaattacttttccgtccggagttctcagtaatttaaatccatacatatctcccagtgaacctcctacttccattttatagaaaaccacatcacctacattggaaacaattccgtcaaaaccttcaggcagcgtcatcactctgttttcattggtagaccagtttccaccaaccttccatgagaagtctttcccttttatggctaagatatccgctgaaagttccaaacctctgtttcggattttacctgcattaataatccttttagaatatccactttcggaaggcagcgataccggaataatctggttttcactgacattctggtaagcagtaagattaaggttcaacctgtttttgaaaagactgaaatccataccggcctcaatattggtatttttttcaggcttaagggaaggattattaaaagttgtaggcgctaccacacttcctgtaatattgctggccgtataatagttatccagaagataaggatcactgtctattcctacttttgcccatgaagctctcagtttccataagttcaggttattgcttttcagattaaaaatatctgataaaatgaaactggtacttactgaaggatagaagaatgatctgttttgcttcggaagcgtagagctccagtcatttcttccggtaatgtctacaaatactttattgtcatatcccaaggtaagcaacccgtatacactgtctacatgcttatctcttggtgcgggatatttaaccggaatactaagtgcattagtaaggctatattctcctgctgttttcaatccgatggcctgataatcattcagcagatattcattataacggatacttccccctgcagaagcggaaatactgagtttgttccaatctgctttgtaagagaataaaaggtcattgttatattcctgatttttgataaactgctccctgtaaaaacctttcagatagtttgcagaactccatggtcttttggtcgttctcttttcgttcaggatttcaattcctgacctcaacattaagctgaaatttttattaaactgataatctgccgtgatattccctgtaatggtcttctttctgactccattcagcatttcgtaagcaatcatataagggttgtctatataagaactaaatggatggatctgatcaacctgttcctgaccgggcttccatatcggtctgtaccattcaagatccacattgggattctgaaagatcatgaaataggaaatcgactggttgttatatcccgtcgcaggaaggttatcactggtagtagtgttataagcaaattttgttgatatttttaatttttgggtaagctgatgggcaaaagataaggcaaaattgaacctgtcgaaacctgtattcggcatcatccactcgttattcagatacgtcagtgaagttctgaagctggttttctcattggagctttctacagaaatactgtttgaatagttagaacccgctctccagaaacctttgatattatttttataaggtctccataattgtctttccttactttgtcccattacatcgggatcgtattggaaataatattgtccggcgaatttaggtccgaaagcactactggtgcctcctgtacttggtccatccggagaaaggccgtaagaatagtaaaagtttcctgctgtattggtagccagtgttccctgtccatattcgtactgccagtccggccattttaatactgtatcaaagcttgaagaagaattaaaagttactctcagttttccgtttttcgtttttccggattttgtagtaatcattaaggctccgttggcggcacgggatccgtataatgcggctgcagaagcaccttttaatacggttacagattcaatatcgtccggattgatgctgtttaatccatttccaagatcgattggaacatcacctccggaacctgctccataggctgctgtaccggaacctgtggtagaatttcccaatggtactccatccactacaataagagcatagttgtgatccatcataatggatttttctcctctcaaagtaattctggaagttcccaacggtcctgctccggcagtctggattttaagacctgccactttcccttccattgactgtgcccagttgttattctgggtttcttcaaatgttttggcttctactttttcggcaacataacctaaagctctatcgtgtcttttgatccccaaagcagtaaccactacttcgtcaagtcctttaaccgtgtcttttttagctttctgctgtgctgccagattgacgctgacgaatcctaacagcgataaaaccaacagtttttgtgtctctttacgcatttcctttttgtttgcgcaaaattagaacgacattacaaggaacaccttaacacacttttaacgtttcttaaaaatttattaaaccatttgttaatccagtcttaataacattagataaataactaattaacaaacaattaagcaattaagtatttttaatatggtttccagattgtatttatgtatctttattgtctgtctttgagataatactaaacaaaacaaataatatactgaattacaataaaatctaaacacttgattctttcatttacttttaaaaagaagggctaacttctaaaaaagcagcctgcttccatataagaagcagactgtataaattattggttatttgttgagatggttaaaaaatttcgtttgaccatccatcaaaattctttgaattttcgccatccctccggaggagggaatattctgtctttcagttgtaatctttctgaaaggttctgaattgtttatttgtttttcaactgatcagggatgtttgtggttacaaacccgattccctgattcttcagttcatcatatacggcgacatcattcacagtccaggcattggtaattaatcctaatgcttttgcttcagcaatccatgttgggtttttctggaaaacactgtagtggtagtccataccatccaatccttcttttttgatctgctcaggagacagctcgccgttcagatactgaactttaaaggatggagccagttttttgatttccttacagatattcaggctgaaggaaataaactcactttgagattccagcttcatatctttaatcattttaatcgttttctccgtgatttcattttctatttccggagttttggcaggcttaatctcgacaattagtttcagagatttatctttttttccctgcttcagataatcttttaaagtaggaaagttttctccgttggataatttcaacgcttccagttctttgaaactggtttcggaaatttccattttaccatggtgctcatcatgattgatcaccaatacaccatcttttgtcattcttacatcaaattcagacccatatacttttaatttctgggcattttccagcgattgaagtgaattttccgtggtaggaggctgagcctggaaataacctctgtgggcgataatctgggtttgtgctttcatcataactgtacttaaaactgctaaccctaaaataaaatttttcataatataatttagattattaaaaacaaagtcctgaaacttctgataaaggtagttattaaaaattgaaccacggagactgtatgtcttccgtggctcaaaagaagttagaaagtatattttgcaccgatctggatctggtaaggatttcctgtcagaggaaccaaaccacctccacttacgtttttggtgtattcgtactgcatcgtatctttattgaacttggttaccttatacaaagaagtatttgagtatgatttgtttaccccccattctttgttaagaaggttggctacgttgaagatatctacagaaagttcaaaggctccgaccttatcgaatttaattttcttggcaacacgtacgtcccaaacaccgtagaaaccgtttttacctccgttacgctctgcgattcttccgttatattcattgatataatctttcagagcctgccctacctgcggatcatccagtatggacttggtaagattagggaagataaaagcaagatcgttggaatctacaaagtctccgttgatgtttcctcctgtggttgctgagaaacgcgttcctccgattcctgaatacctgatccccaatgtaaatcctgcaatggttggagagttaccgtagatcactactttgtttctgaactggttgtctgaataagtcattctcagatctctgggatcactctggatcatggtagataatgttgctgagttggctacgtttccgttgtatgaagtattgtctttaatatcagaccatgtgtaacttgcggtgatttccccatctttccagtaacggtaacttgtatcgattacgaatgagaactggtttaccttaccatcgctcaccaattccagtactcttccgaaattattattgattctcccctgtttccagtcgaaacttacactgttattggcattattggtaatagcacctgtagggataaatactcctcttccgccttcattagccagggtgaagaaaggatttgccaccatgtttctgtcgtagtaaaagtaattatttctacccagagccatgtatcctgcaattcccgctctgaatctttcattgaagaaatgggtatacgagatattggctttataaacaatcgggatttttgcatccttaccggtataattgatggttggaatctgatactgggaaagtgacggaacagaattatagtcattcctgtaactgttgaaatccgggaacggaacatctttacctgttacatccactgtagccagatgttttccatcaaatacaaggttgttgatgatcatatagttgttgatatcggaagagaaaattccggcaccgaacttcaggaagtctttattttcctcattgatattccagtcaaactgaaatcttggctggatgacaaatgatttgatctgattatcggttctgattcccatttcatcaaacagtttctggttgaattctgctttcggataaccgccgtaatctaatcttaaaccagccattaaatcaagacctttagccactttagtctggaattgtccatatactccgatgttccaaatgtttgatcttacagacggatcggccaccaaaggaacttctctgtagaatctgtaaggtgtcatgttgtcaaaattgctcatcccctggaaatggaatcttccgttcacctcacttccgtatactgattttgccgttgtatacataaggtcagccccaaacgtatattttaccttatctgtattgtaatataaattatctacaagctggaatacattatttctgaagctttcctgagcaaaacgatgtcccccgatctgaatattcgtagatcccacactggaagatacgccttccacaatcgctctcggaaccggttttcctaattgattgttctgataactgtcctggaaagtataaagatactgagcctttaattcattggtcagattaggctgaagatttgatcttaatgttaacaataagctgttatcaagatttttatcatttccgtaagactcgaagaaattaatattggtgttatcacccaatccgtttttattaagatcgtatgtgaagttatttctaagcgttaataaatgtttttcattgatctgccagtctaaacgtaaaaaaccggcatcagagtttctcactttatcaaaacttccgaactgcggactgtttcctaccccgtatttttcccttgcaatatccagaaactggttaagtgtttgtgttgttgtattgaatcttttctcgtcatccggagacttgatatcagcaatgaccaatggtcttgaatccaactgatggtcccatgctacgaagaaatgcaatttgtttttaatgattggacctcccaatgaaaatccgaactgggaagtagagaaatcattatctcttttattccctctgatatcatatgggctggaaagccagttggttcttaaatattcccaggcacttcctgaaaacttattggttcccgatttagtaacggcacttaccgttcctcctccgcttctccccaatgttacatcatattggttggtggtgattttgaattcacgtacggcttcaatagagattgaaaacggcgcgccgcttcggctggtagtagatcctgcagaggttggattttttgcagtcatcccgtctatcgtaaagttggtggaagacccgagctgtccggaaaggttacctccttttccacttaaaggtgacagttccgtaaggttggtaaagtttcgtccgtttacaggaagcatactgatgttcttggcagaaattgcggtagctgctcccaggtttccgatcttgtttttaaggttccctgtaatctttacttcttcgatatgcttctcatttccaagatccatattgacagtaacctgatcaccaaaattcacattgtacccttcttttttatcatcattcacaatgacggtgtaaggccctcccagaggaatttccttaaaaatatactccccttttgagttggtttccgtttccgttctgaatcctgtagactcattcacgatcgttactttcactttttcctgagccgtacttcccggtccggtaactttccctacaatagaagcctgtgtggtttgtgcataagccattgtcccaagccctaaaaacaataatcccagtacaatctttacttttttcatttcttccgtagatctatattattaattttttgatattcgcccggaaacctctttgattttcacgatgatagatcattttgaggtttctttcaatcagatgtgcaaaggtattttgactttaagagcggggtgtttaagaaagttttaacatttttttaatttaatcagaacgttatgttaaattactttaaacacatgttttatgttatacagaaccaaactgttaaagcatattaagcatttttaattttcccgtactattttattctgttattttttaaatgcgattactttatttatttttgctcaaaagatagaaacccgatgtctgaaaacattcaacaaaagatagaacagctccgcaaagagcttcaccagcacaacgaaaactactacctattagatacccctactattacggattatgagtttgatctgcttctgcaggaacttcaggatctggaagcccaatatcccgagttttatgatgaaaactctcctacagtacgtgtaggtggtggtgttaccaaggttttccctacgattcagcataaattcagaatgtactctctggacaattcctacgattttgacgatcttgaagactgggaaaagagaatcatcaaaacgattgacgatccggtagaattcgttgctgagctgaaatacgacggtgcttcaatttctattctttatgaaaacggtaagctttcacaggctgtgacccgtggtgatggtttccagggagatgaaattaccccgaatgtacgtaccatttcagatattcctttgaccttaaagggtgatttcccggctcagttttttatgcgtggcgaaatttatctgaccagaaaaaactttgacaaaatcaataaacttcgtgaggaagaaggtcttgatcccttcatgaatccgagaaatacagccagcggaagcctgaaaatgcaggacagcgctgaggtaagaaagcgcggactttcttctgtactgtatcagtttatttctgatgaagttcctgctgaaagccattgggaactgcttcagaaagcacagagctggggcttcaaaacctctcagcaggccaaattatgtaaaaccatggctgaggtacaggaatttattactttctgggataccgaacgccataatctaccatttgaaattgacggaattgttttaaaagtgaattcactgcaacagcagagacagcttggctatacagcgaaatctccgcgttgggcaatggcatataaattcaaagcagaaaaagtagagacagaacttcagagtgtgtcttatcaggtgggaagaacgggtgctattactcctgttgccaaccttaaacctgttttactggccggaacgatcgtaaaaagagcttcccttcataatgaagatatcattaaaaagctggatcttcatgaacacgatttcgtgtacgtagaaaaaggaggtgaaattattcccaaaattgtaggggtaaacacggataaaagaacggaagaaagcaaagaaattgaatatatcaaacactgccctgaatgtggtactgagctggtaaaaattgaagatcaggccattcatttctgtccgaacgagcttcactgtccaccacaggttgtaggaagaatgatccattacgtttccagaaaagcattgaatattgacaatctgggaagtgaaacaattgaacagctgtacagggagagactgattgaaaatcctgctgatttctatgttttaacgaaagaacagcttcttccgctggaaagaatggctgagaaatctgcccggaacatcatcacaggaattgaaaaatccaaagaagttccttttgaaaaagttttgtacggaatcggaattaagcatgtaggagaaacggttgccaaaaaactggtgaaaaattttccaacgattgaggaattaaaaaacgctaccattgaagaactttgccaggtagaagatatcgggacaaaaattgcagtaagcattgttgatttcttccagaatcctgaaaacatcctgatgatcgagcgattgaaatcttacggagtacagcttgaaaaaggagaaagtaccaatgaagttctatccaatgttctggaaggaaaaactttcctgttcaccggaaaattgtctttatttaccagagaatctgccgaggaaatggtagaaaaacatggcggaaaaaatatttctgcggtttcaaaaaacctcaactatcttgtagtaggtgaaaaagccggaagcaagctgaaaaaagcccaggatattgggacaattacgattctggatgagcagcagtttctggatctgattgagaaataataaaattttaaaatattttcagaaaaagaccattgaaataattcaatggtcttttattattatagaaatgagtcgaattaaataattcctcactttttatcctctctccttccatcccaaacagaaagtatgattaactcagaatttgaaaattcataaaatatcagataatctcttactatttttacccttacattatcaatatctgtctttcttccaatagccgggtgatctgctagtaatcttacattatataagatcagcttattgagttttatactaaaagttttagatttatttcttagcatccaatattcaagaatttcttttctttctttattggctttaacggtccaaattacttttcttttagccattcttctatatcctgattggcctgatcttccgtaagatatgctttattcttatattcttctcttccttcagcaattctttctttttgctcggtagtaagaatatattcattctggtccaattcaaaatccagaatcttctgaatttcttcaattattctggcttcttttaattgggtaattctgttaattaaatcaatttttaaatctgatgtattcatcttatgtgatttaagatcaaatttagaaaaatttatttacttaaaaacaataatagtatatgaagcattttctcctgattttggcagaatcatcctgatatgttctttattcctgtagtaatctatgtaaggttctttggtaatgatctttcctttccctgtttctttatacccggttgccaatatcagtttaagatactgctcatattctttcttctctttaaactcaaattctatcctgtcttctgatttttcttctttatattcaaactttccgattttcgaagtatagtccggggcttcgtattcggttaaaagaaagcctaagccctcagttctgtcataaaatctgaacttcagctgcttcatttcctttttaaactcatccattgtcagtttgttgaaacctttaagctgttctaatgtgaatgtctgagcagaggcctgaatactcaatacaactgaaaataataagagtcctaaagtttttctcatttttatttttatcacaaatataagaataacggtttatgcttctttaagcaacactttccggaacagtaaaatttcttccttgtttaatccttccaaagaaattgtgcgttttgtattaggcatccagtcaggataaagaatcaattccacataattatcatgtatgtgaaactctctgagaacttcaggctttcttgtatttctgcgatctgatccaaatctcagattaatacacttaccaggaacaatgtaaaaatctttaggaaacaaaaacatagaattctgattcatgaaaatttcaaaactacaccattgaaagcttttacgatagctaagacttcctttagtgactgaaacaatggtgccatggatatttttaaaaactaccgcatccggctgtttatatttttcgataattttatttttctggctataaaagaaaattcttgaaatgataaaaaatactacacctgccaatggcaaatagaaaaaaggatccatgaatttaaaaggatagaattacaaatttttaaataagaaaaatcaaatattttcttattcaaagatataacaataactcttatgaaaccggcagtctgaaataaaatgtacttccgttattcagagaactcttcactcctatttctccatgttgtttctcaataaaattctttgaaattgctaatccaagtccggtaccattctgatgctcgccgggaacctgaaaatagcggtcaaagatctgtcggtggtatttttcatcaattccgcttccggtatcaatgatgctgaactgaatgaaagaatccagtttctcaactacaatcttaatactttcgtcctgaaaagaatgctttaccgcattagtcaggaaattattcattacccagaccgttttatcaaaatcagcagtcacagaatcgctgtcttccagaagatattccgtactgatggaaatgtttttctgctctgcaagcttttcaacgttctttacagcagtctgtacgatttcttttggggagcatttttcaacagtcagtctgatatttccggattctacctgggaaagattaagcagctcgcctgttatatccagtaagcgctgcccgtcttcattgatgcttttcagtagttcctgctgctgttcgttcagctctccgaatttttgatttccaagaagctgtacacccattttgatagctgatatcggtgttttcagttcatgggaaatggttgcaataaaattggttttggcaaaatcaagctctttaaaaggagtaatatttcttaacagaattacctttccgatatattttttttccttttcaccagtctttacaatattaatcgggataatgtcctgttcaaaataattttctttgttatcacggacaattttaatcggatcttttaccggatgatcaatatttttcaatagctcacgcatcagatcattattaacagccacttcatgagccgtttttccgataatattttctttatggagattggtaatcttcagcgcctcatcattaatcatgtagataaaatggttctcatccagaccaataaccgcatcatgcatattattaaccagcgtttcgatccgttttttatccatcagctgcttggaaagtgtactgctttcgtattcctgaagtttctctgccatgctgttaaaggaatctgcaagactgttgaattcttcgcttcctttgaaatgcactctttcactatagtttttatcggcaatctgtttgatactgaatgtaagctggttaataggttccgcaatggtttgtggtaaattaaaaagtaatataaaagcaatcagaaaacatacggttcctaaacttacgatccagaaagtcgcattttctgctgtaataatcgcgatatcactctttctttctatgcctttcatattcaaagacataatcttcgccaaatcctcacggatgagtttttctttatggatatccggagctttcagataactgtcaaaatgcaggttcaggttctgcgtggcttctttttctccaaattctgtaaggtttttttcctgaagtttattgtttttctgaaaatcagctattgcaacagtactgtctgtactgatattatccaacgccagaagcatatttttggaaaactccaggctgttataattcgcagtaagaattttttcagtatcggattttaatttattgatatatacagaacctatgactgaaagcagaacaatcagcagaaataaaaggcccacgcctaaggtaagtttcgttttaagtttcattactttttaagataaaataataatatctatctgtttttcattcagtctgttcatcagggtatagatccagctgtatcccaagagccgatgccagaacctggcatgaggcttcccaatacataccgttgtaatattatgggctatcacatattccagaattccgttatgaacgctgctttccttgatgcggactactttggcacctaattcctgtgctaaattaaaattattaatcaaataccgctgcttatccagcgcaattttttcaggattttctgagggtttctgcacatataaaaccgtccacgggctgttataataactggctaaccttgctgttttccgaataatagttttggcaatcttctcgttactgctgatgcaggccagaaattttatcggtttaaaattttcggttttgatctctgtttctacttttctctccacgtgggtggctacttcttttaaagctaactcacgaagctgcaaaatatggccgctttggaagaaattactcagcgcagtctgaattttttcttttttatagatctttccttctttcaaacgggtcagcaattcatcagcggtaaggtcaatatttactacttcgtctgccaatgcaagaattttatccggaacccgctctgctacttccactcccgtgattttttttacctcttcattcaggctttcgatgtgctggatattcatggcactgatgacgttgattccgttatccaaaatttccagcacatcctgccatctttttttatttttagaaccttctacgttggtatgggccagctcgtctactaatacgacttcaggatgttcattgataatggcctgaagatccatttcttcaaggttctttcctttataaaaaaccgattttctttcaatttgcggaataccttctaccagagcttcggtttcttcccgtccatgggtttcgatatagccaatctttacatcaatgccatttcgcaaaagggaatgagcttcctgaagcatacggaaagtctttcccacacctgcactcatcccgatataaattttgaattttccttttcgggacttttgaatcagttctaaaaaatcttttgctgatgacattgatttaattctttttaattttactttaagcactattctctgtgactaaactgatattaaaaccagaccgctaaactcgatgttataaagaaatttccctttttaaattcatcatttttcgcgaaaatagcatcttttgaagtcaaacctctcgcttctgtacggaaaacaacatttttaaatattgcataatctacattcagcgagtatccgaaagtctgaaatccattaggcgtatcagtgctgatgatcactccgtttttatcattataatattccaaccttcctgccagtgcccatttattatccagttgatatttcatctggacattcgggctgtaccagatgttgtactgctcgcttccttttgatttctgttctgcaccgatatcaaatcccaataccgcggaaaactgatccgttatctggaaacttccatataaatcatggaaataacgcattcttttatcctcttttgctttatcatttccaataaacgaactgctgttcagggtaattttatcattgggtttataggttacctggtgaccaaaagaaatactctgatttccctcagtctttgcgatacgctgccatccgttcaataccaatccgcttaaaaaccatttcccattatctgaagtgtaggaaattctggctccggtttcaaaatacggagagttctctgcagctaagcttcttgtcagattcacattatcctttccgatagcactttcccagccaatatgggaaggcataatccctgcatcaatccaaaggtttttatttttagaaattctgattcctacattggcttcattcacgtaccgtaatgcattttgttcagctgccatattatcctgcgcgtaagttccggccattaaagctacattggcacggatattttcgctctgatagctggctttaaccaatcccaggttaagattcatttcattgtgtctgttgtatgagtataaaaaattctggcggatatgattggcaggctcattaaaatcgtaggtataaaacagttctgcataagcggaaaatgtaactttattgcctgtttttaatgagtctgatgactgtgctttggagaaaaacattcccaatacggctcctatgactaaatattttttcacttttattaaggtatgttaaccatgtcaaggtttaaagccccgacatgattatttgattattaatttattattttaatcgatccaaagcaatattaagcttcagaacattcacttttgagggtccgaaaagtcctaaaagcggcttttcagtctgagtattaattaaatttctgatctgttcctctgaaaggtttctcacttttgcaattctcttggcctgatacaatgctccttcttcagaaatatccggatccagcccgcttccacttgctgtaacaagctctacagggactttggtattccccatttcaggattatccattttcaaagtatcgattcttttctgtacaatctccagatattctttattgcttggccctttgttgcttcccccgcttcctgctgcattataattgactgaggaaggacggccgtgaaagtatttctcagatttaaattcctgtccgatattagcataaaacttctgtcctttatcataaataacttctccgtttcctttgttgggaagtattttggatcctccatatacaacggccagataaattcctgttaccaccagcattacaagcgttaatctgaatgctgaaacaatatgatttttcattttttaaattttaatagaataaactgattatcagatcaatgattttgattccgatgaatggaacaataactccgcccagaccatagatcaaaaggtttcttcttaacaatgcacttgctccgattggcttataagctactcctttcagtgccagcggaatcaggaacggaataatcaccgcgttaaaaataactgctgataatatggccgtttccgggctgtgaagattcataatattcaacttctgaagggaaggaataaacgtgataaagagtgcaggaataatcgcaaaatacttcgctacgtcattcgcaatgctgaaagtcgtcagcgttcctcttgtcatcaacagctgcttcccgatttccacaatttcgatcagttttgtagggtcattatccaggtctaccatgtttccggcttctttagcggcttgagttccactgttcatggccacacctacatctgcctgagctaatgccggagcgtcattggttccgtctcccatcattgctacgagcttaccttcctgctgttcctttttgatgtaattcattttatcttcaggtttggcttctgcgataaaatcatctactccagctttttctgcaatgaattttgcagtcagaggattatctccggttaccattaccgtttttacgcccatttttctcaatctctggaaacgttcctgaattccggtcttgatgatatcctgaagttcaataacgccccatactttttcattaacggcaaccactaaaggagttcctccgttttcagaaattttggttaccgcatcctgggtttcctgcgggaagatattcccggctttttcagtcagtttttttatcgtatcgtaagctcccttacgaattcttgtttcttcaaaatcgattcctgaggttcttgtttccgcagtaaaatcgatataggtaggattggaaacaaataaatcttcggtttttaaggcactcagttcaatgatggattttccttccggcgtttcatccgctacagaacttaatgcagaagctttaatgaattcttcaagctgaattccattagcaggatgaaattgggtagccttacggttaccgatggtgattgttccggttttatcaagcagcaggacgtcaatatctcccgcagtttccactgctttaccacttttggtaatcacattcgctctcagcgctctgtccattcccgcaatcccgattgcagaaagcagaccaccgatggttgtcggaataagacaaacgaaaagagatataaatgccgctatggtaatcggagtctgcgcatagtctgcaaaaggctttaaagtgagggtaacaataataaatgtaagcgtgaatcctgctaataatatggttaatgcaatttcgtttggtgtcttttgtcttgatgctccttctacaagggcaatcattttgtccagaaaggattctcccggttttgtggttactttcactttaattctgtctgacaatacttttgtacctccggttacagaacttttatctcctccggcttcgcggatcacaggggcactttctccggtaattgcagattcatcaatagttgccagaccttcaataatctctccatccatcggaatctgatctccagcctcacaaaggaaaatatcacctaatttcatttcagcagacattttgagacttgtttctacctggaaccccggcttgttatcaaggactactctggcgggagtttcttcccttgtttttctgagggtatcagcctgtgcttttcctcttgcctctgcgatagcttctgcaaaattggcaaacagaacggtgaaaaataaaataataaatactaaaaagttataggaaaagcttccctgggttttatcaccggtaagactgaacatgcttacgataaacataacaatggttccgatttcaaccagaaacattaccggatttttaaacataattttcggattcagctttacgaaggactgttttatcgcttcgttaaccaaatctctttgaaataatgtttgtgactgatttttcatttttttgaaagagtttatatcatttaaatcaatagtaaccatcaaggtctgccggattataaggatagatatggataatagtaagtgaacgtttcgtaagtgtcagactagcttccttacacttttcagcttccttaatggttaaatattgattttaatttttaatgttcacatttattttgagaaatactgaatctgttctgcaatagggcctaatgtcaatgcagggaagaaagatagtgctgcaatcagtaaaatcaccgccagggtcataaatccgaaagttgccgtatctgttttcaatgttcctgcactttccgggatatatttcttctgtgccaacagacctgcaatggctactggccctatgatcgggataaatcttgagagtaacagtacaattccggttgagatattccaccatggtgtattgtctcccaatccttcaaatccggatccgttattcgctgcggaagaagtaaactcgtacagcatttcactgaaaccatggaagcccgggttattcaatgtttttgctccaaattccggtagataagctgttaaagctgttcctgcaagaattaagaaaggatggaataaagcgacgatcatagcaattttcatttccttcgcttcaatctttttacccataaattccggagttcttcctaccatcagaccactgatgaataccgccagaatgataaagataaaatagttcaggattccgactccacagcctccgtagaagcaattgatcatcatggcaagcagctcattcatccccgaaagaggcattgtactgtcatgcatcgcattcacagaacctgtagaaattacagtggtggcgatactccaatacccggatgctgcacttccgaagcggatttctttcccttccatagcacccagactcttgtctgcacccatttgggtaatcaaaggatttcctcctgtttcattcactatattcggaatggtaagtgccagaaaaccgaccgtcattaccgtaaagatcacccatgagagttttcttttattcagataaaaaccaagtgcaaataccaacgcaaacggaatgatcatttgagtaaccatttctgtcatattggtcatataattaggattttcaagcggatgtgctgagttggctccgaaaaatccacctccgttggttcccaggtgtttaatggcaacaaatgcagatacaggacctctggaaacgtctgccttctgaccttcaagtgttataatatgatctttcccttcaaaagtcattggacttccattaacagaaaggattaaagtaacaatcacactgatcggaaccaggattctgatcatggattttgtaaaataatcgtagaaattaccaagttctgtacttgtcttttccttaaaagctttgaaaagaacagccatcgcagccattcccgttgcagccgtaacaaactgtaaaaacatcagataaagctggctcagataacttactcctgtttctcctgagtagtgctgtaaattacagttaactaagaatgaaatggtcgtattaaaagccagatcaggtgacatattcggatttccgtcaggatttaaaggaagccacgcctgattcagcaaaagaagaaaaccaatgatgaaccagatcaggttgatcgccagcatggcatacatattctgtttccagttcatctggcgggcaggattaattcccgaaactttataaattaacttttcaacgggttcaaaaaccggatccagaaaagtttttttgtatccgtagacattagctatatatttccctaaaaatattccgataactaatgtgatagcaaacattgctataatgcctaatatttctgtattcatgatggattaaaatttttcaggttttattaaaacataacagatatacacgaaggcaagtattgagaggaaaaataaactccacataatttatattctatcaaaaaattcaactgatttatataaaagccaaaacaatactgcaaaaagcagaattaaacttatcagcatcatatcttaattattaaggttaaaagagtcaataatacatacgatacaatcagcagactaaaagtagagtgctcccgttttttaaacgtttttctagaaattgtcatttttaaatattttattcagagactatatgccaaaagaaagtccatcctgaaaaacaaataattaaaacactgaataacaattaattaaatcaaaacagtcacctatataaaaacagaaaagcctatcaaaatgataggctctttattaaaatgataaaaatttattttaatccatattcttcaagtttccggtacaatgtggcaataccgatctcaagcaaccgggcagcttctgccttgttaccttttgtatattgtaatactttttggatatgtattttttccagtgatctgatacttaatgaatcactttcgggaacagctttttccgagtaatggggaaggctgtctgcgtcaaggatattgttatccatcaaaatcaagctgcgttccacagcatttctcaattctcggatatttcctttccagtcgttgcgctccagcgctttaaaataatcaggatttacctgaacggatgcgagatgaagtttatgggaaaaaatatctataaaatgtttggcaatagctttcagatcttcttttctttcccttagtggcggaagtgtgatctcaaatacattcaatctgaaataaagatcctctctgaaatttccctgctttatttcaccctccagatcccggttggttgcagcaattaacctgaaatcggatttggaaactttggtttctcccattttgataaattctccggtttccagcactctgagcagctttgcctgcaattctatcggcatttcacctatttcatcaagaaacagagttcctccattcgcttcttcaatcaatccttttttatcttttaccgcaccggtaaaagcaccttgtttatgtccgaaaagctcactctccaggatttctttactgaatgcagaacaattgatggctacaaagctgttcttcttcctgtcgctcccctcatgaatggcactggcaaagacttcctttcctgttccggtttctcctgtaagaagtacggctgcatccgtcagagccactttttctgccagctttttagcttgtaaaattagtggtgatttacctatgatctggtcaaatcctttcgttgcagtctgctgaaccactctcgatttattatctttcaccttgtcaagagctttataaaccaatgggattattttctcattatcatctccctttaccaggtaatcataagcaccgttcttcatggcctgtacggcatcagtaatattaccgaatgctgtcatcaaaataatctcaagctgtggatatttgcttttaacagactttaccagatctaccccaaaagcatcaggcaggcggacatcactcagaacaacatcaaattcatattgctccagcatcgtcattgccgaacgtgccgtagaagcttcttttacattaaaattttcctgggaaagaatcatccctaatagtttaaggagtttgatctcatcatcgatgatcagaatgtttcctgacattataattattttagaaaacctatacaaacttattgaaattatttgagtaaaacagggttatacaaggaaatagttagtcaatcatttcatgagtttaaggagctgtttcccgctatccattcatactcctcgcgcctgcatcctcccacgctcaaaccctcccgcactccaactcctgctgcggggtaaccattgctatcggggctaggagtgaatgaatgatgaatgataagatataaatgatgtgacgagattcgggatacaggttctgtggttatcttttcctatgagtaattcattccaatggcgtctttctttttcatttccgctgcttctttctactgtgtcattccgcaggaattcaaccccatcattagagtctttaggattcctttaattcagacaatttgatactgtaaaattttttgatgataattaagacatatggattgcagagactcctgcggagtgacagatgagtgggataaacgatagtagtgaaagcaaagaatgatcggccgtaagaataatagattttagtctgaaccggggtaatgatctttcaattgtgtcataacaatccctttccagttgtgctatggttcaattggcctactctccttcatttgtgccgcttatttccactgtgtcattccgcaggaatccaggctcctttattagagtctttagaactcctttaattcagacaatttgatactgtaaaattttttgatgataattgagacatatggattgccgagactcctgcggagtgacaatggggatgtgatgaatgatgaatgtcaagtgataattgatgcttgataattgataattgattgatgtatcgtttatcatttatcaattattactcattactcattgctcattactcattacccattgcttatacgttcagtataaagcaaaaaaaatcctttatcatttgataaaggatttttaaaaataaaataaaaactggcggcggcctactctcccgcgttagcagtaccatcggcgctggtgggcttaacttctgtgttcggaatgggaacaggtgagctctgtcaatcctgagccaggatcaaactctccattgtatgtttgtctgactcactcaaagtttttaacgctttagtttttccttacttggttgttatattgtatgtcaatgatctttatatcttccgctttccacgaagcacgctctctgtcagtggcgctccgtatttgcgagtgcaaaagtaaaactttattttttaatgaccaaatgtttttgaagaaaattttaaagttttttaagtaaccttaatccttctcaaaccctcaatccctctactcctgcgctccgatttattcggactgcaaagatacaaactcttttttatctcacaactctttttgcaaaaagttttaaagtttttttcgtctgtctcttgttgaagtaataatgttcctgcttaactaaaagcccttctgcgcttactgttctactctcgttttcagtggggcaaagatagcaacttcctacaacgcaaaacaagtttatttaacataaattttaccgtttcgtaatatttgctcttaaagcactggtaggcagggagaaaaattttaaacatttgtttggggcttgggttggtgggttggagtgtatgagagtttgagagtttgagagtttgagcgggggagaaagagagaatggtgatacgggatgcgggggtgcggggttacagggttgaccattgatcaaaatagtgtatatattatataatagagtccagactatataagaataagaaaacaagctttcttcgacaagttcagaattatacctggttccgattgaattgatgatacaccatattacatatcaaacacagcattgttactccacaggagtccggacaaaacttttcagtagcggctaataccaactgtcaaaaaaaaagattttagacattatcccaccaacttacatcctttaagggctctggtcaagaggtttggattcccgcggaatgacacaatagaaataaaggcttgtactcactaacccgaagctcaaaacacaataacccgaaccactatattctcctaccatgaaattcatcattcatcattcatcattcatcattcattattaaagactccttccctagccctgatagaaatggttaccccgcagcaggagctggagcgcaggagggtttgagcgtgggagagcaaaggcgcgaggagtaaaaatggatagcaggattaagctccataagaaagtgagaatgtggagagtgagagagtttgagtgtgggagagctgaagagtttgaaagtgaaaccttataaagggaaagaaaatcgtaattgctaatcttaacctccttatagtaatggttttctttttatgattcaagttttcaactataagaatagatgtaatattgataaaaagcagctgacattttttttgattccttacatttgtaatccattccggtttctaaggaatgaaatgagttttatatatgacagacagaaaatataaggaaacggttcacacagataaaaaccattacgaatatattacagtaacaaacgacgaaaataacgtcagaatctatactttgaagaatggattaaaggtttttctcgctcagaattttgatgctccgagaatacaaacctttattccggtaagaacaggaagtaataatgaccctgccgataatactgggctagctcattatctggaacatatgatgtttaaagggacttccaaaataggaacccagaactgggaaaaagaaaaggaacttcttgatcagatttctgcattatatgaagaacataaggcagaacagaatcctgagaagaaaaaggaaatctacaaaaagatagatgaaatctcacaggaagccagtcagtacgccattgccaatgagtatgacaaggcaatttcttctctgggagcaagtggaacaaatgcgcatacctggtttgatgaaacggtttacaaaaacaatattccaaacaatgagcttgagaaatggctgaaaatagaaaaggaaagattctctgaaattgtccttcgtcttttccatactgagctggagtcggtatacgaagaattcaacagagcacaggacaatgatacaagacttgtaagctatgagctgatggatgctctttttcctactcatcctaatggacagcaaaccacccttggaaaaccggaacatctgaaaaatccttcaatgaaagctattcacaagtactttgatgaatattatgttcctaataattatgccatggtactggtgggagatcttgattttgaaaaaacgattcagttgattgatcagtatttcggtactttaccttataaagaacttcctaaaaagaaccctgttactgaacaacctctaacagaaattgtcacaagaacagtaaaaagccctactactccacggactcagattgcatggagaacggaaagctatgggacaagagaagctatgctggccgatattacagccaatatactcagcaacagaggggaagccggattattggatttacatatcaatcaaacgcagaaaatgctatgggcacaggcattttctgttggattaagacagtacggctacttttccatcgttgctgttcctaaggaaacacaaacgctggaggaagcaaagaatatggtacttgatgaaattgaactgatcaaaaaaggagattttccggattggatgctacctgctatcatcaatgatttcaagcttcagagaatgaaggggcttgaaaccgcagaaggactcgctactacgctttatgactcttatataaaaggaagaacctgggaacaggaactgaatgaaatggatgaatacgcctctttcaccaaggaggatgtagtaaattttgccaatgattttttcagagaaaactatgtggtaatcaataaagaaaaaggagtaaatgataagttgatcagagttgagaaccccggcatcactcctgttaagattaaccgtgatacccagtctgagtttttaaaagagattttagcggataaaactgaggatattaagcctgaatttatcgattatcagaaagaaatcatcactgatcagctgaatggcaaaaaattaagttttgtaaagaacagatacaacgatatcgcacagctgcattttatttttcctatgggaagtgatcatgacagagatttaggaatttccactcaactacttcagtatttgggaacagatacgctttcgccggaagatctgaaaaaggagtttttcaaaataggaatcagcaatgattttaaaacaacgaatgatcagctgaccatatctttaagcggactggaagagaatatagaaaaaggagttgccctacttcagcactggatgcatgatgtaaaacctgatcaggagatctataaccaatttgtaggaacagtactggaaaaccgccaggctgtcaagaaagacaaaaaccgtattataacagccctgaacaactatacaaaattaggaagcaattcacgttttacggatgttatttcgaaggaagaacttgaaaacagcaatgcggaagtttttactgacagaatgaaaaagctattcaaatatccttaccaggtatttttctatggtaaagactttgaaaatttcaaggaatatatcggaaggtatgtagaacctgaaagtcttcagatccctgatgccagggaatatcctgaacctgcgacaggaggaaacgtcaatttcatcaattatgatatggttcagatggaaatgagtaagatcgggaaaggaaatgaggtgaaccctaatcattttggaaagatcaatgtatttaatgaatatttcggaagaggattgtcttcgattgtattccaggagatccgtgaaagtaaaagtctcgcctattcagcgtatgtttcctatgcagcgaattctgagcttaaccatcctgactacgtgactacttatatcggaacccagccggacaaactgatgattgcggtggataccctgaatgaactgatgacagaacttcctgaagtacctattcagtttgaaaatgcaaagaatgcagccctgaaacagattgcttcaacaagagttacccgaaacaatatatttttcaacactttaagattgagaaagcttaatatttatcatgatttcagaaaggatatttatcagcagatccaaagcctgaaatttgaagatatcaaacatttctatcacacagaaatcaaaccggtgcagtttaatacagccattatcgggaaaaaagaaaatctggatatggaagccgtcaataaaatgggaacatttaaagaagtaagtctgaaagatattttcggacattaaaaaaacaacgcctgataaatcttttcaggcgtttgtttttttataaatgatgaatgatcattgatatgtgataatgccttattctacttacgtcatcatacaatctccatcgccatcctgatagtttgggttaaaattatcgggtaataatgccaaaaggttcttatggaaaagatactctcttctgaaatcacgctcgtagatatgggaaaatacttttgagttttgtatggctttgtttaatccggtttgataagaggtgaagcctttcactttatgggtaatgatgaagtaatttaaaaaacggacaacctcatctggattactatccgtaaaaagataaggtattttaagatagccatcacggagctgcaacagaaaacaagatgtaagtttattggtttgatcaaaaattttaatccagaagtatttaaatgtcccggcaaaactcgaaaaaaagtatttgtcatctttttcgccttccagcacccagggattgtctataaagatgttaatttcatccgcattacgcctgttaggaaatccattaatgaaaacagcactttcctgatcgattctatccagcatttcatatttgaaatccggtttttgtgtggaaagattttttattgagatcagtccattggctgtaacatccagaatttttaaaagtggcttcagggattgcgttcccggctttttttcaggaatcattttagcagcatctgttctgaaataatagcgctttccttctttaggaaaagcatactcaaacactcccataatattgtaaagtgcctctgcttctttggtaaattctgtaatggcaattcttccttcgtactcttcaaaaacttttttcaataatgcttttgccggtcttttctttctgtattccggattcacatacagcgtactgagccaggcatagtggattttttttccatcaatttcaaaatgatccggaaaacaccccacataacccaccagtttttcttcatagaaagccagaataagaagagtgtcttcagctaatgcttttggattctggatatgagacaacgcacggtgcctggtaaccggaagaaaatcatattgctgaaaatctccggaggatataaaatctcccagttcttttctgttgtatgttttcagtgttatcattttctcagaatcatatttttattgatcagctttttcagcctgaaataagcaatttcctttttcaatatctgtgctccgctctctcccatttccatcggaattctttgaaaatttttccttacactgtccagctttatgccggcacatccgaagctgcagtaaatttcttcatttttatagagttcatcaaaaaaatctttcttgacttcaaaatcggtaaacgggaatgcaaaactttcgtacaaaaaaccattttcttttacataagcaaaagctttatctgttgtttccatctgttctttcagagataaatctccgtatttcgggtggtcccagctgtgcgatgagattccaaagcctttgcgggtaagatcttttaattcttcagtactcaaataaggcttatattctttggagtaagctttaaaatctatttcaagtttttcagcaagcctgtccagaatacttttttcctgataattaacggataaaattttcttttgtagaacgcgtctatctatgttttttaacgatagaataaaataaatttcaggatctattgttttcattcttttagcagcatcggcaagaaggcttgccttacacctgaacatcatctctttgttatcaatgaaagcaggattgataaaattacaggcataaattccttttcgttccaaaacaggagccgcaatatcataaaactctctgaaaccgtcatcaaaagtaagcaaagcaatcttttttgcaggcttaaaatttcctgacatacaatctttgaactcctgccagtttacaaactgaaaattctttgagagatgatccagatcttcttcaaacagcctggtattcttataacggattatgtgttttaaatgaggaagttccctgtctgagacactatgataaagaggcagacagtaatccagcggaaaagatttcccgatattctcagatccgagggctgccagtacattgatgatcctgtctttcatcttatttaaaataaaaagaatctattcaaaactcaattcaaatagattcttaaaggtataacttttaaattattttataattttcatttcatcaataagccactttgagtcagcaaacttatcaatgatgaaaaggatatatttcgtgtctaccatgatgtttctgctgaaacgcggatcatagttgatatcactcatagtaccttcccactgtctgtcgaagttcagtccgacaaggtttccgttggcatccagagcaggacttcctgagttccctccggttgtatggttggttgcagtgaatcctacaggaacatcacctgttttatctttataaattccgtagtcttttttgttgtaaagatcaatcagtttctttggaacatcaaattcataatctccaggaacatatttttccattactcctgccaggtgagtctggtatccgtacgatacggcatctcttggcgtagagcctttcactttaccataagtcacacgaagcgttgaattggcatccgggaagaactttctgtccttatccgtctgcatctgctgagccatgaacgttttctgtaaagcatcgatttttgcctgcattgaagtatattgaggatctgcagttttcatataggtttccttcatggcaacatacagctgataaatcgggtctttctttaaagtcttgatcaatttatcctgattggaaaacgctttatcaatatctgttgtcaaagttgctccgtttacagcagttcttcctgtgacaacggagtttttagacatatcttccactacaggaatgttggcattttcatctttatatttgttgaatccagccggtaaaaactgtggtgctgttttgttaacatataatgccagtaattttgctgttactttagcatcaagctctgcactgtagtctttgtaaaaagaagttaattttgattttaattttgtaagctccttttcatccattcttccggcttccacagcagctacgaaatcataatagtctcccgcaagctttaaagtctctgcatttctggttacttctgtatagtaagcattgtttaatgcataaggagcctgatcattgtacagtttattcagctgatccaaagtattcttgatctcagggtttttagccaccaaagatccttcgtacattactttcttttctacagcattggattttttcaatccttctacttcaccaatccactttttccagtaattggctactgaagcatattttgaagcgtatttgatacgtgtttcattatcaacacgcattttctcatctaatgtttttaaagccacatcacgtacggcaatcttagcaggatcaatatctttcatgatcttttctaccgcaacggcaggaaggtattccgtagttcttcccgggaatccgaatacaaaggtaaaatcgttttcgtttttatcttttatggaaaccggcaagtagtgcttaggtacgtaaggtacgttgtcttttgaataatccgcaggtttgttgtttttgtctgcatagattctgaacatagagaaatctccggtatgtcttggccaaacccagttgtccgtatcacttccgaatttcccgatactttgaggcggtgctcctacaagcctgatatctttatacgtttcgatggtataagcatagtatttgtttccgtaatacataggctttatcatgatcgactggtaagattcaattttctgagcgtttttatatacctcaatattattattgatctttttggtaagttccggttctgtaagattgtccgtaccttccaaaatatgatccgtaacttcttttatatctacaataaaatctacttttagtccgggattagaaagttccccttctgtattttttgcccagaaaccgtttgaaagaagatcattctgaacggtagagtgcgcctgaatctggccgaaaccgcagtgatgattggttaacagcaatcctttcggtgaaataatttccgcagtacatccgccgttaaactgtactactgcatccttaatgctcggtttctgagggttgaaaatatctttagcagaaatcttcattcccaaatccttcatttccttttcattcagctctgtaggaatccacattcctccatattgttgtgcaaatgccattgcagctggcaaaagaaatacagataaaagtatcttttttgtcataatcaaaattttgccccaatttacgaagaaaaatatgaacaggctttataaaacaggtggaaaagttattaagaataggtttttgaaaataaggacagtccatagtgaattttgcttcgcaagtgaatagtaaatttttataatcaaccgataagtaatttcattaagaattgacaagcaagcgaattgtctatgcaccattccttagaggtgatgttgaatgctcttctggctcagtttttgttgattggaagtatctttattattaaaaacatacttaaatctattattatgatgaaaagcaaaatgctcatcttgggaatgggagccgctctgttccttgcctcatgttctaaaaaggaaacaactgaaacaacagcaacaacagattctgctgcggctgttcaacctaccgcaacagacagtatcacaaaagcaactccaactgctgccggagatacttcagagaatgcactggactgggccggaacttatgaagccactgttccatgtgccgactgcccgggaatcaaaacttctttaacgttgaataatgataaaacattcagcattacggaagaatatcttgaaagaaactctaaaaatcaggataaaggatcttttacatgggatgcaacaggaagcataatcactttaaaaggaaaatcggcaaactataaatataaagtgggtgaaaatatgttgatccagcttgatatggaaggaaaggaaatagacggtccgaacaaggatctttatgtattcaagaaaaaataaaaataaaggctccggcctttatttttttgttcttatagtctagaactgataagcagtaattttagaatcatttaccagacgccgtattacttcttcatggtgactgttttttcctaccagcctccagacaacagtaaaattgtcctgtgaatattgttgcctgatcatctggtatcttaaatgatgttctttaaagatattctcgcaatagctgatatcttctgcctttgttacagcaattctatattcccttactttattataatcatcaataaaattctgaagataggttaaagcactcagaacgataagtaccaaagcagttcccagcatagcaatataaacatatcctgaaccaactgccattcctatagaagctgtagcccaaatggttgttgcagtcgtaataccttcaattttattatctcctttaaaaatgactcctgctcccaggaatccgattccggtaatgatattggcagcaaggcggtccgggttttcaactcctatctttatagaaagaatggtaaaaagacaggctccaaaacacacgagaataaatgttctgagaccggcagatttattccggtattcccgctcagcaccaatgaacagtcccagaataacagaaataagaatcagcagtaattcatttttgacaatataatggtcctgaaggaaatccatagcttttaatttaaaccaggaataaatttacaataaaatacaattaaagaactacttttgccactcggattttgtcttgtacattaaaaaaatatttcacgaaaaacttttgtaatattacaccttaacagcaacaattcctgaaataaaaaattatgaaggtaatcaacggcaaattcgctcaaaaaagatcaaaaaataatacttatatacattatggataaagaaatttcacacttctggttaggatattttaaaaatgaagaagacttttacagtttcgtggaagaagacgaaaattattatatcgaagaggaaagcgaagatcagtacgtttccaagtttgcagaatcacagaatatcaaatggtttgatgatgattttatagaatatggcttcgaggatgaaagcctaagtctttatgacaagtttgcagaatattcttatgctgaccaatggctcccgatcctggaaagaaaactgaatgaattaagcctggatactcctgtgaatgccattattttcgccacaagatttgtaattcccaatcctgcttctgtggaaaatgatgatttttcactgcattatgtgggggaaatagaatatgatatttaatatcagagaccaatctgctcaataattgctggcaacaagtgattttattatactgatcatctgttgccattttttaatcaataaaaatgaagataataaagctatatatttgaatcatgaaagaatctaaatctaagcagttctactcttttctgaagagatggtttgttagtactgcttttatttcattgattacattcttacaattttactggtcaatgggaaccttttcagaccgtatttcaagcggctgtccggagtgttcattttttgaagatgcggtatttatatcccttataaccggtagctttttatcaattgtcttttctctgtttttttttgttaagagaatcatccttagggcttctgttgagttcttattactgatcttggtttggttattttggaactacaccatatttgtagacagagaatcttcctggagcacttacgacgtcacttcggaaattcaatatactgtttcgctttcctatctttctgttatcttgctgggatgtttgtgtatttggatcttacattatcaggaaataaaagctagatttgtattttgtaaaaataaacaccattgaaaaaaaacatttctattttacttttagcttctttaattgcttattcatgtaataaaacccaaacagatcctccgaaatcctctaaagcctttataaaaaaggatacaacacaagctcagaaggaggaatcagcagcaggaaaacaaatcccggattttgtttcaaatcaatatgaaattcaatacgaaaccgaaggtgacctcaaccaggacggatttcccgataaggctttagttctaaggaagaaagacgacactttagcacagagaacaatgattgtccttttaaagaatcctgacaaaacctaccgcttatataaaacttccaaaacagtcctgcccgccgaatacaatgattcaggttataagatgcatgatcctgaagacatcagtattgagaaaggggaattacatatcaatttatatgacatcgggccttacggcaaccagttcagtacattcaaatatatgaatgacaacaatctggttctcacttatatcgaaacctataatatgggagcgggttctcattctgccctctattacgaaccaatgaaaggtaaagtaacgcttgaaacggtaaatactatggaagaagaaatgccgtcagaaactaaaaaggtaatcttgaagaaagaaagattcttatttgaaaacgtttctcctgatcatgttgttaccaatgtttaccattctgtagaacagcaggagtaagctgtcccgatctaataaaataaaacttccgtctccaggacggaagttttttatgtaaggtactatttttagtctgattaatgggcttccagccaattatcccctactccaatctccaccaataacggaacctgtgtttttaaggcattttccatttctgttttgatcagctgggaagcagattcaatttcatccgccggggcttcaaacaccaattcgtcatggacctgaagaagcatttttgttttcagctgctgctcttccagttccctgtcaattttaatcatagcaatcttaacaatatctgctgcacttccctgaactggtgcatttacagcatttctttcagcatggcctcttaccacaaagttgtttgaattgatatctttcaaatgacgttttcttcctaatattgtttctacatagcctaactgacgtgctttattcacctgttctgccatgtattccttcaacttcggataagtctcgaagtaggcttcgatcatctgcttggcttctgtacgggataacccggtttgctctgccaatgcaaaagccccctgtccgtagatgatcccaaagttaacggttttggcctggcttctctgggttttggaaacttcagctaatggaattttaaacagttttgcggctgtggaagcgtgaatatcctctccatcctggaaggctttgatcatgttttcttctcctgaaatttcagcaatcagacgaagttcaatctgagaataatcggcagagataatctttttcccttctccggaaacgaaagctccacgaatctgctgtcctctcagcgttcggatcgggatattctgcaggttcgggtttacactcgccaaacggcctgttgcggctgtagtctgtgagaaattggtatgtaccctgttgtcgtctttatcgatctgcgacggtaaggcatctacataggttgatttcaatttctggtaagttctgtactccagaatatgtttgatgatctcatgttttgaagaaagtttctgaagaacatcttccgaggttgcatactgcccggtctttgttttcttggcttttggatcaagctgcattttttcaaacaggatttctcccagctgccttggtgaattcatgttgaactcttcgcctgaaagttcaaagatttttgcttctaatcctttcaggtcgttttcaagatctacactttcctgtgccagccatttttcatccagggaaataccagccagctccattttggcaagtacttccatcagaggcatttcgatattgtagaaaagttcttccaggttttcttttttaagctgtggtgcaaaaagttcatacaactggaatgttacatctgcatcttcggccgcataatcggtctgggttctgagatctgcatctctgaaattcccttgttttttacctttttttccaatgatggtttcaatggatacaggcttgtagttcaggtacacttcggaaagataatccatcccgtgtcttccgtccggattcagcagataatgggcaatcatggtatcaaacatggcccctttcaccgtaatatcgtattgttttaagactttataatcaaatttgagattgtgtgctactttcagcaggttttctttttcaaaaaacggtctgaaaatctccagggtctgcaacacttcttctctgttttcagagagaggaatgtagtaggcaagtccttttttataagagaaactcattcctaccaattcagcttccagctcgttcaatgaggtggtttccgtatcaaaacaaaccactttttgctgtaaaagattatctacaagttttttctgagctttcggattattgataaactgatacagatgatcgttatgctcaatagttgattttgtagaagtagcctgctctaactcttcaaaattagcaaaaagatcaagctgcattacctgtcccttgacttctgttccggccggagtctgttttacttctacctcgcttacgacaatagtttctgccggcgcaggagcaaaagctctgtaaaggttttcgtacagccttctgaattctatttcatcaaaaacttcttttactttttcaaaatccggagtttcaagatcatattgttcctggtggaattctacgggagcatcacagataatggttgccagttttttagacaaaattccacgttctgcagaggcttctactttttccttcagtttacctttcagcttatcagtattggctaacaggttttcaatgcttccgaattctttaaggaacttcatcgccgttttttctcctactccctccagtcccggaatattatctaccgcatctcccatcatggcaagaaaatcaataacctgtttagggtcttcaatttcatattttgcctttacttcttctactccgagaatttcgatatcacctccttttaaacctggcttataaattttaattttatcggtaaccagctgtgcaaagtccttatcaggtgtcaccatatacgtggtatatccttctttttctgctttacaggcaatagtacctatgacatcgtccgcttcatatccttctactccaagaataggaatatgcattgcctccagaattctgtggatgtatggaacagcaattttgattgcttcgggagtttcgcttctgttggctttataatcagagaaatcatcagttcttacgctagcttgtcctacgtcaaaaactacagccagatgagtaggtttttctctcctgatcaattcgatcaaagaattggtaaaaccaaaaatagcagaagtatccagccctttgctggtgagtctcggattcctgattaatgcgtaatatcctctgaaaatcatcgcatacgcatcgatgagaaacagccttttatcttgtgttgcgtccatattatctataatgaacaaatataagaaaataggagtaaaagttgatagtttgaggaagagtttcaggaatgagattggggtttcggggatatgggatacgaggtgcgggatgcgggatacgtattatggtaaccactttttagcaattattgttttgaaatggaattgttcattcttatctcgatggctttccatttttattattttaacaaccactttttataaaaataaaacagcatatccaaagacatgctgtttctttttttatttaagtttatgggattatttaccagatgtaggccatagccctgcgtactgagaattaccgtagtcaatagtttcagcacttactacgaagctgatcagcatactgttgctgtcaatggcatcaaagtctacttcgtgctggattacatatccgttttcccatttcaaagtaattaatgttccttcttcgtgagatttattgaatgtgatttctcctactgtaggcttatatttaccgtttaacaagctttcaaggatgtctgatttttcagtagcttctaccgtaaccttgattaatgcattggaaggatccgatgctacacgtcctgatacgtctgtagatcttgatacactgtagttcatttttaacagcttctgtccttctccgttgttgaattttaagattcctcttgaatttctttcggccatgattgtaaattttaatcgttagtaataaattgtaattcaataattatataacaaagataaaacccttgtttttgaaaaaaaagcatttgaatctaaatctgaaaaagtgtcgtaattgtacgatttgatgtcgtagttctacgatttattgtcgtaattctacgacaacagatttaaaaacagaacataaacaccttattacaaacatattaaaagcaaaaacagagaagttattactacactataaagagatatattacctctgaaattatcctcaaaatctgataatgttaaataaaaaacagaacagcgtctcttgcccgctgttctgtaccaattttatttttactaagatgatgaataggcttatttacctgctgaaggccatagtcctgcgtactgagaagtaccgtagtcaatagtttcagcacttactacgaagctgatcagcatactgttgctgtcaatagcatcaaagtctacttcgtgctggattacatatccgttttcccatttcaaagtaattaatgttccttcttcgtgagatttgttgaatacaatttcccctactgtcggcttatatttaccgtttaacaaactttcaaggatgtctgatttttcagtagcttctaccgtaaccttgattaatgcgttggaaggatccgatgctacacgtcctgatacgtcagtagatcttgatacgctgtaattcatttttaacagcttttgtccttctccgttgttgaattttaagattcctcttgaatttctttcggccatgattgtaaattttaatcgttaatattttgtgattcggtgattgtgttaacaaatatagaggctctttaccgctaaaaaaaacttttcaatataaatctgaaaaagtgtagtagttctacgatttgttgtcgtaattctacgacattagatttatatacaacattaacattctgtttataagtgtattatataaattaaacaagaattataaaattaaaatatttcacactaaaaagacaattaacatacggaaaatcatattattaaccctttattatgttattttcctttaattctgtttaaatcctcctgataaagattttctccgtaattgttcttaaaatttactgatcgtttatctttagaacttaacgactcatattgttttattctgagttttgcttcttccaatgtgtccttcttatatggaaatgctatattatatttctcagacagctgttttttaattctgaataatttttcataataaggagagtcgggcaggttacgatcatttttctgcttttccttatactgaatataatctgcgatcgggcaaaggttcgttcctttaattttaggcaatcctcctttagttaaaaaatattctgccatatccagatcgtctctggcagcactttccataatattgcttccattataggagacattattgatgtcagctccattctgaagtaagtaatcaatcattttcttttcggtactttcatcacctccgagggtcatcgcatcagataagggggaattccctaaagccgggttaggactggctttatatttaaaaagcaactgcagcatttcataattattaagtgctacagcatgattcaaaggagattcaagaccttcatgcggcactatgatattgggatctgccccaagttccaaaagcttttccattgcttttaaatcttcaataatggaagcatacatcagtaaggtataacctgtattctcctgcagtttattgatgtcaatatttttttccttaatgagctcttccatgcctttaagatctccatcaaacattttctgggctgctgataaagcgtctccggcaaacattctcgaaggaggatattgatttctattttcgtttttacgcgacctaagattaaaatctgaacaggaaaaaagtgtcatgatggaaaatattattaaaataattggtttcatattatatattattagctacaacatcagtatttatagtggccagcattgcctggaacgcatcattatatgcgctatgaccgcttccaatggttttgattccaagcccttcattatcatcaatatacccgaagatttcatgctgttgtcctaaagcccttggaactcctcccgtgaggcctccaaaaattgcaattttgttaagccccggaattctggataaagccaatgtagaaagcaggccttctctgttattttgcagcccgttaagaatatcattacttgtactgtaattgataatgtttgaagttgattttacagctccttttttatcgagataatcaagtgtattgccatgtactcctcttgcattgaaggtatatcccggaagaccggtataataggaagccatggcgctgtttcctcctcccaatgaatgtccggtgaatttcacttttcctccggtagcattatccattttttcagcgagcattctggttttttctatctgaggggttgcaaagccaagagcctgccctccatcttcaataagccagtcatgataaaactgcattcctttaggttcggagcccctgaatgctacaaaataatctcctgtttctttgttataatataaggaggaaaagaaaccgttatctttattagtgttgaaatctttgctgtttagcactccgggaccgaacagcttatccagctcagcctgatcatctgtattgattcttgtatatccttcaatattggtattcttcccgttatcctcgtaagaatcctgggccattctactggcaatagaggcttcctgtaactgggcaacgggcaaatgaaaggtaattttacctcctatgaaacagtgtaaactggaattttgcaacagaggttttttattttcaatttttactttgggatgggtattttgccagtcgcttcccttgcataaaaaggaacagatattaaggcagtcatctatgagagcacttcctgcccaggccgcggctgccaaaacaaaaagccctccggagaaagctgctgctactgccacacctgctaatgctcctgccatcatcatttcgggacaaataaaattatctttaaaccgatccttttccgtagccatcagcttagctccttttttcaattttactgaagactgagagctgactccaatgcctataagtctccggcctttactacaagtaagcggagtatcctgtgcgatatataattgactcatagtgacggtattaattgttattttttatttaactttatcttgtatctgcaaacatagatcatcttttcattgagttcttctttcacatggaatataacttctgataatacagaatcttcattataagtatactcaccttcaatggtgtacttatattccagagcatttccaagtgttctctgatatttatctttataaatactttcaaaacgggactggttccctttacttttgccatccagtttgactatgaaacctccttctttattttttaaaattttgtacgaggaactatattcaagttcttctcccgggaaaagggttgacaaagttgttcttgcaggaatttcatctgtaaaacttcctccgctgaatacgggtaaaggataaaacatgatctgatacaaaaaatttcgactgatattgcgatctatattgttaaattcctgatcatagatctgaataaatgccttgtaactttcttttaccagttcaaaaaaatgcagatccttttttatctcttcccacctgcgtagaatttcatttttattggtgacttcatgaatacttttatcggtatttaaagatagttcaacaacttctgttgctttgtttattttctcaagaatttcataaaacggctgcatttgtccgtctgcctgaatatatctctgggtagaagaatggatgttaatatgattgtattctccaggtgttacgatccagtcttcttctatttctgtctggttagctttacctgttcccagtgtaagataggatttgatattgatgtgatattctccttttttataccaggcatatttaaatcctgacagatggtcatttttttcagctttattcggttccaaagtcatgtttttaatacgttttagaatacactcacgatattagttgatatcaacattacttccagtaataaatatatctcctgtagcattcattgaagtgactgctttactgtgaatactcagattatcctgtgttaccaataatgcatttttcaatgaattcaaatccagcattccttcttttgcagatatagtaatgccttctttagtaattgtgatactgttttgacctacccttaattcaatttttgtttttccttccagagaaatatttccgtctgcgtccattgtcagaacagaattggctgccccgccttcttttcctccgacattaatggaatttgtactgccggcatttaccgtattattacttcctacgtttaccgttttattgttattggcattagtctgaacatttcctgccccatcaaacttcatattggctccgccctgatcagtaagaaatacagaaccttcaccatcatttaattctaatttatttccacttctgctgctcaggctttttatattgttaccggttccgccaccgccgccgattccaccatggaacattcctcccatcacaaacggacgatccggatgctgatgtacaaagttgacaataacctggtctcccacttccggaacagccataaatcctctgttcttacttactttatcactactcccggcatccggagtcattacgcggataaattcggtagtatcgggtccgttttgccaatcgaactgcacccgtactcttccctggtttaaaggatctgtatttgaaattacttttccaaactgggcttctgcttttggcatctgaaattcgggacgcgggataaatcctgtatctgcggcaattgcttcaaatttaccatcgtaatagcctctggcatctacttcgtgagtgacttcaataatcatcagcttggtaaaataagccgtttcattactcccggatttgcgcatttcgatatctgcggtacatcccgggtataagaaaggaactgttgtagttcctgaagtaacgaaaacttctgaagctttgcttcctgcggttcccttctgggaagcatcaatatccatgaaggaagaagctttgataggagcaactctcagagaaggggttgtaaaagttttttctgatatttcgtaagctcgtcttgcaatatctgatgtatggttaatttttgaactgccagttgtcagcttctcatttttactgctgttatagccataaaaagtaggacttacatgctgggccttcattttgatggcaatatcacttacactgcttccataagtaagccttacaggcttttcctgaggtggcaattttccgaagtgcagaacttccccatcataataaaactgctctccataggcttcggccattctggcgagatagttataatgggtttcttcatattgtgagctataggatatatttccatgttgtgcatctactctgaaatcgaatttatgctgtcccagtccttctttaattacctgatcagcaatactgttcagacttacaggctggcttcctccaaagctctgaatatgaggagcagcatctaaaagtacagttgggctgtagcctttgatcataatatttccaagacttcctttttcctggctgaatcccacttctgtaatcactcctacaaaattgcgttcagcacctttctcaatatctttatatttgaaaacaactgtgattctttttcctaaaaatctctgagcttcttccagattgtgattttccggtttacccaaagtatcatgggccagcatcagactgaattcatggtgcctggtagcactctggaccagcttaaaatgcttgaaatgattaatgatctgtccttctatgatgacatcgagcttgatgacacggttgattccagctatataactctgagaaatagcttctgcattatgtatttttgaagtaggctgcctggcccacacttttgtctcaacaacggaaggatcattggaaaccaacgtttgattcagaaacttacctgtttcctgtgctgagtttacatgctgtgcggtttctgctgtcttttttattttatcccctgctttgcttactttttcctctgctttcgcaaccgcattttcctgtgcagtttttttgatcgtctctgtatcctggctgatagattgttgagaattctttattttggttttatcatcttgaaacatagtgttgcgtgtttaagttaataaatattgaattgaagctgtaggtattattaccagctctttaaattccagatatcgttttctatgtactggattatttatctgaaacttattgtaaagcagaaaacagaacagcaaacttttacaagggctgttctgtaccaattttatttttactaagatgatgaataggcttatttacctgctgaaggccatagtcctgcgtactgagaagtaccgtagtcaatagtttcagcacttactacgaagctgatcagcatactgttgctgtcgatggcatcaaagtctacttcgtgctggattacatatccgttctcccatttcaaagtaattaatgttccttcttcgtgagatttgttgaatacaatttcccctactgtcggcttgtatttaccgtttaacaagctttcaaggatgtctgatttttcagtagcttctaccgtaaccttgattaatgcgttggaaggatctgatgctacacgtcctgatacgtctgtagatcttgatacactgtagttcatttttaacagcttctgtccttctccgttgttgaattttaagattcctcttgaatttctttcggccatgattgtaaattttaatcgttaatattttgtgattcggtgattgtgttaacaaagatagaggctctttaccgctaaaaaaaacttttcaatataaatctgaaaaagtgtagtagttctacgatttgttgtcgtaattctacgacattggatttaacaaattcattacacatacgattaataaagactttcaacacatttaaaaaggataattaaaatcaataattttacacattactgagaaatattaagattcttttaataaaattagtatgtttttaacagtacaaaaaagcagcaagtaagaaacctgctgcttatttattttattcaattttatttactgtttactgttgagtcttacctccttcttttatggaacgaactaatattttattttttctcagcagaaaatcgggcatcagatcaaccggaagatagaaagggctttccccttttttctgcagttcttctacaattcccggattccaggcaagaattttatctactcctatattaagttcggctgcaactacgttaagattaaatccggcattgatttctgtttctgaaagtgcagcagcagtttctttccggtctccttcaaaaaacaccttattgattcttgatgaattataattattcaggacactctgaagctctccggtagcataacatgcattcaggtatttctttacgtgattaatagtttcccccggaagatatttataaaattcatgatattgagaggaacctgcagcttccattgctttcgctatatttccttcgccacagttgtaagcagctactaccgtcacccaattattatactttttatagaggttgcttaaagaaatggccgctgttttggtacttttatagagatccgtacgtccctgctcagtaagtccgtactggttggcgtgtgcagtcataaactgccaaacccctacagctccggctcctgaggtaatatttctgtcaaaattagactcaatcagagccaggtttctcaaatgtttgggaagtcctttctggagaagtaactgctcaataaattctaccagatctttattggcattaatgatacttctgtactttttcacactgctttccgaggtatcggaagcggcaagaaactgtccgtttaccaaaacaacagttcctattaatagtaaacctgtaaagatatttctgacaatcgttttcatgttaattttatttataagcaaaaggcaaaaaagcggcttgcagatctgcctttactgtatacttaatctactttccagcttagtttttcttcttctttattccaatctacatggatagtctgcccggatttcacttcttctctgacaatcattttagagataggtcttgccagctgtgcacgaatgactccagagatctgtcttgctccgtacttactgctgaatccacctaaagcaaggtttctgacagcatcatcacttatttttaaagtgataccgagccttgtcaaggatgtatgaagtgatttcagctgaatattaaagattctctctgcaatggattctgtaattggtgcaaaaggaatgatctctgtaattcttgccaggaactcaggtctgaaccgtcctgaatttgacataatttgcatcagtgaagatgattccggaatttttccttcttcaaactgttttacaatttcttcacttccgatattggaagtaaacagaatcaatgcattactaaaatctccttctttccctaatttatcatgtactttcccttcatccataatctgaaggaatacatcaaacacagaatggtgggctttttcaatttcatcaaataaaactacagtataaggctgttgtctgattttatttaccagcatacccccttcttcatatcctacatatcccggaggcgctccgtatagcaatgccgcggaatgctcttctttaaattctgacatatcaaagcgtaccattgccttttcatcgttgaaaagcaactctgccattgatttcgccagctctgttttaccggttccggtaggccccagaaggaagaaggatccgataggttgccccggcttattcaatccgcttcggttttcaacaatggcatcggaaaggattttcaatgcatggtcctgccctaccactctgttcaacagaagggattccatattcaggagtttttctttttcctgggcctggattttcccgattggaatattggtttttgcagccattacagcagccagttctaatctgtctaccttttctctttttttggccgcatgctgcagaagttctgcataggtatcttcaataatcttctggatctgatctacgggcatagagttgtcaatcgaaggctgttcactcagtgatccccacagaatcgggcttattttgtctctcaacaggttgtaagtccagatcagttcatccgctttatctttgttgtctgcatattcttccttcaaaattgtatcataactttctttccagctttcaagttctttttcggaaagttcatcaagcattttgatcgcggccattgttctgtctaacaaatcgatagctgcatccggcaattttttacctttagcatatctttttgcaagacgtacgcattccggaagagctgttttttcaacttcaataccgtggtgttttttgtacccttcaaggagtacatctatcattttgacacaggtcttctcgtccggttcaagaacggtcaacacttcaaaacgacggttgaaagcttgttcaggctcaataatttttctgtattcttcctgagttgtggctccaattacggtaatttcacctctggcaagctcaggtttcaggagattggcaacatttccgatgcttcctttcgggtctaagagggtatgaatttcatcaatgaaaagaatggctttttcaattttcttacattcattgatgacttttttcaggcggtcttcaatttcgcctttataagaggttccggctagcaacgctccggtatcaagttctaaaagggttccgtttttaagcatttcaggaacattccctttaataatttctgtagcaaagccttctaccaaagctgtttttcctactcccggctctccgataatgatcacatttggtttacttctgcgacaaagaatttccaccagcattctgagttctttgtccctgccgatgatattttctatttctccttttcttgcctgtgccgttctgtcgacacagtaacttttaatagaaggaaaggaagaatctgaatagtctgaaccatttgaaaataatgatgagaagttcccatcttctgaaacagtaaacggagtatcttttctgtaaagattaaagatttcatgttctctcaaaggaagtgattttaactgctgaagagagaatacaacctgtggttttacaatggctgtaaggatgcagataggagtaatctcatccagtcctaattttaaacggatatcgtcagcctcttcaataagggtatccactgcatcatcctgccctacttcatcgggaagatgactggttttcggatattcttcgatgcggacatctgcccattcatagaagtatcccggatctttatctatgcttttcaggaattcattaagtccgatatctttatgcattaaagcctgcaggatgtgcgggccaccataagttccattataattttccttcgctatcgactgagcaatgtgaaatagttgctttactgtttcgttggttactagtactcccatttataattttcttatattaatatatttgcgttctgttttatgtgctgatttgatggtttcgatccatattttccatcccttttatcagggtataaaaaattgttctttttatgatgctaaaattagttattttattctaaatgatataaagatagttaattcttcaaatagagaagaagcatgatttgttgttttaccctggtgacctctattggattataacctaaaagaggctattaatattgctgaattaatgaattcaccctatctacgtcataatcaaaaacaaattctttgttcatttctttttttgaatgatattgtctgtttttttcctcttctttatgtccatactcctgatattcgctttctatttttccaactcttacaaatttattttgcttccaatcctgaaaataaaattttgcaacaatattttcttttaccgtagaatttgtaaaatctgtatgttctgcattcgttatcgtatttttttctctaataatcaatatgggaactttatttttgagataaacaatcaggttgtcatgactccattcttctccggcggattctatttttatgatatcaggatctgatagttctttatttattttagatatcaatttttgctcagatttattttgggaaaaaactaaaacggataaaaaaattaaggacgtttttattactttttttatcataagtaatcttttcaaattcattactaacttttggaatcattgtttcttgtaattcctgagattggcattgtagaaaaagacccaacaagaattatggattataaaacggtactgtttttttctgaagctcttttcctgttttaccatccagaatgatttcttctattttgtcgcctgcaatttgatgagaaattctccatacttttttgccttcaaaatcctgttttaatactctggactggtaaccagaatcatggtagcctttaggcagatcaattttattcttttcgcagtatgcaataatatctgcgggtttaaagtcgtagccttcatccatgttttcctctttaaggagcttaccagattcgtcaaaatgataccaaataccaactactgagccttcattgaacaaacatccttttttctcaatattaccattaccatagaaaaatttagtgaccttataaaacaaattatcattataaattatttctctataacctggtgattgaaaatcctgaatgtaggtatttttattttcccgcactttcaagtatcctcttactgatttcttttggaaattttcaatatcaaatttttcatacttattatcaacaattggtatcatatatttgtctattttttgagattggcattgtataaacatactcaaccacattaacactattattttattcataacaacctattttatagatgaattagcttttttccattgccaataatataatgaacatcgcttattatcatttcctccatgatgcgaataatctaataaattatctgtctttctatattcatacgtatacaatgcatgagaagatgcctccttatttgcaaatgtatgggctaaattcattgaatgaagaaattcatgtgctgctgtctgctcgtttttacttttaaatacgaccacataatctgctccataatttgaatatccggaaacgtgtcctcttgcatcataaccatgctcagcaaaataaaatgctttgaaatgctttgtatatttcttaggataagccttttccaattgaactttcaaataatcctgtagctcttttccaccactcattttaccaggatctacctcaccactggttacgaagtcaataaaatttttatctgccgttaaatctaattcaacaatatctgaatcatccgataatttgatatatgcttgctcaagatattgatttatcctatttttttcatcattaatattaggtttattcttccctgatcctattgacaattccggagtttttatttcaacaaatacaacatctttttttttctgttttgtattatcattggcccagacatttattttcccggcaattgattcaacagttgctcctgcttcagttttaaaagcttttaactctatagtctggttacttgttaactcttttatgcatttgattgtaacttcataatcgttcaaagctattttctttttaccttttatttctattttatcaggagtaaaagtaaaataatcagatttggtaaactccaaataatcagcttcttgttggatttctgcaaaaaaagtaatcttaatttctttatcttttaggatagaaagccacggtatgaagtattcttcaggaacatcttttcctgttttatcttttttcgttttccatgcaacactgaaaggattatactctttttttaagttattaaacatcgtttcgctaacctcaaagtatccatcatatttattgccgttttttacttttgttgtaaacttggcatcttcatactgatatgctacaatatcctcaaatttttgatcattaaaaaggctcgtatctcctattctcatccaatcaaaaccaaactctcctttccagtttttattcggtctgaattgcacaatcaattgtatcagctgttgtagtggtggagattggggagtattatgactcacacctttagcattccctttttcagaaatccatttcatggcacgtgaaataatactctcctgagaatacatattatgattttcatgtgagattttattgtaggtgccttttacaattctcgttctgctcatggttaatgtgctttagatttctcaccgctgttattttgaacttcctgctgggcatgtttattaatggaagcattggaagtaatgttgatttccttctccgaaatctcatttctttccttctttgtttcactatgcacatctccttcaatgatctcagtaagtttacccgtaataaatgtactcacatttcctatgaccgaggtaagtttcatagcgcctacagtctcagtattatttaatccgatactatcagacttattcattcccaccgtcgtagtcatattctcccctacattaatgttcatatttttgcagttcagggtcatggtttccggtgctgtgatattgatattacttcctgtagtatccagatggatctcattgccgctcttatccgtaataataatgctttcatcttctgtaaaaacgattctgtggccgcttcttgtctggatagattttacacggttttctgctccaccgccaaggcctattcctccatggaacatccctcccattacgaagggtctgtccggatggcaatggacaaaattcaccattacctgatctcccacttcaggaattgccacatacccacggttctgagtaatctgatcggttcctcctgcatccggactcattacccggacaaagtgagtggtatcattcatctgccagtcaaatcttacctgaactctgccctggccttccggatcagcatttgagattactgttgctatctgcggttgggcagcaggtattgtaaattccggtttgggtaaaaagcctgtatcagccgctatggattcaaaagttcctgtgtaatgcccaattgtatcaatttcatgaacagcttcagtgatcatgacctttgtaaagtaggaagtttcattgctatccggctttctcatatgaatatctgcaatgcatcccggatgcaaaaacggaactgttgtagatccagaaacagaaaacacattaacggcttcacttcctgatgtacttctctgggagtgctctacatccagatgtgtagttgctttgatgggcgcaatctgtaatgccggagttttatatattttatcattatggctgtatgccgtacgggccagatcacccaaatgactgaccggtgtttcacctgaagtcagtttttcgtttttactgctgttatatccgtaatattgaggttttgtatgaacagcttttaactctactctgatattatccgcattgcttccatacatcagctttataggtttattctgaggtggaagttttccaaaatgcaatacctcaccatcgtagtagaattgttctccataagcttctgccattctcgccagataattataatgggtctcgttatattggctgctgtaaataatctgagaataatcgttggtatccactcttatatcaaaccgttctttatccagcccctgtttgattactttttctgcaatgattcccatattaacaggttgtccaccgccaaaactctgaatatgtggagctccatccagcaagatggtcggactgtaccctgaaagcacaatattgccaagactcattttttcctggctgaatcctactttggtaataactccaacaaaatttctttcggggctattctcaatatctttgtacgacataacggccgtgagacgttttccaagaaatttattagcttcttcaagtgtatggctttgcctgtctcccagtgcatcatgagcaaggataagattgaattcgtggtggtgacccgctttttgtttaagagtgaaatgtttatagtacttaataattttgccttctacaaccagtgacaatttaaccagccggttgatgcccgtatgatgattctcggatattccgtcggcattttgtgacggacggaaagaagatccctttgtctttgattcggttttcatatgctttgtgtttgtgttggtattaaagatagtaatattttacgtaacagacattatataagcctgttgtagaataaaatcctttgtgtaagtttttttattcaggcaaaaaaagaccgcctttaatagggacagtctttttcttatgaatgttgataatgtgtgtaatattagcttgacggccatagaccagcatattgcgaagtaccatagtcaatggtttcagcacttactacgaagctgatcagcatactattgctgtcaatggcatcgaagtctacctgatgttgaattacatatccgttttcccatttcagagtgatcagtgttccttcttcgtgagatttattgaatgtgatttctcctactgtcggcttgtatttaccatttaataagctttcaaggatgtctgatttttcagtagcttctaccgtaaccttgatgagagcgttggaagggtctgatgctacacgtcctgatacgtctgtagatcttgatacactgtaattcatttttaacagtttctgtccttctccattattgaattttaagattcctcttgaatttctttcggccatgattagtaaattttaatcgttagtaatattttgtgattcagtgattgtatagcaaagatagaggctcttttccgctaaaaaaaacttttcagtataaatctgagaaattgtagtagttctacgatttgttgtcgtaattctacgacaatagatttaaaccctactctataactcccaccaatgaagcattttaagttaaatcccgtattcaagaaaaatatttattttacacatacaagagaaataattagggtgaaagtttaaatttaaggtacaaaatttaaggttgttataaattaaaacagagagggttcattttacaacacaaaaaaagcagaagttaatactcctgcttttaatatcattaacttaaaattcttaatgttttgtgtattccggctgttccgtaggcattcttgacggagtaaagtattcattaagccagtagaaagtctgtccgttctgctggatttttaccgctgggttatttctgttcgcaagcattctgtccgccagatttttatagtggtaaaaatagtttttcactgtttcattaggaacaacttttgatttcttccagcctttcagtttatacttagccatcaattcttcttcagaaagatcaaatcctgtgctcattccgatagcataagacattggcagctcgtaaagcgctcctttatccaggaattttatcgtaggattatatttcttaagcagcttaacgtattctttaatagctcttgcctgattaaagtctgcacggtcagcctgggtatttctgtatacttccgtgtagaaagctttcagattatcatattccgattcagaaataaggattcctttttctattgccggtgtaaattctttcagatcttttggaatatatcctttcacaaggaacgggcttccgtaattgatcagctgtgctgcaatacctgcagaaaccggattggtaagtcccggatacagatatttatattttaaatccacatctgttcttcctgctcctactgatgaatggaaatattcattaagggatttatcaaccgtctggttgtctaaagtaacctgtgcaataaggctgtcaactgatttcttcaggaatcccggagtcgtaatgtctccttttttagggaaaataacgaatccctgggacatactctgtttagggtaagctaaagaaaagaatcctgcatcaccttccacaaggctgaaattattcttggtcaaaacatcattttggtcgatgatcttttgttttttgagttcagcaatattcttagccgtattggtaaccacattttccgccatcaatacgaaatcattataggtatcggaagatcgtgcgctggtctggaacatgatcagtcttgcctgagcctgagtcagtgaactgattacgctgtacatattcccgctctggttagcagtagttcctacagttacaacaatattggtttcatcaggaacatttgaaagaaggttcccggctgcagtaagagcttctcccaccggctgataaccgttattgcttgcgcagttcatttcattcgttttctgatcaataaatgaagtgattttactgtaatctgtacttaaggtggataccgcaacattatctccacatggattattcttatataaaactgctccatatttaacattgttaaaatatgatggtttttcaaatctgagctgaagatcctgcagcaatgattttacaataggggcataaggcgcattggaagcacttacatccaatgcaaacacaatattgatatttttatctttttccgtgatctctctgtaacggtcaaaatagataggctctcccaatacgttggatacaaagtttttgctgtaatctaaaatattggtgaaatattttgtcttgatatcaggagttggcgtttcttctaacggaagatttatcggataaatgttttccagaggggttctcttatttacatcggtaagaagaatagccgttttattagtagcatctgatgctgatcctccaggatgcccttcatggattcccaatgttgtatcgttaatccctgttgtattcttaagtttgatggcagaacgttctccccatgtagaaatcacatttgagcttacccatccgtaaagccctttactgatactgtccatgtcaacagaaggttttttacctaccaggaaacgtttgttattctcagccatcttgtatacatatacaatctgtccgttagggattttcacattggctgtttcaataagactcggtgagttaaacaccataatagagtcatttttatagtacctttcagcatttctgatgacctcactgttattgggaactacagctactcttacaggataacctgttttttcactttttaaagcgttattccagagaagaagatccgattcaggaatccaaccgtatgtcttaactgattttgacgaaacttttttcattaaagcatccggaacatattccgctacttttaccattccgtctctatgtttcagaaccattaaaggctcaaggaattttacttctttgtaagacttctcatcatctttatccagataagctgtatttcttgatctgtctgaaatgacgatccatggaactgacttttttggatacccgttaacgacaggggaagcatccacctgcccatactgtgaaggctccggggttttctttgacggcagttttacctggcaactcgtcaataatactgataaccctatataatatgctgctagaggaaatttatttttcatcctatttaatctttttatgattggtacatccgtaataccggacgaaattatttgctttgattgatatctactttcgttacacagttctgcgtgtcatccaggtttacttttacagtctggatcaccgtatttttgtcaaactgaagacctgcacaatacatgtagaagttgtttactttactgtcatttacttttaccactgtattttcattgttacacagataagtttttaacaggtaattgtaatgcatattgaaactgtttccgtttgcaatctgctgcaggtgatatttgaaatcgttgtcaacttttgcataagaatcttctacagaaatttcatcttctgcaagagcatcataggcaggaagaattttaatacggtggtaaacaggatcttcgctttcttctgtataaagcgttacaagataatcaccgggctttttataggaataaattgtaaatttatctttagcatctgtgttgccggtttctccgaatttccatgcaaaacgctttgcttcagaaacagcacggaaaggtacgttttcattttgcattgcctgtgcaggagcttcgattgtcgtggtaatcttcgcagtatcctttggcttctgaacgcttcttgcgcttaccattacagggaaagatttcgtgtacttattgtctacgatcaaactcacctgataatatcctggtttattatagaagtgaataccactgtttttatctgaagttgtcccatctccgaaattccatcttttggttttggcaaactgggttttatcttcgaataaaagcgtgtctcctaccgccagtgaagacggataaaccaccccaacaatatcatctgccgaatgtattacctttttctgcagccacagagcaaccaatgctgcgatcagcaaagttgcaataacaccgataataatgtttttcttgttcttttgaaaataattcatagttagtaattgtgatgtgttttatttatgttcctagtatttttttgcttactgcattcttgctttcagatcctgctcgcgctgatagagcttattttgcttatctttaaatccgattcggcattcatctacctgcttctggaaaattttaatgtcttcagaggctgttgaaagaactttcttgtcttcaaaatacattttatagaattttgcaatctgaggataggcatccttacggatatccacaacgtctgtactgttgaaatagctgttaaggtcattaacgcccagctgaatattgttttccatgaaaggttgtggaccgtcatcggtaagtttgctgatcatggtataagtactgtccatgataggaagaacaattttctgatgtttttcaaacgcagctttctgttcaagattctgaattcctcttacatcttcatcagaaaagggagattgaaatccttttaaaaagattactcccaaaaacaacatggcggtcaccagcatcagtattaaataaaaaaactgataatgcctttctttcttagataatgtgatttgtccctgcatatcttttctttttatcttcttcttttacttcctgtgaaatttcttgtaggatcttttctaagctcgttgttggtcactcttatcttacccatacattcatccagatcccttatgatacttttcttctgatactctacctcaatgatcttagcttttaagttcatcataggtacaatctgtttcatcagtacggcataatgcttaaagctctccacactgtctttacccataatgtttttggcgtctctcacattatccataatattggttctgagaaacacttcattctccaccttattaatactaagctggttcattttgtcgtaaatatcatcaatgtgatctttcagtacgtcacttcgaagcatcagttctttgtaggcttcagcttcacggctgatcccttcccgctgtatatcataactcttaaagaagagaaataagcaagcaaaagatacaaccgacaaaacaacaaatgacagaataaacttccaaatgcccattctgacgtcagatttgttcaattttttttccctgttagaagacataatttgcgatttgtttggcctgtgaaaatataaaaaaaaaaattcatgcacaatacgtaatttccccagccttgtttcgtgaaaaccctgattaaattaatattaattttcactttgataagtttttcataaattagacctctgaattttaaatatcattcgccaaatcgatattaagaatgagcaaaatattatctaataccgtacgtttttccattgctgacagtgatttttattttaagaaaataatgatcaaaacacttatggaaaaccccttctatatgcttctgaatgattgtaataacgggcatgaactggtaaacagaatctacagaagacaggaagacgtgttcattattgaactctttatgccggtattaagcgggattgaagcaatcaaatacatcagaaaaaacaataccgaaactcctattattacctattccggaacctatcaggaggatatggctgaaattctttcaaagattccaaatatctactactgtcagaaaaagagcaccatcataaaggacattattaaaggaagtattgtttctgatgacttcgactaccaggcctattccaaagaatgggaacagcagcctcttgctgtacaggaatatatggacaggcagaaaaaagggcaggaagagctttcaccctctgaaatacagctcatgagattctgttatgaaggattcagtaataaagagattgcagaaaagcttaatctgagcaccagaactattgacacttacatcaaccgtcttacagaaaagctggggttaaaaaccaagcttcaccttataagattttgcgtagaaaacggatattataattccagcctgtaaaattctgattcaagcaatatttttttaattccggtaacaaataaggataatcagagattctttcaatgtcttttgtaagactacaaaaaccctgcagagccttccaaaaccgttatttattaatttttgttcatgttttttccgcatcctaattcagccacattattttattgttaattattacaaccctgccttaatatggcgtatatataaaaagtcctgctctttgaataaaaatattttgtcactaatttgctagtattcaatttttttaactaaatttgcacacctaaaatttaaaattaaaataaggaaatgacaaaggcagaattggtaaacaccatctcaaataagttgggaacagaaaagaatgaaacacagaaagttgtagaagcttttatgcaggagatcagaacttctatgtataatggggataacgtttatctaagaggttttggatcttttatcattaaaacaagagctgctaaaacaggaagaaatatttctaaaaacactgcaattgagattcctgctcataacattcctgctttcaaaccttcaaaatcttttgttgagaaagtaaaaactaaagttgcagtaaaataagaacattaactgaatattaactagttactaaaaaattaaaattatgccaagcggaaagaaaagaaaaagacacaaggttgcaactcacaaaagaaagaaaagaagaagagcaaacagacataagaaaaaataatctctttttcccgagatttacaatataataatatagttggtggatttaattttttaaagttcactaactatatttttgtttgcaactataagattccgcggaaaacggagggtttcaaatattattttaacaaacatataatggttttcattcaaaatccttatatttaatagatgaattaatcaaaaaaacatccacttcctataatcttaacaattttatcttattaaaaaatgaagaaagaactaatagtttcgcatgaagatgatcttacaaagattgcgctgctggaagacggaagactatgtgaacttcatgagcaagaagacaaaagcgattttatagttggagatctgtttataggaaaagtaaaaaaactggcacccaatctgaatgcggcattcgtcaatatcggatatgacaaggatgcatttctgcattatcaggatcttggaccgcagtaccttacgtaccgaaagtttttaaaagacactatttctaaaaaacaaagcacttcgagcttaaaaaatttcgagatacaacccgaaatagacaaaaacggaactgtagacaaggtaatcgccaaagacgatctggttttgctacagattaccaaagaaccaatttctaccaaaggtcccaggatttctacccagatttcattaacaggacgctttctggttttaattccttttgacaataaagtttctatttccaaaaaaatcagaagctctgaggaaaaagaaagactgagaacccttatcgacagtattaagcctgaaggattcggggtgatcatcagaacggtagcagaaggaaaaaaagtagccgaccttcataatgatatgaaccagctggttcagaaatgggaaagcacttttaaaaatatccagagaaataaagttccgtctaaagttttaagcgaagaagacaaagcttcagctattttaagagacaattttaaccaggacttcgtgaatatcatctgtgatgatgaacagatggtgaacgaaatgaagaattacattgaagtaattgctcctgaaaagaaaaatattgtccagttttatgattctcatattccacttctggaatattacaatgttgaaaaacagcttaaacagagcttcggaaaacacgtaaacattccaagttctaaaggagcctatcttgttattgagcacacagaagcacttcacgtcgttgacgttaactccggaaacaatattactaccggaacagcggtcaataaggaacacgcactgaaagtgaacaaaatggccgctactgaaatcgcaagacaacttcgcctccgcgacatgggaggaatcatcgttatcgatttcatagacatgccgaattctgatcacagaagagatctttacgaacatctcaaagaggaaatgaagcgcgacaaagcacgccacaaaatacttcctccaagtaaatttggtctgatccagatcaccagacaaagaaaccgtccggaaaagcagatcgaaaccaaagaagaaaacccgaacaaagacggagaaattgtagctcctattgttatcgtggaaagaatgggtgaaaccttaagaaacattctgcagaaagaaaaaggaaaaatctacctgcatgtacacccattcgtggaagcctaccttacaaaaggcattaaaagtatccagatgaaatggtttatgaaatacaaaaaatgggtaaccattgttccaagagattcttttaaatatttagaatacaaaatctataatgctaaaaaagaagaattaatagaattctctaattaaaaaatttaagaccttcagttgtactggaggtttttttattatctttcttgctataagtttcggctgaagccaatggacgtttttgtttatccaggctgggctaaagcccacccctattgaattttaacaaaaagacattttactttttactttttacttttatcttttatcttttatctatgaaaaaccaccattataaaaccaccatccaatggacaggaaacaaaggtaccggaaccagcggttacagagactatgagagaagccacactatttcagcagaaaataaggttgtgattgaaggatcatctgatccggcattccgtggagaccgaacaaaatataatcctgaagaaatgcttttatcttctctctcttcctgtcatatgctctggtatctgcacttctgttccgaggctggtattattgtgacagaatatacagatgaagcttcaggtataatggcagaaacagcaaatggaagcggtcattttacagaagtgatcttacatccaagagtgaccgttgcagaagcatccatgattgaaaaagcagaacagcttcatcataaagcgaatgaatattgcttcattgccaattcggttaattttcctgtaaaacatttccctgctatattagtgaaatcagaaaaataaattcagatcataaaatatcaattcactattcacttgcgaagcaaaattcaccattaacaaacttttcctattggttaattaatgttaaggcccttatttcttcaagatatattgctaaatttgagttatggaaaattttggaaaagatttattgagaaaaataaaaagtgtggaacttcccggtgagcacgcacatggagtcttctcacctccctaccgtcctgtttttacttatgatgaagtattggcaaagaatcccaaatttgcagcagtcaatattgttctgtatctgaaagacaacgagtggtattttccattgattcaaaggactattaacgagcacgacagacatagtggacagatatcactgcccggaggaaagcgtgaggaaatggacagagactttgcagaaactgcggttcgtgaaacctctgaagaaatagggatagacaagcattatgtaagaatcatcagagaaatgtctcctatttatattccgccaagcaatttttacgtatatccttatatttcctatactaaaaaaaatcctgcttttgttcttcagcagacggaagcagtggagacaatcgaatttccgatcacatcctttctcaatctttcagacacccctgaaattatggccctgccaagtgcaggcggacatgaagtccctgtcattaatttcaacggatacattatctggggcgctacagcaatgatattaagtgaattcagccagttgctgaaaaatatgtaactttgcactaccgtgtttaattgagaaatggcgaagaaaaatattttcaccgatgcattcggaacaccttattttttgaaaaggtttattatttttattttaggtattgtatcctacagaaggttcaatggctttaataaactgaagattaccggcacagaacaccttgtggatcttccggattccaatgtattgtttgtgtctaaccatcagacctattttgcagacgtagcagcgatgtaccacgctttctgtgctgtaaacaacggatatttaaacacaataaaaaacccgatctatctgttaaacccaaagatcgatttttactatgttgctgccgaagagaccatgaataaaggtattcttcccaagattttcaaaattgcaggagctgtaacagtaaaaagaacctggagatccgaaggaaaaaatgtcaaccgaatggtagacatgagtgaggtagacaatattatgaaagcattggacaatggctgggtagctactttccctcagggtactacatcagcttttgcacagggacgaagaggaacggccaaattggtaaaaaatcagcgtcctattgtgattccaatcaaaataaacggattcagaagagcttttgataaaaaaggactccgcgtaaaggtaaccggtgtgaaacctacgatggaattcaaagctcctttggatatcgattatgataatgaaaaagcaccggaaatcctgttgaaaatcatgactgccattgagcagactgaagatttcaatcttttacacaattatgatgaagaacttaaagctaaaaaattagaacaaaaggattcaaataattaagtaaattaaaaattatgaacaaaatacttggaatattattcgcaatcatagtattagtttcatgcaacagccagaaggtatattcggattttgatatcagctattcgaaaagcggaggctatgctcctgtttatgaaaacctccttataaaagggaataatgcacactactcctttgaaggccagggaaaaaaatacaaacaggattttaaaatttctgatgaagatttaaagaaactggaccaggttctttctcagaataatttcaggaggatacaggaagaccgtaaaaaattgtatgacaatatttcgacttccatcaatgttaagagaggtcccaatgaaggcagtaaaacggatgcgagtatgatcattccgaattaccagaccaactggaacaatattcttgaggctttccagcagatcattaatattaatgttaaaaaacagtaaagacaattgaaaacccactttattgccattggcggaagcgccatgcataatcttgccatcgcattaaaagacaaaggatatcaggtaaccggttccgatgatgctatttttgaaccttcaaaatcccgactggaaaagaaaggaataatgccccaggaaatgggctggttcccggagaagatcactgcggatattgatgctgtgattctcgggatgcatgcacatcaggataaccctgagctagcaagagctaaagaactgggtctgaaaatatattcttatccggaattcctttacgaacagtctaaaaataaaaccagagttgttatcgcaggatcacatggtaaaacaaccattacctcaatgattcttcatgtgctgaattttcaccggaaagatgtggattttatggtgggtgcccagcttgaaggttttgactgtatggtaaaactgacacaggataatgacttcatggtgctggaaggtgacgaatatctttcctctcctattgacctgcgctcgaaatttttactgtatcagccgaatattgctttaatgagcggtattgcatgggatcacatcaatgtattcaaaacttttgatgattatattgagcagttcagaaagtttgtagcaagcattactgcaggcggagttctggtatacaatgaagaagacccggaagtagtgaaagtagtggaaaatgctgaaaattatttcagaaagatcccatacaaaactcctgaatatgaaatcagcaacggtaaagtatatctaaaaacagaaatgggagatgttcccctttctgtttttggagcgcacaatctgttaaaccttgaaggagcaagacatatctgtcagcaactcggcatcatggatgaagatttctatgaggcaattatgagcttcaaaggcgcctccaagcgtcttgaaaaagtggaaagagaagataaaggaatcctttacaaagattttgcccatgcaccaagtaaggtaaaagctgccgtaaaagcattcgtagaacagtttaaaactgataagaaatatggatttctggagcttcacacctattcaagcctaaatcctgctttccttgagcaatatgaccacgctatggatggtctggacgagtctgtggttttctattctgaagatgctttgaagattaaaagaatggagcctatttctcctgaattcatcaaggaaaaattcagaaatgatcatttaaaagttttcactaatgctgaagatcttcatgcctactggaatacattagataaaacggatggtgtttatttaatgatgagttccggaaactttggcggattagatttaacaaaataactcaataaaaaagcttcagaaatatgatctgaagcttttttattgatgtttgtttatcttttttcacactggctgattaaatgtttcagaatctcttctgtagaacgttcactatactgatgaatggattgtccgacccagattcctacaaactccggattttgcagtgattttgctgctttgcgcaacgcattggtgagtttgttctgataaggatacggtaaaatatattccgagttttcaacggtttctataaatttattttttactcccctggcatatctcccggagaagctcttcgttagaacaatttcttcttctcttacttttttcaatctttctttttcaaatggcagtaaggcactttcctgagaagctagtagaaggttaccaacctgaaagccctgtgctcctaaatctttaacagcctgcaatgttcttgagccatagattcctcctgcatagatcaaaggaacatttacctgatcatatatctgcgacaataaagatagacctccgatctgcggaatatcttctgcttcgaaacttcctctgtgaccgccggcttctattccctgaacacaaatgatatcaataccggatttttcaagcattaaagcttcatttacagaagtacatgtcccgataagggttactccgttttcttttaatttctgaatactctgatcatcaagatttccaaatgtaaaactcagaatcttacatccttcctgaataatggcatccacctgttcatgataactgttaataccgatcgcagcaaggtccggaagctgtacttctatattattttctctggccagctgttctataaactgcctggttttactatatttttcttttaaggcatctgtcactgcaggaatgtaatggacaaaaatattggcagcaaaaggcttatctgtcagtttttttgtctctctgatcaactcaacagattgatctgcagaaagatcagccaatgccaatgatcccagacagtctgcctgagccgctgcagcagtcatttgtaccgtgctgactccaaacatcggagcctgaattacaggatattttattcccaacttgttactgattgtatccggccaaaacataagaattattttaattaaaaggtacaaaaaaataggaacagctcattttcaacaggatatgacattcctcatcctgaatgaaaatacaattcccacaggtttcacaaaaaacacagattgtaatctgtgaaatagtgaaagctgtgggaatattcttaatttccggtttttattatatatccgctacagaatttagcatcttttgttcccacgcaggatctttcggatcaaagaataatctttttcccgtatctaagctacgaacaacattcatttcatcttctgtaagttcaaaatcaaatacattaaagttttcctcaattcttgacggggtcacagattttggaatcactacaaacccttcctgcagatgccatctcagaatgacctgtgctacggttttaccatatttttcagcaattgctttcagatcaggattgcttaaaagattcgcattaccatttccaagcgggctccatggctgtgttataatattgttttccctgtcatatacctgcagttctttttgctggaatacaggatgcagttcaatctggttgattaccggtaaaactgttgaatttgctttcaattcttccagtttctcaactgtaaaattacatactcctatagctttgattttcccctcctgatagagttcttccaaagctttccacgttcccagaaaatctccataaggccaatggataagatacatatcaagataatccatctgtaatctgtctaatgttctctgaaaagctcttttcgctttttcatatccgtgatcctgaacccagacttttgatgtaataaacagttcatccctgtctactccgctattttttaccgcagcacctactgccgtttcattctggtaaatagcagcagtatcaatcattctgtatcctgtctgaatagctttgatgactgcattttcacattctttcagatcatccatctgccatactccaaagcctaaagccggaatatccactccattatttaaagttaccacaggctgtcctggataggttttcttttgcataagtctttattttaatgattaatataaagtgataaacaaatttgcaataaaaaattgaaaatccggcctaccatttttactgttttatgttaatagactgctcttgtattgctttttttaaactaccccgtctttttgctttgcaaaaatccaccccttcaaggaaggggaatgagtagtcgataaaaccaactctctacacttctaacttccttcttccatcttccagcctcaaattttctctcctgtcggcatttctcctcaattttctctatttttgttcaaattaaaaatcatgtcacaacatatcagactggctcatgcagaagattatccaagaattatggaaatatgggaatcagccgtaaaggcaacccacaattttcttgcagaagaagacttcaactattttaaagaggtaattccaagggattatcttcctaaccttgatgtttatttaattactgaagatcatgaagctaaaggttttgcatccgtggcagaaggcaacctggaaatgctttttattcataatgatacgcgtggaaaaggctacggaaaaaagctttatcagtttatgaaagagaaaaccggattgaccaaagtagatgttaatgagcagaatcctcaggcaattggtttttacgaaaaaatgggtttcaaaaaaatcggaagatcagaaaaagatagttccggaaaggattatccgcttattcatatgagtttataaatggaagattttatttttcatcaattaagttccgattcggaaataccttatcaactcttattattggccgatgaaaccaaagaagccattgatcagtatatttttaaatctgacatctatcttttacataatggcatagaagatattgctgtaatggcattatataaaatcaatgaggccgaactggaaataaaaaatgttgctgtaattgaaagctacagaagcaaaggaatcggaagtatcctgatgaacaaggccaaggaaattgccggagaaaatcattataaaacactgatcgttggaacgtcggataccggcttccaacagatcagattttatgagaaaaacggtttcaaaaaaaccggaatccggaaagatttctttattgaaaactacccgtcacccatttttgaaaacggtttacagatgcgggatatggttttacttacccattacctgtcggaataagcctttaatatgttctatttcggcctgatagttcgtttttttacggcatccgaaatacagtgtattttccagctttttctttccttcccagatcattttcacgtcaccgccttcaatgtcatttttacatagaaaatcaggaacgacagctaatcctgttcctcctttcagacatcggatgattgaattcagattgggaacgatataattgggccggaaattcggtttatgaccaaaatttaaggtccagaactggaaaaggtgttccatatctcccgtagttccgtaccatttttcgttcttcagccactcctctatctgttctgcatcttttgtttttaaaactttactgaaagcggcagtatctacatctttccctccaaccagaatgatctgctcggaagagaaggcttcatgctctatattgggggaagaaccttttttaggagtaatgattagatccagaattcctttatccagctgatccagcatttcaggatattctccaaaactgatgatcagattgaaaggcagtgatgaaacatattgttccagcgtagtctgaaaagtctcaaaacacattcccacactgattgtaggcgtaagcttttctgtagacttctgaaaatttttctctacatcttccagtttggtaagaggctcagcaacggcattgaacagcaccttccctctttctgtcggaatcatttttctaccggttctgtcaaacagtttatagcctacataagcttccaaagaacttaaatgcaggcttactcccggctgtgagatgaataaggcatctgctgcacctgtcaatgtcccggttttatatatcgctttaaaagtacgataccattctaagttaaccatgacttaattattaatattctgatgcaaatttacaaaataattataatattgatacattttcattttctagaaacgctgcataataatccggaattccgctttcccttatctggcgggcagtttcctcaatcggataagataactgtacaatttcaggggtaatcttttcttcatccaaagtgagcaccagataagaagccagtctgttttcttctttggaacgtcctacagatccacaattgacagcccaagagttattttcaaattgttttttaaatgataaatgagtgtgtcccatcacaataaggtcagcgtccgcattcttcagcatagatgtaaaaatctcatcattctcggactcatacagataggtatcgttactttcaaggcttgaatgaaccaattggatattccagtgttttttacctgttttatagtttaattttaaatgaaaaggaaggtcagcgagaaattttttattctgttttgtaatatgctttttagaatggtctattgcaatgaaccgggcttcagtttcttcttccgaatgctttgaaagaggaatgacgggaatatcaaaagcaattctttcatcatgatttcccatcagacagggaatgttcaggcttctgcttttttcaatcacttcatttccccaaggtgcaaaatctacaaggtctccaagacagaatttctggctgattcctctctcttcaatatccttcaacaccacttctagtgcaggaagatttccgtgcacatcgctaaaaacagctatctgtatcattgtccttcaatttgttaacaaatttacctgtcacaacataattccggtttagaaatgatatgatattttaccatgaaatgagaaaaagtaaattgccaatcgtcaatttttgctacgcaaagtcaatagtgaataattaactgctgattagaaatacctgtacatacaaacaaatcggctacactcaatccccaaccacacatcccgaacctataaaaaattcacaagcaaagcgaattgacttttcaccattcacatacaaaaccttaaattttgaacccaagaccttgaaccctataaattataattttaataatactttactataaattatattatttttattatacaatcgtccatcctaactttgcagagtaaaatttaaacaatcataaaagaaatgaaaaaagtactaatcatcaacggaggacagaatttcggacattccggaggaaaatataatcaaacgatcgcagaaaatacattggcagttcttaaagaatttgacaacgtagaagtaaagatcaccaatgtaagcgaaaattatgacaaacatgaagaagttcagaagtttgtatgggcagattacattatttaccacactccgatctggtggttccagcttccgaacggattgaaaaaatatatcgatgaagtgttcaccgcaggtcatgcaaaaggaatttatatgagtgacggcagaaaagctgagaatcctgaaatcaactatggaacaggaggaatgcttggtggcagaaaatatatgctgactacaagctggaatgctcctgcaaccgctttcacacttcccggagaattctttaatgaaaaaagtgtggacgaaggtccgttatttgggttccacagaatgaatgcttttgtttctatggaaaaaatggaaagcttccatttccacgatgtagagaaaaacgccaatatagagcgcgatatgaagctttacagagaacatgtaagaaatgtttttgaaaaagaattaaaatctgaactggtatcatgaaaaaaatactgatcacaggtattaccggctatattggcggtagtattgcaaaaaagctccttgagaggaattatgaagtgacaggactcgtccgtaatgaatcccatgtacaggaactggaatcattgggaatcaagacggttgtcgggaacattcacaatgaagaccttatcaaaacagctgttgccggcgttgatgcagtcattcacaatgctgattctgccgatgatgcttatgctgtggataactttatcaaagctctggagggaagtcataaaacatttatttttacttcaggttctgccatttttggaggtaaagaaaatggtagaaggagtgattttgtgtatacggaagattttcctttgactccaagactggaaatggcatcaagggtacttatcaataattatgtacttcaatctgttcaaaaagatataagaagtatcgttattgttcctaccatggtgtatggagaaggcctgggaataaaaaaagacagcatccagatccctgctctgattaatttctcacagaaaaaaggacatggtgtttattttggcgaaggtgaaaatatctggtccaatttacatattgaagatttggcagatctttatgtactggccttggaaaaagcaaaagaaggttccatttattatgcagaaaacggagcctcatctttaaaaaacattgcggaaatcatcagtaaaaaatatcatctggaacccgccagatctttaagcatacaggatgctgttgacaatttcgggcctgcaggcggctatttcggttttgcatccaacagcatatgcagcgcagataaagccagaacagaactggggtggaaacccgtctataactcaattgaaaattttatttaattatgaaaatttatcttacagcgattataaagtctaaagaagaacatcaggcagaagtatttgaagttcttcagaatatggtaaaagaaacaagaaaagaagaggcttgtgaactttacagccttcaccagggaattgaagacaaaaatgagtttgttttctacgaaatctggaaaagcgaagaaggattagcccaacataatcagcagttttacatcaaggctttcggagctttggttgaagaaaagcttcaggagaaaccacagatttatactacccatatcatttaatcatgaaaaaattagcgtttttaatgcttgcaatccttacaataggatttgtacatgcacaaactaaaaaatcaaagaatatgaaaaagaaaattttatttgtcgtaaccagccatgataaaaaaggcagtaccggcgaagatacaggatattatctgggcgaagtctctcacccatgggaagttctacacaaagcaggatatgaaattgactttgtaagtcctaaaggcggaactcctccggtagatggtttcgatttgaaagatccggtcaacaaagaattctgggagaacaaggaatataaaaacaaaattgaccattctatgacgccgtcacaggtcgatcctaaggaatattcaaccattttttatgccggagggcacggtgcgatgtgggattttgcagataatcaggaactggcagacattgcttccaaaatctatgaaaacggcggtattgtagccggagtatgtcatggtcccgcaggtttggtgaatatcaaactggataatggaaaatatcttgtagacggcaagaaaatcaacgcttttaccaatgaagaggagtctgaagtaaaattaacgaatgttgttcctttcttattggaagataagctgaaagaaagaggagcaaaatttgaaaaatcagggctttggcagaatcatgtggtaacggatcagagagtgatcacaggacagaatccacaatctgcaaagagtgttggagaagcaattttaaaggaattaaataacaaataatttttaaccacaaaagtcacaaaagtttcagacacttaaataaaaagaagtttctaatcagaatacagagaagagtatttaaagtctttttatatcgaaaagttcttaaaagtgtcaacattgaaacggcgagaattcccctccagtggaggggtggcgaaaattcaaagaatttttgacggggtggtttacacataacaattaaaacaaaatggaatacagaaaattaggaaacactgatttagaattatcaacaatcacacacggagcatttgcaatcggtggaaatatgtggggcggtaatgaaaaacaggattctatcaactctattcacgcatcattggatcatggcgttacttctatcgatactgcaccattttatggtttcggactaagtgaagaaatgatcggggaagccatcaaaggtaaagaccgttcaaaaatccagcttttgacaaaattcggattggtatgggacggaagcaataatggcaaaggagaatttttctttgatgctgaagacgaaggaaaaactctaccggtgtacaaattagcttctaaagaaaatatcatcaaagaagttgaagaaagtttaaaaagattagggacagattatatcgaccttttacagcttcactggccggacagcactacgccaatctgcgaaactatggaagctatggaactattgatccagcagggaaaaatccgtgctgcaggggttagcaattacagcgtggctcaaatggaagaagctaacagaacgttaaagcttgccagcaatcaggtttcttacagtatgctgaaccgtgctattgaaaatgatattgttccttattctttggaaaacaattcaggaattatcgtgtacagtccgatggaaagaggtcttttaaccggtaaatattttaaggaaacacaattgaaagataacgaccacagaaacggatatttctctcagtttgatttgaataaagtgaaaactttcttagaaaaaatagaacctattgcacaggaaaaaggagccagcctttctcagctggtactaagatggacaactttacaaccagccattaccgttgtattggcgggagcaagaaatgcacagcaggctattgaaaatgcaaaagcaatgtctattgacctttcacaggaagaactgaagtttatcaattcagctttgaacgagatatagcattataaagctggaaggaggctggaagaaagaagttattgatgtcggataaccaatagattggtttacgattgaacttcaactgtcattccgacgaaggaggaatctctttgttacatgcagaaaagtgcatagaaaccacctaattatcaatacactaatagaacttcctcttccagcttcccttcttaaacctcaatccttataaaaatgaaaaataatctgatcaaagtattcgggttagcaacactattgactataaacagtattgcattaaatgctcagaccctcgttaatcccgaagaccaatcatggtatccttctacttatggtgcacaggatgagatcggagctgccaatttattgacacctgaagttgtaaaacaggcattagggctcgtgaaacaaggtaaaacgctggcgcttgcggttccgattgataaaaatcttcctgctttcagacacagaagttttaatttatacaatattcaacccggagaacagggcggaaaaagcataggaccaaataaattcaccttcaatgatgaactggtcaacggatggaccggcgtgggaacccagcttaacggaatcgggcacatcggaattgataacacctactataacggaaataaagcaacagactttgtaaccgtagaaggtgtcaagaaactgggcgttgaaaaagtgccaccttttgtaacccgtggtgtagtgcttgatatgactgctcattatggaaaaccaattgtgccgggaggaacagaatttacagtagaagacattaaatccgttttaaagaaacaaggaattactctgagaaaaggtgatattgttcttttcaacaccggatggcttgaattgattggtaaaaacaacccgcaattcctggaaactgaaccgggaatcggaatggatgccgcaaaatggcttgccgatcagggaatcgtagcttttggcggtgatacctgggcttctgaagtatatcctaacccaaaaagtaaagaagaattccctatcaaccagtttatgctggccaaaaaaggaatttataacctggaactgatcgacagccgtccgttggtgaagcaaaaaatctgggaatttttgttcgtgctgggacagcctttatatgtaggctctactcaggtgaatgtaaatcctgtggcaatttattaaattatagcttcccaaatttagaagaacagagagacaacgtaattgcgttaaaaaataaaattaaccttaaaatttatttttagaattaatacccaaaccaggttacattgtcactttgcttcttatactaaaacggcctttcacatttgaaaggccgtttttataaagtaaatatcagtaaattatgcagtcttcattgacttacatcttccatctccccgctcccagacttcactattttgcaatcggaagatgagtacttactgcaattctgttccaggcattgatggttatgatcgccataatgatctgggcaatctggttatcatcaaagaaagattttgctttctgataagtttcttcagttaaccccttgtcactgatcagagtaatttcttctgtcatggccagcaatgcctgctcttcctcagtgaaaaactctttagcttctgtccatccgttcagaataaagatcctttggggattttctccatatttgatagcatcttttgtatgcatatccaggcagaaagcacatttattgatctgtgaagctctgattttaattaattctttctgaataggagttaaagaaatagtctgtaaatacccttccaatcccatcatcgctttgtaagctgccgaatctactgttgcaatattcaatcttgcgctcataatattattattttttggttaattgatctatacttaaagaataatgttgttgtaccgccagtaaaagtgcagcagcacttcccacccatacagagtaattcagcggggcttttggtcctgatgcaatggtcatggatactgcaaaaatcagcagcagaatactgcttccatacgctgcaattctggttttaaatccaagaattagcatcaaagggaaaagaatttccaaaaatgtagcagcatatgctgaaaatgtactcagagattccggaagaaaaaatgtcagctgtcttgtatattctttaaagctttccatatttccccatgaagaattttctttgctccacaaccctaaccggtctgcaacagcagaaagcatcgtcacggcaagagccagccttaaatagagttgcggaaattgattttttgtatctgtcattgcattagcttttaatcacatgacaaatttccggcttatgatccgtaaaaaacttaaactggtttaagaacgtagttttgctttaatttcacttaaatactccggtgtaaatccgagaaacgaagcaacaaggtattggggaatcctttgaataaaccatgggtacatcgtgctgaaatggatatacagttcttctcttgaaaattcagacaaataacggagttttctttctgaagcggcgtaagccctttgataaataatccggaaataacgctccattacaggatgttttgcaaacaataattcctgatttttaaaatcaatcaccaaaacagtagaatgctccaccgactgaatattaaaatccgtctgctgctgcctttcatacgaaaatgtatccgtaatccaccagttttcaatggcaaactgagtggtattctccactcctttttcattgataaagaatttcctcagacagccctttaccacaaaaaacatattccggcatatctctccctcaagcatcagattctgcttcttctttacctccgtcaccttgaaaaatgatacaatagaagtatactcctcatcggttacggtaatgaatttatttaaatgtgctttgaatggatccattgtaagaattaatactcaaacttaactttatttttttagttttacaatgagaaaaatattgaatcatggaaatcgttgctaaaattctgatcactgtcgttgcactggaacacctttatatcctttggatggaaatgtttgcctgggaaactaaaggaaaagaagtttttaaagcagctttgcctgcggagatgtttaaacctacgaaaggacttgctgccaatcagggactttacaatggttttctggctgcaggactgatatggtcatttttgattaaagatccgcaatggcagaccaatgtggcattattctttttaggatgtgtagctgtggccggaatctatggggccatttctgccactaaaaaaatatttttcgttcaggcattacccgccattcttgcgattattgccgttttactgaaataacttgacaagctatcgtagaaatttctttccaatcaacattctcttaactttcataataagagaaaaatcatcatgaaaatactatttcaaaaccatactgaaaatcaacaacttatccacacaaaaatccatttaatataaattttgtaaatttgccccgtcataaaaaactgatatacagttttttgatactggcaagcattttgatgaaatgtagccattcaagttgttcagtacacatatctgtaattatctcatcagtaatttaattgtagactctatgtaaaaagattaatttcttttgcataatacactctttttctagagtataatctattgaaatatttaaaataaacataagactatcaggtctttatgctgttatttttttgcttgaagcttttatcactaaaggccaggcaaattattttatcctatcgtaatcagcagaacaacgaaagctaaatgtatatactaaactggtgtacagtttttatatcaaattattaattgaaaaaattctgaatatggaaaaaaatgaaaacacccgaaaagtaaaacttaaggttgaagacctgaccatcatctttggtaaaaacaaagaaaaagcacaggaacttttagacaaaggtttttccaaaaaggaaattcttgaaaaaacaggctgcaccataggaatcaacaaagccagttttgaaatttatgaaggggaattctttgtcatcatgggactgtcaggaagtggaaaatctactttactgcgttgtcttaacagactgaatgagcctacttccggaaaagtatacatcaacaacgatgatattaccagtaaaaagaacaaggaacttttagaagtaaggagaacggaaatgagtatggtatttcagaaattcggattgctgcctcatcataccattttagacaatgcaggtttcgggctggaaatcagaggagaaagcaaagcttcccgggacaaaaaagcacagaaagcactggatattgtaggattaacaggttttgaaaaccaatatccttcgcaactttcaggaggaatgcagcagagagtaggattggcaagagctttggccaatgatcccgaagtattgttgatggacgaagctttctcagcacttgacccattgataaaatctgaaatgcaggatcagatgcttgaactgcagaataccttacagaaaaccatcgtcttcattacccatgatctggacgaagccattaaaatcggagaccgcatcgtcatcatgaaagatggtgtcatagaacagataggaacagcggaagaaattttaaccaacccagcaagcgactatgtaaaagcgttcgtagaaaaagtagaccgtaaaaccattattacagcaagatctttaatgtttgataaagctacggtagtccgtttcagaaaagatggtcctgagggtgctttacgaaaaatgagagccaccgggctggaaaacttacctgttgtagattttcagaataaattccttggatttgttacccttaacgatgtcgtacgcattgccagaaagaaagaaccaacggtagaatccattatcaacagtaatgttccttcggtgtaccctgaagtgactgttgaagaaatgttaccactgatctcagagaataaatcgtccattgccgtgattgatgaagacaataaatttttaggtcttgtgacccagttatctctggtcatagaagccacaaagtttaacgaagaagaaattattgaattaaaagaaatcgcaaacaaccaataagatgaataaaactatagatataggtcaatatgtagaaactgcaatcaattggctcacagaaaatggaaaacctgtattcgatgtcataaaacacttaggaaatgcctctatcatggggattgaatgggtattaacaaacacacctttttatgtaatcattctcttctttacccttctggcactgtggaaggccggaaaagctatcgctgtggtaactgcagccggactaagcttaatatttttaatgggattatggaaagaaaccatggaaacgctggcactgatctttgtttctaccattaccgcccttatcctttctatccctttgggaattctggctgctaaaagcaaaatagcagacaaaatcatccgtcctttactggatttgatgcagaccatgcccgcatttgtctacctgattccggctgtactttttttcagtatcggaaaagtacctggtgcttttgccaccatcatttttgcgatgccgcctgcagtaaggttaacggcattgggaattgaggctgttccaaaagatattgtagaagcagcaagagcttttggagctaccggccgtcagattttgtttaaagtagagcttcctttagcgatgaaaacgattttaacagggatcaatcaaacgatattattatccttatccatggtcgtgatcgcaggaatgattgctgcaggcggtttgggagaaaaagtactggaaggaattaataatctggatatcggtttaggatttgaaagtggattatccgttgtgattttagccattatcctcgaccgtattactcagggatttgtaaagaaaaagcaataagatgaaacaattaaaatatctgtttttacccgttttaatgttactatttacagcattaagttcgtgtgaaaatataaaaaactctaaatatatcaccatcggaatggtagatggctgggcagaagatgttgcaatgacacaccttgctaaagccattctggatgagcagggatatcacgttattattcaaaaagcctctacggatatgatcctggcttcgatgaataatgaagatacagaccttttcatgggaatatggcttccttacactcacgcaaaaaagctcgctaaatttcccggattaacttatcttggaaccaattacgacaacggccgtataggattggtggttccggattacgttcctgtgaactcaattgaagaacttaatcaacataaagatcaattcaatcacagaattataggaatcgaaaaaggagccggattaaccaccggaacagataaagcaattatagattataaactggattatcagcagatcaactcctctaccattgccatgatcaccgagttacagaatgccatacagcgaaaagaatggattgtggtaaccggatggcagcctcactggatgtttggtaagatgaagcttaagtttcttgatgatcccaaaaagatttatggtgaagccgaacagattaaaacctattccaggaaaagcttttcaaaagatcatccggagctggtcagattcttttcaaaacttcattttgatgatgagaacatgtctgatcttttaatgaaaatggaacagagtaaaaacaaagaagccacggccaaagaatggttgaaagatcacccggaactgatacagtcgtggttaaacaaaaattaataaacaatttggtattatttaaaatcctcaactctataagagcctgaggatttttttgatttattatgcagaagaactcattgattctttgattttctcacgatgaaggattccccaattgactaatgtttctgttaccggaaatacagattttccatattctgtgacagcataggttaccgtaataggttttgtatcctgaatcgttcttgtgatcaggagattggtttccagctcttttaattctttgctcagcatttttgcagaaatcccttcaatactgcgttccagctttttaaaatgaatcatctgatccggtctgttcgtcagataccgtaaaatcatcagtttccattttcctcccaaaacatccagactgtcacgcattgcaaacagttcttctgtacagcttgcttctctttcgataccgttttcaataatttttgccataatagtttcatgaaggtaactagttaccattggttaactagtagcaaatataaactattccctctttacatttgtgtatcaaattaacaataatgaaagcagttattttaaataagaacggaacactggaagacggatttactgaccagccgcaacctaaaagtaatgaagtattaatacggattaaagcaagtggtttcaatcccattgattaccagatgctggaaaatgaactggaaaggaaactcatcagttctccgatattaggaagagaattatccggaattgtagtagatataggttcagaagttacagaattcgatattggagacgaagtctattgtggaagcggttctatgggaagtaacggtacttatgcagattacataagcgttcccgaggccattgtttcttttaaaccaaacaatatttcgtttgagcaggcggccaccattccttcagcagggcttacttctttacagatctttaaccgtttgaaattaaatccggaaaatacaatccttgttacaggtgctgccggaggtgttggttcattcctgattaaacttttattagcttataatatcaggaagatcacgacaaccgctggcagtgaagaaaacaggcagatgcttcttaatttaggattaaaaagtcatcaaatcatcaattataaagaagaaaatcttattggaaatatcctgaaagccaataatgacgagccatttgaatatggaattgatctcgtaggaaattacatgtcagaagtaacggcagaagttttaaaaatcaacggtatgtatgtagatgttactgctttggtaacaaaagatgctcatgagacattgttcaacaaaggaactttaatcatgaatatctccaattacgcgtatggtatgactaaaaaatacgactattataaaaacagtttactggaaataaaaagacttattgaaaatggaaccattcttcctccccagcataaaatagttggagatctttctttggaaactgttatgaaagcacattctatgttaaaaaataaccagacccaaggtcataaacttatcatgaaaaatgatgaataaaataccaagacgtatcgtaacaggaataaaagacggaaaatctgttattgtagaagatcagcaggttgaaaacgctgtggaacattttccgggacttatcatttcagatgtatggaatactcagacaatgccagccagcttagagtttgaaaccagaattcccaatacaggatttccgaaaacacctaaaaacggcacttattttaggtatgtagtagttcctccggataaagatttaggcgtagaatggaaaaaaaacgaatctcatccgatgatgcaccagactcctacgttggattatatcattatcctttccggtgaactgtatctgatcatggaagaaggtgaaacgcttttgaaaccgggcgacattatcatccaaagaggaacgaatcatgcatggagcaaccgttctgacgagccttgcattcagctggcgattttgattgatgcaaaaatttaatagtaaagaatttccacagatcacacaaataccacagataaaaattcatgtagatgcagcaaattttacagagatctgcataatctgtgggaaataaaaaagatttttaaagttgggaaaacgcaaaggcgcaaagaaaaataaacaataggttgttttaaggcgcaagaaaatcaaagattttcagcaaagattaatccatatagtattaggaacatacaattttatcacagataaaatccttgcgccttacagcataataaaaaaaaaattgcgcctttgcgttttccaacaaaaacctcttaacttacaaaccagaaaactccttcagtttctgcttcattttttcaggcgtcatctgcccttcctgataatacaccagattctgatgctgatcaagaaatatccacaaaggataaacaggctgatttttattctttgataatgccagtgccaattcatgaattccggaatttccattctgcagatattcaaatgtctgattttgaaaatgaatgatctccttcgttttctctgtctcaaagttgataaaataaaaatgatcattgatcatactcaccagctctttatctttattcaaacgataagcctcaatcttacagactgcacaccaatctgtatacagatgaatcaccaccggctttggattttctttctgctgagtctcaaggtcagaaaaagtgcccgtcttcatctgagacagataaaaacagggcactaacattaaaaataaagctaattttttcatttcaaagtatattttactccgaggaaacctctgattccctgcatgggtgcatagccatatgccgtatcaaaagtataatgattaggattattgatgggatcatcaacatgtttatcaaatgggtcaaatggtctcatcaaaggatctttaggtctgaaattgaacaggtttttcattccgcaatacacctcaaatcctgatttaaagctcttagacacctgaatattggccagagaataaaacggtgaatattcagggcggtagtcattcaccagaacaggaagcctcatcggtccgtaaaactgtcccgtaaagtctaccgtcagattattcgcaaacttataagtcaggttataagtaccactccattttggggcatgcagctgttgtgttttttgattttcattatcaaatttctgatacacatccagatatgtgactccaagattaatacttaggggaaattgaaagctaaaatctacattcaaagaagctcctctggaaattccatatccgtgaagattatcataaataattttattcggatcagaatcaaaatcccctacaattttattactgaaatacgtataaaatgccgaagcatcaagatttaccatcctgctacctaccggaattttccagatataattcaggttaccgttaacagatctttccggcttcaggtctgattttaccaccacttcccttgaaccggttaatgcagcgtgatcttccgtaaataaattcaccactctgaaacctgttccaaaattgaaacgtaaagtatgatacggattaggattgaatttccatgcaaacctcggcgaatgtacagaatggtgaactttatcataatcatatctgtatccaagcagcaaagtatttttatcattgatctcccactgatcctggataaaggcaccccagatcggggatttcatcggtgcattggtgatcccgtctgcagctaatgttcccggagtattatcatcataaaatgttcttttaaatgtaagtccggctgtaatatcatgcttcccgaagcttctgtcccaatacgtctgtacaaaagctactttctgtgtagcattgaatggattggatccataaaatgaattctggtcgtgataattataagaaaactgagtcacaatatgctctttcatgggccattcgtataatccgaaaatctctgccctgttggtataaatactttctccgtatacttcatcactgccacggaaagatttattccactgcatttcacctccaaaacggtcttcatacagatacctcatggcaaaacttgcctgtctgttttcctttcttttaaaattccatttgttaaaaaccgaaatcctgctttgcagcgtagcatccgtaaaattatctttattctgatctattctttcctgaaaactgaaataatttaaacttaataatgaagcggccttttttccaacattgaactttgtggaaagatccaggttattttcactccagctactggtcatcatatcaacactcagtttaggagcggtcagtgcatttttggtgataatattgatcactcctcccatggcttcagaaccataaatagaagatgccggaccttttactacttctattctatctaccaagctattagggattccgcttaatccgtatacggtggaaagtgaactcacaatcggcattccgtcaatcaggatcatcgtgtatggcccttccagtccgttgatgtgaatatctcctgtattacatacagaacagttcagctgaggttttactccattcaccatggcaatggcctcaaaaatacttggggtaggatttttctgaaaaaatttctgactgtagatctctaccgccacaggacttttggatctgctcattggttttatggttcctgtaaccactacatcctcaatgttacttgttttgtattccctcttcataacgctggcagaatcctgacttgtaatctgctgtaaactcaaactgtccgtctcctgtgcaaaacaataggttgataaaaaagtaatagaaaataatattcgcttcatgaaattaaaattgttagacaaatctaacaattatttttcaaatacaaaactttgcataaaaatatagattgagtcaattcatgaaaaatgattaaatttgagaaactacatacgaaagtaaaatgagatatcatcaatcgggaaatatcccaccaaaaaggcatacgatctttaagtctcctgaagataaattttactatgaacagcttttcggtacagaaggcttccatggtatttcttctctgttatatcatatccaccgccctacacagatcaaatctatcggtgagccgaaagacgtcactcctaagatcgctgtggaaaaaaacattactcccagaatgtttaagggaatgaatgtcactcctgaaaacgattttctggacagccgaaaaatccttttgatgaacaacgacctgaaaatgggattggcaaaaccaagaaattcgatggattatttctacaaaaatgcggaatgtgatgagcttttgtacgttcataacggagccggaattttaaaaacatttgtaggagaccttgaattcgtaaccggcgattatcttattattccgagaggaaccatttatcaggtagaactaaaatctgatgatactgtatttttcgtactggaaagtcactctcctatttatactccgaaaagatacagaaatgaatttgggcagcttctggaacattctccattctgtgagagagacatgattgctcctactttcaaagaacccgttgacgaaaaaggagaattcctgattaaagtaaaaaaagaaaatcagattacagatttcatctatgcaacacacccgtttgatgtggtgggctgggatggttatttctatccttataaattcaatattaaaaactttgagccgattaccggaagaattcaccaaccgccaccggttcaccagaattttgaaggacataatttcgtagtatgttcattctgcgcaagaatgtatgactaccatccacaggcaattcctgctccttataaccactccaatattgattctgatgaggtattgttctacacagaaggtgacttcatgagccgtaatcatattgatttgatggatttcacacttcaccccggaggaattgtacatggacctcacccaggtgctatggaaagaagtatcggtaaaaaattcacagaagaatatgctgtaatggtagaccctttccgccctttaaaaattacagaagaagctttaaaagtggaagatccttcttataaaacttcctggctggaataaatctcaaaaagtattactgactacatacaaaagacgctttaaatcctttatttaaagcgtcttttttcgtaaatttgtgaggtatggttaaacatattgaccatcattatttttcatgacgcatcctaagtaatggtggtttaaaacaaaatcaatattacatgttagaaagaatcagattagaaagtctacgcgacaaagtaaccaccgcggaaaatgcagtaaaaattatcaaagacggtatgaccattgggtccagcggctttacaaaggcaggtgacagcaaagccattttgccggcactggctgaaagaggaaaaaccgaagaccttaaagtcactttaatgaccggagcttcactgggccacggtaccgatggaaaactggcagaagccaacgtcctgaaaaaaagaatgcccttccaggtagatcctattctaagaaacaaaatcaacaatggtgaaattctcttcattgaccagcatttaagcgaaagtgcagagcttcttcacactaaaaaccttcagagcattgatgtcgccattattgaggctgcttatattgaaagagacggaagtattgttcctaccacttctgtgggaaattcggtgacctttgcggctttggctaaaaaagtcatcattgaaatcaataccgaagttcctgaagaagtctatggaatccatgacatttaccaggcagaagattatccttacagaaatgttatcccaattgtagctccttggaataaaatcggaagaaaaagcattcccgttgaccccgataaaattgaagccattgtttttactaaccgcaaagacagtccggcagatattgcagaacgggacgaaaaaacaacagccattgctaaacaccttcttgcattctttgaaaatgaagttcttttgggtcgccttacagaccgcttacttcctcttcaggccggtatcggtaaagtagccaatgctgttctgacaggtttcaaagacagtaatttttatgatctcaccatgttttccgaggtgctgcaggacagtacttttgatctgatcgattccggtaagctaagctttgcatcagcatcctccattaccgtttctcaggaatgttatgaaagagttttaggaaacctttcaaaatataaagacaaattcgttttaagacctcagaatatttccaatacacccggactgatccgaagattgggagtgattgccatcaatacagctattgaattcgatatttatggaaatgtaaactccactcatatcggaggaacaaaaattatgaatggaatcggaggttccggagactttgcaagaaacgcctatctgagtatttttgtgactcaggcagcttcaaaaggaaacaatatttcccatgttcttcctatggtttcacataccgatcatacagaacacgatgtggatattctggtaacagatgtcggattggcagatttaagaggactggcaccaagagaaagagcacagaagattatagacaattgtgttcatccggattataaagaagaattgcaatcttacttcaacagagcctgcgaaaaaggaggtcatactcctcatttattacaggaagccttcagctggcatttacgatttgctgaaacaggaagtatgaaacagaaaacagctgtagaagctgctaattaaatattttcaccaaaagaataaataagaaaaaaggaccggatgtcaatgcatcctgtcctttttttatacaatattcctgcaagttttgcatgacaaaagtcttttcaatatctttaaaatatttgaaaagtatattgttataaagattatctttgaaagaagagctgtattttttatgagatttaaaatacgttgaatacccttttaaaaagacaaaatatgaataattacatcagtgcagaagaagcaatatatacgataaaaagtggaaaccgtgtattctttcacggcagtgcatgtaccccgaactacctgattgatgagctcgcaagacagtctaaccgattgcagaatgtggaaatggtttccattacccagcagggaaatgtagaaattgcaaaaccacaatacaaagacagttttttcatcaattctttatttgtttccacccctgtgcgtgatgctgtaaattctgacagaggtgactttgttccggtatttttaagtgaaattcctattttgttcagaaaaaatattttaccccttgacgtggccctggtaaccgtttcacctccggacagacatggtttctgcacattgggaacttctgtagatatcgccagagcagcagtagatacggcaaaaatcattgtggccattgttaatccaagaatgccgagaacccatggagatgggatgctccacatcagcagaatccacaaactggtttggcatgaagaggaacttccaacggtagactatggctcaaaagttggccctgaagaaatgcttgttggaaagaatgttgctgaacttattgaagacagatccacccttcagatgggtatcgggaccattcctgatgcggttctgaaatgccttaccaatcacaaagacctcggaattcatacagaaatgctgagcgatggtgttattgatttaattcagaatgatgtgatcaataacaaatataaagggtacaacgataataaaaccataacaagcttctgcttcggaaccagaaaactctatgattatgtggatgataataccgtttttgctttcagggatgtaagtgaagtcaatttcccgatcaatatcatgagaaacaaaaagatggtagccatcaattctgctattgaaatagaccttacaggacaggtttgtgccgactctatcggaacacttcagtacagcgggatcggaggacaaatggactttatgcgtggtgccgctttaagtgatgacggaaagcccatcattgccattacggccagaaccaaaaagggagtttcaagaattgttcctttccttaaacagggagctggcgtagtaacaacaagaggtcacattcattacgtcgttactgaatacggaactgcctatctgtacggaaaaaatcttcgccagagagcacaggagcttatcagcattgctcatcctggtgacagagagatgctggagagagcggcctttgaaagatttaaacattgagaatcaaatcataaagcataaaaaactgtttgtgaaactaattatttaaaacaaattctgaactgtacatccctaaaacataaaaaaacattaatattttggcagtatatttgataaaattcattcaaaaacaaggaaattgaaaactatatataattcgatacgggaggaagttataaagcattcgaaagtaaggaattctgttttggggaatgtgaatgaatggaaaagaagccattatattattctttctgaaattattaaagaagaactttccggagctgaagaactgaaaggaggaaaaaaatttgaaatcggaaataccatttcccatgttaccctccagcgattctttgagaatgattaccaggataaaacccacagtgatctcagattcctgaagacccttgataaaatctgtattttcttaggatacaaagatcttaacgattatattcttgccatcagatacagaaaagagaatgaagaggaaaacaatgatcagtcttatcttacgcagatggtgtatgattattgtgccaccgcttttgagttctgcaaacagtttcctgaacacaacaccaacctgtttaaagaactggtttttgatgattccccttttttagagcgggtttcacaattcagcaaagaactatgtgataaagattttcaactggtaacaaaaaataaccggtccaattatgaagtttttgatattcatatcgttaccgatgagccggataagaaaatcctggaaactcaggaattctggaatctgctgttcaaggtaggagaaaccggtgaagaacattttgtgaatcagctgagtacccagatctacttcatccggaaaataaacaatacctggaagatatgggataattacaatcccgatgcgggaatgctcaacagaaaaattgaaaccacttcataagaaagccgtagatattctctacggctttcatgtttcgaaatatttttttttcacttgtattttgtataacaaatgtaggcagacgattttaaactaattaaacttaaatatacttaagtaaactcttctttaagattatgttaaatatattcaatgaaactgcgggaatattttcgccatatctaagaattttgtaatttgcataccaataaaataaaagtaaaagagaaaatatgtcaacacttacatttgccgagaaaatagctcaagcagaaaatttcttgccgattaacggtacggattacattgagttttatgtaggaaatgcaaaacaggctgcccattattacaaaaccgctttcggttttcagtctgtagcttacgcgggtcctgaaacaggagtaagagatcgtgcatcttatgtacttcaacagggaaaaatcagattggtattaacaacaggacttaagtctgattctcctatcaacgaacacgtaaaaaaacatggtgacggagtaaaaattttggcactttgggtagatgacgcttacgcagctttcgaagaaacaactaaaagaggtggaaaaccatatttagagcctgtaacgttaaccgatgagcaaggtgaagtaagaatgtccggtatctacacctatggagaaaccgttcacatgtttgtggaaagaaaaaattataacggagctttcatgcctggctatgaaaagtgggaaagtgattataatcctgaagaagcaggcttgttatacgtagaccactgtgtgggaaatgttgactggaacagaatgatcccgacagtagaatggtatgaaaaagtaatgggatttgtaaacatcctttcttttgacgacaagcagatcaacacagaatattctgctctgatgtctaaagtaatgtcaaacggaaacggatatgcaaagttcccgatcaacgaacctgcagaaggtaaaaagaaatctcaggtagaagaatatcttgatttctatgaaggagaaggtgtacagcacattgctgtggctacaaaagacattatccacactgtaactgaacttaaaaaacgtggcgtagagttcctgtctgctccgccggaagcttattatgatatggttcctgaaagagtgggccatattgatgaagatcttaagaaacttcaggagttaggtatacttattgatcatgatgaagaaggatacttattacagatctttacgaaacctgtagaagaccgtcctactctattcttcgaaattattgaaagacatggtgcacagagttttggtgccgggaatttcaaagctttattcgaagcattggaaagagaacaggaaagaagaggtaatctttaattttacattagaaaatataagttttgtcaggatacagtattctggcaaaacttttttataaaacacagtatatgagaaaatttttaatcgggatttttcttttgggaacactagggcttaaagctcaatatggaactctgaacgaaatccttaaccgacttgaacaaagaaaaggtattaatcagcatcttgagaatgtaaatattgacaacaaaaagttcattttcattaaagacgaagctgatcatacggaaagggactttattgttatcaaagggaataatgctacgtatgtagaagttttcgatgataaggcaaccggagaaagcagttccaatgtattcaccggtgatatcatcaggaaaaaaaatattatttccttaagagcagatatgcttgaaaataaaaaaatcccaatgcctgtcacgaagactttattgctgactcagcaggataatatcctgtacctcattgatgtcaataccagagataggtggatagatgaagcatcttactcaaaaaaggcaaaataaatgttccggggaatttctccggatgatatttaatctaactaaaatctaaacttatgaaatcatttgtagactattcctcaaattcggatttttctatacataatattcctttcggagtcgctgtttttaacaaagaatatatcggatgttgtacaagaatcggagatcaggtcattgatcttgcgaccttatatgaccttggttattttgaagatattgaaggattggacgacaatgtttttgaagcgtataccatcaatgaatttattgaacttggaaaacctgttaccaatgctgttcgtaccagaattcagactttattgcaggaaggatcaattttatcaaaagatcagaaaaccatcgaagaagcattttatgatctggataaagtaaaaatgatgatgcctgtgcacatcccgaattatacggatttctacagcagtattgaacatgctaccaacgttggaaaaatgttccgcgatccggcaaacgcattattacccaactggaaacatttaccggtgggttatcatggaagagcctcctcaattgttgtttcaggaacagaaatcaaccgtccgaaaggccagatgaaacctgcagatgcagataaacctgttttcggtccatgtaagcagctggactttgaactggaaatggcattcatcatcaacaaaaatacagagatgggagaaagtatttctactaaggaggcggaagatgctatcttcggtatggttattttcaatgactggtctgcaagagatattcaatcatgggaatacgttccgctgggaccattccttgcaaaaaacttcggttcatccatttcaccatgggtcgttacccttgaagcgctggaaccattcagaaccgcttctccggtacaggatcctgaagtgttggattatttaaaatttgagggtgataaaaactacgatatcaaccttgaagtatacatccagccagaaaacggcgagcaaaacctgatctgcgaaagcaactacaaacatatgtactggaatatgacccaacaacttgcacaccacaccgtaaacggttgtaatgtagaagtaggtgacatgtatgcgagcggaactatttccggaagtgatccgaaatctttcggttctatgcttgagcttacatggagaggccaaaatcctttatcattaagcaacggagaagagagaaaattcattgaagacaatgatacggttaccatgaaagcatgggctgaaaaggatggtgtgagagtaggctttggtgaagtttcaggtaaaattattccgacactttaatttttatttaaattttaactttgcacaatactattattaaaccttataggttttgaaaacctataaggtttggtgtatgacactgctagaaatatactgttaaacaattagtattagatgtgtcatgctgagcggagtcgaagcacatttttaatatcatttgaatacttaagttaaattaagtgttaaaaccaaaaacatgaaaacagtaatcccctccgagataacctccgtacagctgcagaccattatgcagacagccgtttcaccgcgcccgattgcactggcatctactgtggacaaagacggtaacagtaacttatctccattcagtttttttaatatgttcagtacggttcctcccattctgattttttcaccttcgaggagagtacgtgacaatacaaccaaacataccctggaaaatgttcttgaagtaccggaagtggtaatcggaacagtgaattttccaattgtacaacagatttctttagcttccacagaatatgaaaccggagtcaatgagtttataaaatccggtcttacgatgaaggatgcagaccttgtacagcctaaactgattgaagaatgccctgtcaactttgaatgtaaagttttagaagtaaaaccattgggtgatcagggcggcgcaggaaatctggtgatctgtgaagttcagaaaatccatatcagagaagaatatctgaatgaagacggaaatctggatcagaaaaaactggatatggtagcccgtctgggcagcaactggtattccagaagcaatgaaaacagcctttttgaagtacctaaacctttggtaacaaaaggaattggtttcgatcttctgccggatgccataaagtatagcaaagtatttacaggaaacgaccttggaatgcttgccaacaccgaagtattacctgccaatgacttccattccgatgaaaatattcatcttgaggcccagaagttacttttggaaagtaaaattgaagaagcgtggaaattattaatcagataattgagttgcattcatgaaaaaatatattttctttatctttctattcatagcattacaatcatgctattatccggtaaggaaagattatggcatttacagtaaagcattggtgttttctaaagacaaaaaatggttgattaatgacatcagaacaggggtagactcgcaccacagagaaatgatgggtaaagaaactcttcagctatttcaaaatttaagcagtggtactgcttatgatttaaaaatggcaaaagcggggaacctcattcaaaataatattccatttgagccggaaagtgaagatcttgaggcattgaaaaacaattctgattttaattttctggtaaacatctacacaatgaaggtgcgaaacggtttagacaattccattggaacccagtatgaatataagaaaaatgaaacttttgcaatgatggatgtttatgatattacaaccatgaaaaagatatattctttaaaagcgtattcggaagtttctgtagataaagatcagaaagcaactatttttactcctacgactgaaatgatgactatgaaaaattttagaagtcttttaaaatccgtaaaaaagaatgctgttaaaaactaaagatatctattgataaccaacaaaaaaggagtgaaagtttcactcctttttttattatttggatttaagcgattctgaaacagtaatttttcctttttcagcaaaatctgttaccttaccgtttttatcaatggaaacattcaggttgtcatttttagcatcatagtaaatgcttgtggcatatcccggacagtcgtgctgcttacagcctgtcagtttgtaaattccattctctgatgcgataggaccttccacattgaaattcttcaccatttcatcgtattgggatcctgccagttttttcagtctttctgatatctccttatcttcaaagaatttaatatcatgtggatatttacctacattcttggtgatgatattatcaggagccggggcagaaggaggtggtgatgcaacagaatcgttttttggagttgagacagtgtcttgaggcatcgccgtagtaagagtatccgtagtgcttacagaagattctgttttagtctcttttttacacgaaacaacaaataatgacagcgcaaatgcgcccgcaataacttttttcataatgatattgatatggtgattaatatgttaacgtaattttaaaacctttattttaatttttctttgataaaatcaatacatttttcggttacagtattcagatctttgggtaaatctgcttccgtccatggttctttcgctccgaaagtatgattgccattttcaatcagaaacagttcggaattcgggtggagaatatgaagatgctcagcctgttttacttctacagcctcatcgtctgtcccatgaataatgagcatatgtgcttttgccatttctgtagctctttccacatcaagacggtgaatattctgctcataatcttcataaaactggtaataatgcggcatttcctgtttggtacgcccgttaaccgcataatacactccattatttttccagttttcaaaagcttctccttttggaaaccggtccagagtatcaacactggccaatgtaatcaatccgttgattctttcgtcttcaaaagttttaataatagcaatacctcctcccctgctgtgtcccatcagaacaatcttttcgtcatccacgtgaggatttttactgaagtggtcaattactactccaaggtcagaaagttctctggaataattattattcccaaaagcttcaagatctccaaagcttaacggatcatctgtagttgtcccattatgcgaaaaattaaatttgacaaagaaaaaaccggcttcagcaaatttttcagccatcaggttccaggctccccaatctttataacctttatatccgtgaacaaatattactaagggaagtttttgccctgtgttttgataaaaagcatcggcaagaaaaccttttgtttctttattttccagatatatattcttttcggtaatcagattcataacaaattttcctttccttttaagatggtaatttatgaaaaaaactctgttttccggtctttaattcattatttctttattaaaagtcaggtcaaagtttctaaaaatagcatatttttgtatcatgcagaatttaagaactgtaaccgtgatgcgttacattctgcctctgagagaaggaggatctcttcccgctctggcagaagctgatgatgatttcaaatatgtattaaagttccgtggcgccggtcacggagtaaaaatgctgatctctgaacttttaggcggaaagattaccgaagtattgggacttaaaattcctgaacttgtttttgtcaaccttgatgccgatttcggaagaacggaagctgatgaagaaatacaggatctgctcaagttttcagaaggtctgaatcttggactgcattatctttccggctctatcacctatgatccgggagtaagtgtagatccgcttctggcttcaaaaattgtatggctggatgcattcatcaccaatattgaccgtacttttaaaaatacaaatatgctgatgtggcataaagaactctggatcattgataatggtgcctcgttctacttccaccactcatggcagaattttgatgcagccgctaaaacacctttcaaatatgtgaaagaccacgtgcttcttccaaaagcaaaaatgcttgatgaagcagacaggtttgctcatgaagttctgaacgaaacgttattccgggaaattgtcaatatgattcctgaagactggttgcattggaatgatgctgatgaaacccctgaagaaatccgtgagatctattttcagtttttgaaaaccagattagaaaattctcaaatctttgtaaacgaagccaaaaatgcaagaggataaaatatatgaatatgcggtaatacgccttgtacctaaagttgaaagagaggaatttttcaatatcgggctggtgatgttttcaaaaaaggaaaaattcatcagggtagaattttatttgtgcccggacaaatttaagctgatgcacagcaagctggattacgaagatatcatccataatctggagagctttcagaaaattgcaaatggcgataaagacggcggccctattgcactgcttgatattccggaacgtttccgatggctgacagctgtaagaagcgctgtcgttcaaacctcccgcccacatccgggaaaatccaaagatctggatgctacttttggtaagctttttgaggagttagtaaaataacacatccttaaaaaatttaatatgaatttatcgataaacaacatatcaatttacaggtttttcacaaacctgttttttatttcatttttaagcttttccaatttatttttttcacaagacctgccattaaggccaactaaagctcctgctgtaaaaagcacactacttcccgaaatagcaacagtttcagaaaatattgtttacaaaaccaacagaaaaggccagcctcttgctcttgatctctatactcctaagaacaatactggtgaaaaacttccggtattgatctacgttcatggaggcggatgggtagaaggcgacaaagtggtaaatgccgataattatcttgaaacgactataaaaaaacttataggcaaacaatatgctgtgatcagtatcaactatacgcttctaagtgacagcatccatttcccattgcctttggaagatactaaagatgcggtcagatgggtcagaaaaaatgcagaaaaatatcattttgataccagcaacatcggccttttcggagcttcagcgggagctcatctttctctgatggcagcttatacaccagacaatacttatttgggtaatcctgagctttcatcctattctggtaaggtaaattatgtaattgatcattatggtcctgcagacctcaacaaacttttccacacaagattagggacaatcccggtgggaatgatcggattactgtccaaaaaaattgtcggtttacaggaaaatctggtgaaagggatttcaggatatgatatcagaaaagatcaggacagagcaatagattatcttaagacgatatccccggctaactttgtttcaggtggtgttcctactttaattgttcagggaaataatgataaaattgttcctttaagccaatctaaaaagcttcacagaaaattaaacagggctaaaatacagaattcactgatcatcgttgatggcggtgtccatggttttggtactacagacaaagactatcttgataaaataacagatcagatggttgactttattcttttacagaaaaaataatatacataaaccaatccatgctattattaatattctaaaagtcaatacaataaataacaaaaaatcaaaaatatgctagtttgatatacatattggtattttttattcgggaattaattaccttggctaatgtttaaattatttataataaaatcattaataatttaattatttaccaataaaaatacacaatatggattcattaaacaatatcaatgcgctcaccctcatatttgcttctgttcttattttcgcgatcgcttaccggttctatggtatttttatcgccaacaaagtgctccggctcaatgaccaaaacttgactcctgctgttgaatttgcagatggtaaagattatgttgccaccaataaaaatgtgcttttcgggcatcattttgctgcaatcgcagcagccgggccattggtaggacctgtccttgctgcacaattcggatatcttcccggtgcgctatggatccttatcggatgtgttctgggtggtggggtacatgatatgatcgtactttttgcttcagtaagacataaaggccaaagtcttgccaccattgcttccaaagaaatcgggaaagcaacgggaactgttgcaggatttgccattcttttcatccttatccttacactagcaggattatcattagcttgtatcaatgcaatgcacgaagcttcatggtctctgtttacggtagtcattactatgcctattgcgatcataatgggtctgattatgcgctacaaaaagaacagtgttctgtttgcaagtattttgggaggtattctcttagttgcaggaataatcggagggcacagcctcatgcagaatcctacaatgaataatttattttcatgggatattaaaacaatttccatagcgattcctctgtatggttttattgcttctgtcctgcccgtatggcttcttttggttccaagggattatttatcaacctatttaaagatcggaactattatcatgcttgccatcggtgtaattgttattcatcctaccattcagatgccggctatcacagctttcgttaatggcggaggtcctattataggtggacctgtgcttccttttatttttattgtgattgcctgtggtgcgatttccgggttccatgctgtgattgctacgggaaccactccaaaaatgcttaataaagaaagggaaattcttttcgtaggatatggagctatgctggtagaaggctttgttgcattaatggcacttattgcagcctgcacattgatgccgggcgattattttgcaatcaatacccctaaagaagcttatgactcattccttgctgcgcacccttctcttcacggagtagatattgattattattcgcagaaaataggcattgacctctacggcagaaccggaggtgctgtatctctggctgtgggaatggctcacatcttcaataaaatcccgtacatggatcagcttactgcgtattggtataattttgcgatcatgtttgaagctgtttttatcctgactgctattgatgcaggaacaagggttggacgtttctttttacaggaaatgctgggttctgtagttccgaaattcaatgataaaaactggattcccggaatcattatcagtagtcttctttttacttttgcctggggctatcttgtgtatacaggaaatgtaaacagtatctggccgttattcgggatcagtaaccagctgttagcagcctgcggactgatcgtctgtacaacgatgctgatcaggatgaaccggggtaaatatgctttatgttctgcagttcccggggttttcatggcagggattacgttttgggctggttatatacaggtgacagccatttatatccccaaaggacaatatttactggcagctttagcggtaacggcaatggttctgatgcttattgtgtttatcggagctttcaggaaatggtatcagctgcttcagatcaataagacagagattgatcattatggcgaacctgtgaaggaacttgtggaaagataagattcacattaaattaaaaagaaaaacagttcagaaattctgaactgtttttttataagcattatcggttattaaattaaaaattgaaattaagtcttgcaaaaacatatcttccgttctgtccaaactgagaagtggaacgtgagtaaacgaactgatcattattggtagaagcagaaggtttttcgttggataaatatcaaacaggttattcacacccaaagtgagccctacatttttggtaaactgataggccgcagagatatcagtaatgattttatctccgatctgctgatgttcattaaaatcaatgattccatctccgttaacatcaataatatcagcacctgttacttttccgaaataggtatttctcagatagaagttggcgttcttccatgaaaaggtatgcgaaaggctggctttcactcttggcacagcttcttcaagatacactcttgatttttcagaaaaataaatcttttcaagggaaggagactgcagcagccctgccgaatgaatttctccaacctgtttggtctggttcaggttaattgcgaaattattatccagtttaaatcctgaaaatcttgcattatgtgagatcacaacgtctactccctttgtttctgtatcaatggcattggtaaagaattgtgcagcattgattcctaactggtcgtaagcctcctgtgctttctgtggaacgcttgctcttaagaactggtctgtaagaataatacggttatcaattctcgtgaaataaccgtctgcggtaaagctaagcccagccgaaggaattctgtaagtaaaccctacacttgctgacttggaagtttcctgtttcagctttggcatatccaaaagtcctgctagctgagaatcattactgaaagttcctacttccaaaagctggttatttgtaaataatgtagacgttacattataataaatctggtggatagacggagctctgaatcctgtagaaccggcaaatctcacattgaaatccgatgtgactttgattcttgatgctaatttataattgaatgtcgatccaaaatcagaatagttttcatatctcgccgcagcatctaccaatagccagttggtaaagttaaattccacatccgcataggctgctaccgactgtctgtttttatctactgcatttccgggcttaaatccgttgaaaacctgagaacctcccggaagcgatgctccgaaaaaatctgtaggtcttacagaatttccgttccaaacatttcctgaaacgtcatatgttgcataagaagcttcttctccctgggtaattttaaaattttcatatcggtgctcacctccaaaggctacattgataccttcccacacatcgtattttttagagaaatctaaattgatcgtattttgagaaaaccttaagccacctgcattgaattcccttggtgaagcaaagcgcagagaggtattgcctgtattctgaatattataggtaaatgaattctgcccgtaagtattactgaaatcaatattccagccgtcccatttcccttttattcctgctgctaatgaaatatcctgaatatctgttccgatttgtggaagataaccattgggatataatcctgtaaaagttctgctttcgcttggtcttctgtaaaaccctccggaagttccatgtcttaaactgtatcctccaaaagtgtatactttccagttttcactgacaggcacttcagcatttacaaacaactgatgattattaagttttgactgtcctacctgcatattaaaatcctttctcgtctgacctctgtaagccagttcctgatcagtaaagtaattaagctgatctctggtaaagctcgaagatttcaagacattctgtaacgcagagatggtaccagctccctgaatcgcattttgtaaatccggagaaaaatagcttacattctgtgcatactgatgaatgtaattcacgatctgctgtgaattgggtgtattatttatattggtaaaaagagaagaaaggtttactccgtcatttaaagcacgttgttcaattgcattataagcattataaataggtccactttctgttcctgctctatacgttggatttctgaactgtgacgaccaggtaatattaaagaatcctcccttggttccgattttatttccataattcaaatccagctgaatattttgtccgtcaaaatctccggtatgatcgttagctgttggcgtaaggtttcctccgtagctgatctgacctgcaagttttcctgtatctcttttaagatcaaggttaatgacacctgcaatggcatcagaaccgtattgagctgcagctccgtctcttaaaacttcaatcctgtttaaagcaaaagatggaatagcattcaaatctgtaccaacagttcctcttcccggcgttccgtttacattcaccaatgctgaagtatgtcttctttttccattcactaaaaccaaaacctgatctggtcccaatcctctgagctgtgcgggatccaagtgatctgtaccatcagaattggtttgaatggtggaagtaaatgaaggtgctaccgcgttaaggatttgccctatattcgtctgcggaagaatgattgaagattcttttacattaaagacatctacaggaaccgcactttctgtcttagatctggcaccagctcttgaacccaataccacaacttcttctacattattggtttttatactgtctttatttgtttttatgctgtctttttcctgtccgtaagtaaatacaccaaggaaaaataaaacagaggccgaaagaatagtttttttatttctcatatagtttagaatttgataacatttatgttttttacaaggtgcaaatgtaaaatttatttattagtctacaaaacagatagactttgtttttataaaaaatagttatcgtttctttctatccctcacttaaagttaagataaattaaggaaatatttataaaaaacgttgttttatagcaggttaaatttaaattgaattttataaaaacgctacgcacgcaaagaaatcttttacttattgattattttttggtcgcaacgcacttcgttcagcagaggatttatcttagctaagtgaacgccttcgcgaacgaaaaaatgaaacagttcaaatagaacagaactctgcgaacttcgcgtttaaataaaaaaacggatccaaaattgaatccgttttctttatattattttatgataaaattaaatcttagtcagttttgcatatttcaggatcaggtttttctctccttcatgcatgaaaactacttttgctttgatattctgaggatcagttccgtccaggaaagtgacttctcctattccgaaacggtcatgtctcactttatcacccacttcaatatcctgagacgaggctccgcttggattgataattttagccgtgctaacaggtttcagttttctaacttccgttgccggttttgaagtctctcctctatcgattgtctttttttcaacctttttgaaagatctcatttcggaaggatgttcatcaaaaatattggactttacccctgaattattgataaaccttttttccatagcaggattaaggaattcaatatattcatcatcaatttcacttaagaatcttgaaggttcagcgtcggtaattttcccccattggaaacgggaaacagcatatgagaagaaagcttgtttttctgcccttgtcaatgctacgtagaataatcttctttcttcttccagatcttctctggtagccgaactcataaagctcgggaataaattttcttcaagtcctaccaggtgaaccaccgggaattccagccctttggagaggtgaatggtcatcaatgaaaccatatcatcttccagttctttatcctgagtatctgcagaaagggcaatattttcaaggaaattggaaagactcggatcaccgtcttcaagctgcatctgttcttcaatgaatccctgcatagagttcatcaattcctgtacgttttctactctggaaattccctcaggagtctgatcatctttcaggaatttgattaaaccgcttcgttttgccacttccatagcaacactgtaagcggtttctgttttcaatagtacctgaaaagccttgatcatggaccagaaatcattcagtttatttaaaactccgttgtttaaacctaactggggtgcatacattggaagattatccaacacttttgaaactgcgatattgtgagcatctgcaaaaacaatcagtttattctgtgttgtttctccgattcctctcgccggataattgataatcctcatcaatgcttcagaatcgttttcattgataaggaggcgaaggtacccgataaggtcttttacttcttttctctggtaaaatgaaagtcccccgtaaactttgtacggaatatttttacgtctcagcgcatcttcaaaggcacgcgtctgagagttggttctgtataaaatagcgaaatcgctgtactttctctggtcacggttacgaagttcccagatatttcctgccacgaaattggcttcatcagcatcggaaagcgaacggtatattttaattttgtccccttcttcattatcactgaatacattcttcttaaactgctgcaggttttttgcaatcacaacattcgcagcatttacaatattctgtgtagaacggtaattctgttccaaagataccgttttagcatccggataatcttttttaaagtttaagatattataaatattcgctccacggaaagagtagatagactgcgcatcatctcctaccacacaaatattttcaaattttgaagccaatgcttttacaataaggtattgagagtggttcgtatcctgatactcatccaccataatgtatctgaatctatcctgatattttgccagtacttccgggaaacgggttaaaagttcattggtttttagcagaagatcatcaaaatccatggatccgtttctgaaacactgctcaacatatctttgataaatctgcccgatgaacttcatattcgctttttcatcagcttccatcagttccggattattgaaatatgcttttaccgtaatcagattattcttgtaggttgagattcttgcctgaacttttttaggtttataaagatctgcatcaatattcatatccttcagtacctttttgatcacattcaaagcatcctgctgatcataaatggtaaagttggaaggataaccaagataatgggcttcaattcttaaaatcctcgcaaaaaccgagtgaaaagttcccatccagaggcttcttgcattgctttcccccacaacttttgcgatacggtctttcatttcacgtgccgctttattggtaaaggtaagagccaggatattgaaagggtctattccgttgtgtattaagtgggcaatacgcatggtaagtacacgcgttttcccggaacctgctccggcaagtaccatcagaggtccctgtaaagaggtaacggcttcatattgtgattcgttgagtcctttcaaatagtccatacagcaaaaattttgggaacacaaaattaaggtattcggaggagaattcaaactctcataaagaagttaggagtatgaagtattaagattgtatttgtcaatggtcaattttgctccgcaagtgaattgtgaaggattattcttggtctcaactcccgcaaccctaatcacctaacaaattgacaagcgaagcgaattcactattcgccattcactattcaccatcacctatatatttctacatattctgtaacatttaattcacttttcatactaataggtaaacaatttctaaattttatgaaaaagcgacttctttctgctgctgccgtagctttcttcgggctaatgctgaacgcacagcaaattaaattcgaagagtatgaccttcccaatggtcttcatgtaattcttcatcaggataactcagcaccggtggtaacaacaggtgtaatgtaccatgtaggtgccaaagatgaagtaaaaggcagaacaggttttgctcatttcttcgaacatcttttattcgaaggaacccctaatatcaaaagaggagactggttcaaaatcgtttcttcaaacggagggcagaacaacgccaacaccaccaacgacagaacgtattattatgaaacattcccttccaataatgaacagcttggactttggatggaagctgaaagaatgcgtcacgcagtaattaaccagattggtgtagatacgcagagagaggtggtaaaagaagagaaaagattaagaatggataaccagccttatggaaatcttttcaccacaattcagaaaaatttatttaccaatcacccgtacaactggccgacaatcggttctatggaagatctgaactcagctaagctagaggaattccaggcattctacaaaaagtattacgttccgaacaatgctactttggttgttgcgggagatatcaaacctgagcagacaaaaaaatggatcgaaacgtattacggaggaattccaaagggaacagtatatcctaaagatttcccgaaagaaactcctatcactcaggaaaaagaagtaactgctactgacccgaatattcagcttccggcttatgttttcgcgtacagaactccggctaacaaagagaaagatgcttatgttttagatatgctttcttcttatttaagtaatggtaaatcttccgttttatataaaaaattagttgaccaggataaaaaagcacttcaggtagctgctttcaaccagggtcttgaggattacagtatcttcgcattcttcgcgattccgatgggacagactaccaaacaggttctacaggcagatattgatgctgaaatcaaaaagcttcagactactttaatttcagaagaagattatcaaaagcttcaaaaccagtatgaaaaccagtttgtaaatgctaactcgagcattcagggaattgctgcttcattggcaactaatcatgtattgatgggtgacacgaatcttatcaacaaagaaattgacatttacagatccatcacaagacaggatcttcagaatgcggctaaaaagtatcttaattccaaccaaagaataatcatcaactacgtacctgagaaaaagtaatcattccattttttcaggttaacctatgattattaaaaattaaatttttacaaatgaaaaagcaattaacatatatagctgcagcgtttttctttacaggaatggtttcagcacaaaaaatagatcttaatgcaatgccaaaaccaggacctactcctgcgatcaacattgccaagccaaaaacatttcagctaaacaacggccttacagtgatggtggttgaaaacaacaaactgccaagagtaagcgcaagtctttctatggacagacctccatacaacgaaggagctgtaacgggtgtaagcgaaattatggccgaacagttcgaaaacggaacaaccaacatgagcaaagatgatttcaacaaaaaagtggattatcttggggctaaccttaatttctcttcaggaggtgcttctgccaactcactttcaaaatatttccctgaagtattaaacttaatggctgatgccatcatcaatccaaaattctctgcggaagaaattcaaagttctaaggaaagagctatcgaaggattaaaatccgacgaaaaaaacgcatcttccattgcttcaagagtttccaatgctttgatgtatggaaaaaatacttctagaggtgagtttgaaacggttgaatctatcaacaaaatccagcttgctgacgtacagaatatatacaaaaaatactacgctccggacaatgcttatctggtaatcgtaggagatgtaaagtttgatcagataaaacctctgatcgagaaagctttcagtggctggaaaaaggcaaatacacctgttaccccactagaaccggcttctaatgttgctaaaacagaaatcaacgtagtggatgttccttcagcagtacagtctgttgtttccttaaacaacctgaataccctgaagatgaaggatgccaactacttccctgcaacaattgccaactacattcttggaggagggggtgaagccagacttttcatgaaccttcgtgagaaaaacggattcacttatggtgcttattcaagcatggttgcaagtaaatattctccacaattctctgcaagtgcaagtgtaagaaatgaggttacagacaaagcagttaaggaattcatgaatgaacttaatgctatttctactgtaaaaccggaagaactggctaatgcaaaagcaaaactgaaaggagctttcattatgtctttggaacagcctgcgacgatcgcaagatttgctttaaatcaaaaggttcaggatttaccggctgatttctataccaactacttaaaatctattgataaagtaacagcagcagatgttaccaatgctgtaaaagctaccatcttacctaaccagagcagaattttcatcgcaggtaaagcctctgatatttctgaaggactggaaaagctggggtatcctgtaaaatattttgataaagatgccaatcctgtagcgaaaccaacggtacagaaagtggatgccagcgtaactgttgcatctattgttgacaaatatatcaatgccatcggaggaaaagctaatcttgcaaaaattacttcttacaccacaaatgcttcaatgtctatgcagggacagaatatcgattttaaaatcgttaaggcacaaggaggaaaagaacttactactgtaacagcaatgggtcaggttgttcagaagcaggtatttgacggaaaaacaggttattctgagcaaatgggacaaaaagttgccatcacgccggaagaaattgctgaaaaacaaaagaatcctgagctttttgaagaattaggcttcacaaaatccgctgattataaattaggaggaattgagaaaatcggaggcgaagattcttatgcaatcaaaggcggagatacaacgtattactacagcgttgcaacaggattgaaaaccggagaaactaaaaaagtaaaggctaagggtcaggaaatgactatcccaacaacattctctaattacaaagatgtagaaggcgtaaaaatgccttacaccatctctgtaagccagatgggaatggatatgaccatgacggtaaagtcttatgaaatcaataaagcaacggatgctgattttaaataacaacatcctgtttttataaaaaaaacggtaacaattgttgccgtttttatttttatcaacatttggcgacatctttttttgccattcagtaaaaaaagattaaatttgcccattcaaaaagatatcggaattaatggatactatatttacactattgatggttcttattatgattgccagtgttttattggtaattatcgttatggcgcaaaatccaaaaggaggaggcctttccagtacattcggaggtgcatcatctgcacagttcggggtacagagaaccaatgatttcatggaaaaagcaacatggactctgggcggaactatcatcgttcttatccttttaagcgttgttattacaggtaagccttcacaggcacttcctcaacagccagcgaagaaagaagctcctgcaaaacagtcagctcctgcttcttctacaacaactcctgcacagactcctgcaccggtaaaataagaagaacattatcataaaacaaaagcaactcaattgagttgcttttttattttaacctgatcttttcaatctgatggcggagcttcaatcctgctttcaaaaatgaatattgtacaggtttagattctttataatacttgtcaataaagatctgcattgctccatagaatctgctgagatatacctcatctttaatggtactttcccctttatggtgaagaattgaaacctttccgtaatagaagtttttatatccgtttcttaaaaaggtatagcaaagatcaatatcttctccatacataaaataagcttcatccagcccgcctattttttcgtacactttttttttagccaataaaaaggctcctgtgatcacatcaacttcagctacctcattttcttctatatcgtttctgtaataggattttgaattgttctttttaaaattggtaaacagtttttcaaacgaattgaacatatccggaactgagcgtttactttcaggcaaaaaatttccttcagcatcatgcatcctcactcccagacatccaaaggaaggctgtgcatctgcaaaatccagcaattctttcatataaaacccttcaagctcggtatcaggatttagaagtaaaatatattctccttttgccgtccggatggcccgattgttcgcttttgaaaaaccaccatttgtttcagaagaaataaaatgtatgttgggaaattcagtaataagttcttgccatgaagcgtctgtagaagcattatcgatgacaatgacttcatattctatctccaggatatatttctgaagcgactggaggcagcttctgagcagttgggtgacattgtaattaacaataataacagacagcttcatattaatctttctcgttgtatggcaatctgttgataatagatcttcctaaagaaatttcatcggcatattccagctcgtctcctaccgaaattcctcttgcaatgcttgaaaaattaacattgaagtttttaaatttcttataaatataataagctgtcgtatctccctccatcgtagcactcaacgcaaaaataaattctttcaccttgccttcattcagctttttttcaatgctgggaatgttcaactggcctggtccaactccttccattggagatatttttccgccaagaatcagatatttccccgtgtacttccctgtattttcaatagcaatgacatcacgcacatcttccacaatacagatcagttcgccatttctcttttcattgctgcatatttcacaaacgtcaaaatctgaaaaattatgacattctttgcagtatttgatttcgttgacaagattaatcagggagtttccaagacttacggctctggaactgggctgcttcaacaaatgtaatgctaatcttaaagctgtttttctaccaattccaggcagcccggaaatctcatccaccgcctttgccaatactttactagggtaatccataagtacaaaaataaggattaaagttgataatttacagtgaataatgaatcgtcgattcgcttcgcatgtgaattttcatacaacataaataaattttaacgcagtgttcactaagatttttttaattcttaaaaacgatagcgggggcgtttcactcagcaacagacaaatctgatatcctggttgaacgaagtgcctttgcgatcgaaataaataaaaataaatatcaaccttgcgagcatagcgtttcttttaacaaaaaacattttcaacacaatgtctcattatgatattttatatttctctcctgtctgagaactgtaaaaaaacctttatatttgcggcttaaattaaatatgaaaaaaataaactgacatggtacttaacaatcttaattatccactggatttcaaattcaaaatcactactttagcaagcgacttcaacattactgacaaaaatggaaattatgtggcgtatgttcgtcagaaaatgttcaagttaaaagaagatgttatcgtttttaatgatgagagcaaatctaaagagcttttcagaatcaaagcgaatcagtggattgatttcaacgcttcgtattctctgaatgatcttattgataacaaaaactatggcagactggcaagaaaaggtatgcgttctctctggaaagcaagctatgatatccttgatgcacatgatcagcctaagtttaaaattcaggaagacagcgcatgggtaagattctgggacagctttgtaggagaaattcctatcatcgggatgttcaccggctattttcttaatccatcttatacagtaacgggtattgatggtaaagcttattttaagctaaaaaaaatgccgtcattcttcggaagaagattccagctggacagactgattgacattgatgatcaggaagaaagtttagtgatcctttctttactaatgatgacgcttcttgaaagagcaagaggataaaccaattataaaaccacaaacaaatgaaatatttaatcattttattttctgcatttctgctggtagcctgtaaaaaggaaaaagaaactgtttcagattctgctcctgctgattctttacatgtcactaaggactctgcttccactgctggtatttcttccggaaatatcctggtgggaacaattccgtttccaaaagaaatcaaagaatgttcctgctattttgctgtaagcaaaactgattttgaaaatgaaagatacatctacgcagatgacgccggaaagaccgcttatatgatgctggacggtaaaagactcgctatgaatctgatctcatcaagcgatatggaagtagatgaattgcttaccaaagaaatagaaaatgatgattataagatttctgtaaaaggtaaaaaaataaaaggcgaagaagctctgctgtttgaaggtactctgactattgagaaaccagacggcaccactttcacgactcctatttatggagagtgtggatgctgataaaagcgaaaaagcccactcgcaaaaaggtagaagcgaaaaaaaggatcagcccatttgctgttttgctatttcgtctccaaatgcatacaaagtgcttctgtattccacagaagcattttttattttgtaaatttgggaaaaataaatttcaatggaattatctaatatagaaccgcagatcatctggaaaaatttttccagattaaatgctgttccaagaccttcaaaaaaagaagaaaaagtaattgctttcatcaaaggatttggtgagaatttaggactggaaactacggtagatgaagtaggaaacgttattattaaaaaacctgccactgcaggaatggaaaaccgtaaatctattgtgcttcagtctcaccttgatatggtttgccagaaaaacaatgatgttaatttcgattttgaaacagaaggaatcaaaatggaaattgacggtgactgggtaaaggcaaaaggaactacactaggagctgataacggtttaggagtagcaaccattatgtctatccttgaaagttcagatataccccaccctgcattggaagctcttttcactattgatgaagagaccggaatgacaggtgctttaggattaaaaccaggacagttaacaggtgatattctattgaatcttgacactgaagaagatgatgaaattgatatcggctgcgccggtggtgttgatgtaaccatcactcaaacttaccctgcagaagcttcaaaaggacaaattgtaagacttgaagtaaaaggtcttcagggaggacactccggaatggatatccataaaggcttcggaaatgccaatatcattttgggaagacttctttacagcggattggaaaaccagaacatcgaactggtttctatcgacagcggagggttgagaaatgcgattccaagagaaggtgttgccgttatttcggtgagaaatgctcaggagtttattgaaaatgtaacggttcttaaaaaagatattttagaagaattcgcaacggtagaacctggaatccagattaatattgagagctctacatcttctgacaaggcaatttctgaagaagattccagaaaagtgatacttactttaaaagcgcttcacaacggagtttacagaatgagcccggacgtaaaagatcttgtagaagcttctaacaacgtggcaagagtagaactgaaaggtggagaacttaagatcttaaaccttacgagatcttctgtagattcttcaaaatattcagtagcggaacaattaaaatctgtagcggaactggctggaatgaatgttgagttcagcggttcatatcctggatggaaaccaaaaccaggttcagaaattgtacagctgatggataaactttacacagaaaagttcaatgaaaaacctcatgtagtagcttgtcacgcaggacttgaatgtggaatcatcggtgctaattatcctgaaatggaaatggtaagctttggacctactatcagaggggcacactctcctgatgaaagagccaatattccttcagcacagaaattctggagcttcctaaaagatattttagcgaatattcctcagaaataaaacattaaaattactatattgaatatccaaagtcttatgattttggatattttagttttaattgaaataaagatgcttcgacaggctcagcatgacgctgctaaaaatttatctctaaaaaagcagttagtattagagatgtcatgctgagcttgtcgaagcatctcaacaatagcataaaaaacaaatctaatacaatgaaaaatatcaccgtattctgcggctcaagtttcggcacagatacaatctatgaagagcaggcatttttgcttggccagactttggcaaaacaaaatatacaattaatttatggcggctctgaaaccggtttaatgggaactattgccaacggagtattaagcgaaaacggcaaggtaacaggagttctcccctattttttacaagctaaagagattgctcataaaagccttaccgaactgatcctcgtggaaacaatgcacgaaagaaaaaccaaaatgaatgaactctgtgacggcgttatcgttcttcctggcggctatggtacactagaagagttttttgagatgatcacatgggcacagcttgggcttcataaaaaacccatcggaattctaaatattgacggattttatgatgatctgatcaggttggttcaaaccatggtcgacaagggatttttaaaacaggtgaacagagatatgctgctgatcagcgataccattgatgaactgttggaaaagatgagaaattaccaggcgcctacggttgggaaatggatttctaaagatcaggcataatcacaggaagaatatattgaaacattcgctctttttaaaatatgttttcatatctgaggtttaagtttagtacatttgtgagaatactttctcacgactaaaagaattaaaacaatgaaaaatggacttctgacaggctgtatattattaagccaggtcatttttgctcagtataattatcctaagactcctgaaaatcctgtgacagacgattactttggtaccaaaatcacagacaattaccaatggttggaaaacctgaaaagtcccgaagtacaaacatggttcaaggcacagtcagatttcagccataatcttattaataccattcctaatcgtgatgccctgtatcaaagaatgaaacaggttcaggaacttggtggagattcctacggctatgcaaagcaaagaggaaatctttatttctatgctaaaaccaaaaaaaatgaaaagctttccaagctctacgcaaaagacgtttctacgggaaaggaaactctgattttcgaccctgaaacctataaaaaggatgcacagattaccgatttcacagtagactccagcggtaataaaattgctctgttattttccaagtccgggagtgaaatttgtgagcttagaattttagatctaaaaactaaaaaattccttaatgataccttatcgcccatctggagcgaatttaattttgaatttactccggatggacagtatatcacctataccaagatgagcacgggagatcctaacagcaatatgttgctgaaagaaatgaaggcgatgcttcatcagattgggaccagtcaggataaagacgttatattgggatcacgtgaagaatatccggaacttaatatcttaacagaacaatttcctgaagtatcttttacaagtgattaccaaaccatgatcttaagaatcggatccacaaaaagcgaaaaccctgttttttatgctccgatatcttctcttaaagataaaaaaatcaagtggaaacagatcatcaaaccatcggacgagattgtacagacattcatcagcggagatcaattgtttttccttacgcataaggatgctcccaattataaagtagggctgacaagtttatcaaatcctgatttcggtcatgctaaagttattgttcctgaaagcagttctgtcatcacctctatccacagctctaaaaattatctgttctattctttaagcaacgggattacccaggataaatatcagatagatcgtaaaacactggctataaccaaaattcctctacctggtgggattaataattctatcgctcttaattcccgtgaaaatgataatctgcaatgctataacagcaattggcttactcctggcactttttatgattataaccccgaaagtggtaaagctgtaaaaagcaaatattttaacggagacagcaactatcctgattacaatgcactgtatgaagtaaaagaagtggaagtaaaaagtcatgacggagcaatagtacctctttctattatttatcctaaaaacatcaaaatggatggcagtactccagcttatatcacagggtatggcggttatggaatatcttatacccctcgtttttccactagattatcagtattacttgaacaaggtgtagtactggcaattgcccatgtaagaggaggaggcgaaaaaggagacaaatggcacagagacggaatgaaagctaaaaaacctaatacctggaaagattttatcgcatgttccgaatatcttgtgaatcaaaaatatacttctccctcaaagcttatcggcaatggggcaagtatgggaggagttcttattgggcgggctattactgaaagaccggatttatatggagttgccatcgccgaagtaggaatgaccaatgttctgcgttcccaaaactcagctaacggagccaatcagattccggaagtaggaaatttaaaagatcctgaagacaccaagcaccttattgaaatggatgctcaaagcaaggtaaaaaaaggcgtaaaatatccagctgttcttgtgagtaccggaatgaatgattccagaattaccccatgggagcctgcaaaatttgccgctgcattacagaacagtacgtcttccgggaaacctgttttattatatgtgaattatgaaaacggacactttacaagtgatctggaaataactttccgtgaatatgcagatatttatgcttttgcattatggcaggtaggccatccgaaatttcaacccgaaaaaaaataaagcaaaacccgtccgaaaaaactcggacgggtttcttattaagattaaaaaatattttctaaggataaggagcaatctccacttcaagtccctccatttcatcagcaatatgcagctggcatcctaatctgctgttgtctttcacgtggaaagcttcagccaacatcgcatcttcttcatctcccattggctctagccccggatcattgattacataaacctggcacgaagcacacatcgccattcctccgcatacaccaatagtaccttcttctgccaattcataggaacggataatttccattaaattcatagacatatccgtaggagctacgacatcgtgggttaccccttctctgtcggtgattttaatattaatatctgacataattctgcaaaattagtcaatttttttcacaacagctttctctgcttctttacggcttccgtcaaatccgtctactccacttaccgttgtatattttaaaacgaattttttacctggattcagtctgttgtaaacgctctggcacattaaagtagcctcatggaaaccacaaaggatcagcttcagttttccagggtaagtgttgatatccccgatagcataaataccatcaatgttggtctgataatcaagggcattgtttacaacgattgcatttttttcaatatttaatccccagtttccgatctctcctaattttggtgtcaatccgaataaaggaataaaataatccgtttcaatatcgtaagcttcctgaccttctacttctaccgtgatagcctctacttttccgtcacctttaataccggtaacttctgcaggagtaattaatttgattttcccctgatttttaagatcctgaactttctctacagaatccaaagctcctctgaactcatttcttctgtggatcaaagttacttcgctggctacattagaaaggaagatactccagtcaagggcagaatcacctcctcctgcaataactacttttttgtttctgaagtgctcaggttccttaacgaaatattcaagacctttttcttcataatcagctatattttcgaaagtgggctttctcggttcaaaagttcctaatcctcctgcaatagcaatagctttacatctgtgaacagtacctttgttggtaatcacttcaaaccattcatcatcaacttttgtataagaaacagccgtctctcccaaagtaaaccctggttgaaactgcttgatctgctccatcaaattatctaccaattctccggcatttactgaaggataacctgggatatcgaagataggtttcttaggataaagttccgccaattgccctcccggctgtggaagtgcatcaataatatgacacttcattttcaataaaccagcttcaaaaactgcaaaaagtcctgtaggtcccgcacctatgatcaatatatcagtggttatcataatctttaagataatttaattatacatgtaactgcaaatttactaattttaatgcgaagcatatttaattgattctaaataaaaacctgagatttgtcaaatatctatcaattaagattttaaatttggcaatgtttttgtaaatgtcttgttatgaagaaaattttaaacctttttgcagtatttatattctttttaggctctgcccagattgataacatcgcagacggcgaatctattactcttaggattcactacggcttcctgaatgcaggaactgcgaatcttactacaaaaaagactaactacaaaggggttcctcatctctatgtgaaaggcacagggcagacaaccggtgctgtaaaagcattcttcaaggtagaggatttatatgaaagcttcatcaatacccagacaggattaccaagtttttatgtaagaaatgtacgcgagggaagctatcggcaacattttgaaaccgctttcaatcacgataataacactttgattttaacggataaaaagacaccggccaatgggtctaaagttttaaaatcagtgaaaggtgtacaggatatgctttcatgcttctattatttaagaagtaaaagcccggatgaactcaaagtaggaactgtgatcaatatgaacgtatggattgatgatgaaatgtttccgttccagctaaaagtgattggaacagaaaatttaaagactaaattcgggaccatcaattgtttgaaaattatcccatctgtaaaaagcggaagggtatttaaagaaaaagagggagtcaccatgtgggtttccaacgatgctaaccacattcctatgctgttgaaagcggaacttgccgttggggcactaaaagccagcattgatgattataaaaatgtgaagtatcctttaaagtttagtaaataacaacatttgtttcaatagaaagcctgtaaaactacaggctttttttatttccaatgtaatatactcctaagattgattgtcttaattatagaggcagtcaaagagctgcagcatgtcaatactgaggttccatccaaagtatgggcataagaaacagacacgtgtaaatttttcaataagatcagtttttagttacgttttgtttcttaggtcagtaattaaaaacaaaaaacctccggagctccggaggtttgattttttatagtgttttgaattgttcaagtgttctgatatcattttcaaagaacattctgatatcactcatctggtaaagaagcatcgtaattctttcaattcccattccgaatgcatatcctgaatatttctcagaatcgatattcacatttttcagtaccgcaggatctaccattccgcaccccatgatttccagccatcctgttcccttcgtgattctgtaatcagtttcagagtttaatccccaatacacatcaatttcagcactaggctctgtgaacgggaagaaagagggtctcattctgattttagattttccgaaaagctcagtagtaaagaactgaatggtttgcttcagatctgcaaagcttacattctcatcaatatacaatccctcaatctggtggaaaatacagtgagaacgtgaagaaattgcctcatttctgaatactcttcccggagataaaattctgatcggaggctggttttcttccatataacgggtctgtacggaagaagtatgcgttctcaaaagaatatccggattctgctcaatgaagaacgtatcctgcatatctcttgccgggtgatattccggaaggttaagcgctgtaaagttatgccagtcatcttcaatctcagggccatctgctactgcaaaaccgatagatttgaagatttcaataatcctgttttttaccagattgatcggatgtctggaacccagatccaatggaaaagcgggtcttgtaagatcttctttttcaacgataacagaagatgctgaagcatttttcaaatcctccagttttacagccaccgcctgctttaaagtattgatcttctgcccaaattctttcttctggtcattaggaacttctttaaatttttcaaaaaaatcattcagaaccccttttttaccattgtacttgattcggaagttttcgatctcttccttagaggtagcattgaagccgtttacttcgatcagtagttcttctatcttttctatcattgttttaccctttcaaaatgttttgcaaaaatacgattttaagttgaataataagtccgtcataaaaaaatctgcctctttttcgggaggcagacttcaatcacttatttcacttaaataaaaaaattatttcttttctaaagctttaacgctgatctgaagagttacctcatctttgatcacaccgttttcagcaggagcctggaacttcaccccaaactcttctcttttgatatctttcggctcagtagctacgctcacttctccattcttcacagaaacattagctttaaactgaacaggttttgtaattcccttaatcgttaaattaccatccaaaagcgtattataatcaccttctgtagccggagttacttttgtaatttcataagaagctgtaggaaatttttccacttcaaagaaatctccgctcttcaggtggccgtttaattttcctaaatcttccggactgtctttaagatcaacagaagttaaagaattcatatcagcaacgaattttccgctttccagttttccgtctttcaccgtcacatctccgctttcaaacctgatcgtaccgaaatggctcgtattttcagatttaaatactttatatcccttccattcaaccttactgtttagtgtatccaaagtgaactggctaccttctttagtagtcgtcacctcattactttcactggtaagcggtttatcttttttacaagaaaccattacagcagcaataaataatgcaggaatagctaacgaaagcagtttttttctcatttttgatttatttttattagttccgctaatataataaaaaaaaatatgttttcataaaaaccttacatttgtaatatgctattagaaataaacaatttatttttctctcacaacaaagaaaatcccctgtttcagaaccttaatctaaggtttgaagaaaacagaattatagctcttgccggtgaaagcggatgtggaaaatctacccttctcagcctgatctatggccttcttgattgggagagcggagaaattatttttaacggaacaaagctttcaggaccaaagggaaaccttgttcccggagagcccgaaatgaaattcgtggcacaaaattttgatcttatgccttacgctactgttgccgaaaacgtaggaaaatttatttcaaatatcaatttaaaacaaaaaaaagaaaccgtaacggaacttcttgaggtggtaggacttcaggaatttgccaacgtactgcctaaatatttaagtggcggacaacagcaaagagtggctattgccagagcattatccgtacttccaaagctcctgattttagacgaaccgttcagtaatcttgatttcccgagaaaaattgaaatccgggaaagacttttcaggtatgtaaagcagcatggtgtttctttaattatttccacccatgaactacaggatattatgccatggctggatcagattgttattcttcaaaacggaagacttattcagaatgacagtcctgaagaaacctacagacatccttacaattcttatgttgcgagactattcggggaagtgaatatctttaccgaaactgaggcagcagatttccagctttcaaaattttcatattatccaaaggaaataaaaattaccgaaaccggtgttgaagctgaaattctggaaagcagatttgcaggaaattattattggaacaaactaaaagcaaaaggtaaagaactggtagtttatactgatgataaaatatccggaccaatatatatttcttttatttaggctaaaaggctaaatcgcaaaaaagacgaatagaaaaaatcctgaaacagattatcagactgactatgaatccattttgctatttcacagttttgccattttactacctcatctaactcctacatttccttacacttacccataaaaaaaatacaaagataagaagcggttataaaactttttcttacatttgtattccacagcataaggaaatttttggttaattctctttctgccttccggacggacattagcagtactgcaattaagtctcttgaaagattacactgtccaattttttccttttcttatttttatgggtataaaaagcaaagcaatcttacgctttctttacaaattctgatttaagagccatcgctccgaaaccatcaattttacagtcgatattatgatcgctccctggtcttaaacggatatttttcactttggttcctgcttttaccggctttggagctccttttacaggaaggtcttttactactactacagaatcaccatcctgaagttcatttccgttagagtccaatatctttccttcatttgcagcttcagaagcagcttcttcagggttccattcgtaaaaacactgagaacataccatcatgttatcgcttgggtaggtaaactcagagctgcatttcggacaaagtactgtatcactcatattttaattttttgcaaaggtagggctttttaaaggttgaagtcaagaggtaaagcccagtatagtagacaataagcacatgttaatttcacaccaccaagtgaattagtacaaattaaataaacctgtcgcaaagaaaataaagtataataatgaagagtgcatattttgctagcaaatatttttcattaagcaaaaatacaggtttattcatcgtagagtaaaaagctattgtaaacaaataaaaaatataaatattcggaaaatatttagaaattcagcattaaaatttatttctaccatctaaaaaattaataaatataatgaccattcactactggatctcagattgtcaatagtcaatttttgctttgcaaagtgaattgtgaatgcgcaaccttttattagaaaactgatttgtacaatatataattactcataacctctcaaccggaaaccgaaaattcacaagcgaagcggaattcactattcactattcaccatccaggatccccttcacctctcctattctcaatctctctactcaaatcttcaactctcaattaaaagtcgtatttttgcagattcaaacagcgaagcaaatttatggaacttattcacagaaacttggcaatcggaattcacgatgccttacaggagacattttttgagaaaaacaaatatgccgataaagttattgaaagacttttgaaagcaaacaaaaaatggggaagccaggacagagctgttgtttctgaaattttctacaatatcatccgttggaaaaaacgccttgaatactatatgggtgaaggtgtaaaacccaacaatatctacaaactaatcattgcgtatttgctttggagcaaaaccaattataaaaaatttgaagaatttgacggaattaaaatcgccgatattcttaccaaacttaaaaagaacaccgttcctacaaaagcaatagaacattctattcccgactggctcgctgaaacacttgaaaaagaactgggtgccaactgggaaagagaaatgacggccttaaatgagcaggctcctactgttttaagagctaattctttaagaacaactactaaagaacttatttctgatctttcggatgaaggtgttgtatcttatcctgttaatggttatcctgatgctgttcagctggaagaaaagaagaatgttttccttaccacagctttcaaagaaggattatttgaagttcaggatgcttcttcccaaaagatcgggtatttccttgatgtaaaagagggacaaagagtggtggatgcatgtgccggtgcaggaggaaaaacacttcacctggccgcattaatgaaaaacaaaggacagatcatagcattagatatcttcgactggaagctcgcggagttgaagcgccgtgcaaagagagccggagcccacaatattgaaacccgtatgatctccgacaacaaagtgatcaagcgtcttcatgaaaaagcagacagacttctgattgatgctccatgttcaggtcttggagttttaaaaagaaacccggacagtaagtggaagattgatcaggattttattgacagaattaaaaaggagcagcaacaaatccttcaggattattctaaaatacttaaaaaaggaggaaaaatggtctacgcaacgtgttctatccttccttctgaaaataatctgcaggtagaagaattcatcaaaaacaatcctggattcaaaatgattaaagatgaaaaagtaatgcctagcgaagggtatgacggattctatatggctttgattgagagagtttcttaatctgatcctaacaacaatatattaaactactctattttatagagtagttttttatttcaaaatctttctgaaaaaaatgtaacaatttttgtaacatttaatatacattatctactaactgtatagattaaatccgttttttgacgctgtagaaagtttagaataactttgcaggaaactcatttatttatgcatacaagaattgttttcaattttctggctgtttttttatactgtctgttttctgcacagacctatgaaattcagtataccagctcttataacggaaaaatattaactgaccagccttctaccattgtatgggttaatgaaaaggaaaattttattctcaacaatacgatcaaggagcaaaaaagcaactatccttatgagatcactaaggtagaaaagccatccaatactattgtctcttatgcatttttaaaacccggatcaatcatctcaacatcagatgctgaatctgtaggaaaacaggattttgaactgaccaatgagacgaaaaaaattctgggatacaactgtaaaaaagcaatcacaaaagtcaattccaataccattgaagtatggtataccaatgatctgaaactaaaaggcggaccttctgttctaggacaaaatctgggattggttctggaagtggagagaaataaaaattctttggttacagccggatcaatcaaaaaaatcaagagcaccggagttgaaaatattctgaaaggaaatattcagacaacagatcagctgggatataaagatgagctttggaaaagcagatttaccacactgaatgtttttgaaaatgaactcatcaatttctctgaggcctcaaaatctgacagccagataaaaagatatgccaacggaaccattatccttaaaaaagtaaaattccctgctattacagaaggtgaaaatatttttatagagctgaaacagcagtctaacggagacgcctatgacagaacaggaactgttttttttattccgcaggacaaagaaaagtctttttttgatggactggaaaaaggagtgaaaacacttcctgtctacgaaaacggaaacggaaaacaatattatggagtaacggcttccgaaaactacagccctgccatggaaatgatgcggttctttacagcctttggcattcagaagttcaaccatatccagcttaagggaaaagactggcagactataagtccgtaccggcaggatattacagaattgaagcctgctctatcaggaaaagagctatggataggaacatttattggcaattatgataaaggcggacataaggtgagtcttgacattactatccataaaagcgatcagacagttcataagaacaatgtggctattccgctgttcaatactttaaatattatggaaatggccggacaggattattctacaatgttcaatcaggataaggggcttcttgtcaatttcactttagataaagatctgaaaaacgcacagctaagatataccaccaccgggcacggaggctgggaaaacggagacgaattcgtcccaaaaaccaattctgtctttgtggatggaaatccggtattttcatttattccctggagaacagattgcggttcgtaccgtttatataatccggcttcaggaaatttccaggacggactttcttcatcagacctcagcagatcaaactggtgtccgggaacagttaccaatcctaatttcatctctcttggagatctgaaagcaggtaagcatacgatacaggtaaaaattccgcagggaccaacagaaggaacaagcttcagctcatggaatgtttcgggaacattattggggatccaataaaaacaaaaccttcttgcatgagaattgcaagaaggtaaaaacacaaatgatgaaaaaaaattatttcgagccacaaagtaaggagtaaaattcatataattaattaccatagattaataaatatgtcatttttatttcgtatgagggtgacattaatttacctcaacgaaaaaaatcaatcaaacacctgctaatttcaaaaaatagttaatatttttaacttaaaaatattaattggttaaaattttacacatttaaactttttttattgttatttataaacatcacttctacttttgtcccataaataataaaaattatgtgtggaattgtatgtttatttgacgccaaacagaaaactgatgtattaagaccccaggttttggaaatgtcaaaaaaaatccgtcacagaggaccggattggagtggagtttttcagaacgaaaaagtagttttctctcatgaaaggcttgccatcgtagatcctacatccggaaaacaacctttatttaccaaagacggaaaagtagtattagctgtaaacggtgaaatctacaaccatagagaattaaaagaagagtttcctgattatgaatttcagacccagtctgactgtgaagtaatcctggctctttacaaaaaatacggaaaaaatttcgttgaaaaactgaacggaatttttgcatttgctttatatgatactgaaaacgacgtttacctgattgcccgtgaccatatgggaatctgtccactttatcagggctgggacaaaaacggaaactattatgtcgcttctgaactgaaagctcttgaaggagtttgtaaaaaaatcgaaactttcttacctgggcattttgtgtacagcaaagatggcgctgaacttcagcaatggtataaaagagactgggaaagttttgatcatgtaaaagaaaacgaaacggatattgcaaaattgagaaaaggccttgaagatgccgtacacagacaactgatgagtgatgtcccttatggagttcttctttccggaggtttggattcatctgtcatttcagccattacagcaaagtttgcacgccagagaattgaaagtggtgatacccaggaagcctggtacccaagacttcacagttttgccgtagggcttgtaggttctcccgatctggcagcggctcagaaagcagcagaacacatcggatctgttcaccatgaagttaactttactgtacaggaaggactggatgctgtacgtgacgtcatttatcaccttgaaacgtatgatgtaacaaccatcagagcatccaccccgatgtatcttctggcaagagtgatcaagtctatgggaattaaaatggttctttcaggagaaggttccgacgaacttttcggtggctatttatatttccacaaagcacctgatgcaagagaattccatgatgagacagtaagaaagcttggtaaacttcacctttacgattgcctgagggctaacaaagcattaatgagctggggaattgaaggaagagtccctttccttgataaagaattcatggatattgccatgacgattaacccaaaagataaaatgatcaacacggcagaaggaaaaattgaaaagtgggtattgagaaaagctttcgaagatattcttcctgattctatcgtctggagacagaaagaacagttctctgatggtgtgggatattcatggatcgatactttaaaagaggttgctgaaaaagaagtaacggatgaaatgatggcgaatgcaagattcagatttccgttgaatacccctcagaacaaagaagagtacagatacagaactatttttgaagaacatttcccaagtgaaactgctgcagcaaccgttccatccgttccatctgtggcatgctccactcctattgctttggaatgggatgaagccttcaaaaaaatgaatgatccaagcggaagagcggtgaaggtacatgaaacgtcgtattagattatgttatttgtttcgggatattttaacgcagagtacgctaagatatttccattagtgtttaagaacgatcgcaaaggcgtttcacttagcaacagacaaaccgatatccttgctgaacgaagtgcccttgcgaacgaaatatatgggattaaaatataaaccttgcgaccatagcgtttatttaaccttgccaataatattaattcactaattaaaatatatatttttcacattcaaacctataaccctctcaattataatttatcaatcctgtagtaatacaggattttttcttgaattaacaataacaatatggcataatttaactcacaatccaaaataatatctaataaataattatatttggaaaacgaaaatatcaattataaaaaaatgagaagaaaccttactgttttatttgccttattagccataagtttcgcttttggacaaggaaaatatggcaaatatctgaattcaaagaagcttgctttggcttacaagagtgtgaaagaccaggataaagatgactactatcaacaatattattggcttgtaaaggcagagcagctgaaaacgtatcctcaccttaaagatataaaacctgttgttttatacgaatttgtaaaatatgtcaatcctcagaatccgacaaaaaaactggatgccagaggaaaagaacttagagcaacagcagaattatctttgaatcagtattttaaaaataaaaaatttgaaaacaattctgttttaatgtacaaccttgagacgtatgtagatccttcaaaaggccagtattatactaaggttgatccggaaaaaatcaaggaactcgtacctaaggaattatttgctttcaattcttacaacagaaacatcggagaggaaaaaacatactatctttggattgacaagaaaaaggacgatctgaatattgtagacatcattcctaatgaaaaagaggacaaagctttttataccagattaagacaatatcttcccaattataaattttcaaagtatgttcctactgtaaaaaaagggaacaaatctgataaaacagatattgaatactattacatcatgccgtttgagcagaatacagataacatcgaatacaaaacaaaggatttcaaaactttcactttaagccagtacagaaaagccggtgatgaatggaaaggagtagaaaaacctagaaaataaatcaaaaagtcctgtgaaatttcacaggacttttttaattttatatgcatttctttatctaaggatcaaaccgcttaaagcaagtggttcttcaaatcaaataagtctgggagttttttataacccagccggtacaaaatgacagaagcaaatacaccacagacatccgtaaaaaaaatacttcccttaattctggccactgctatttttatgcaaatgctggattccacaatcctgaatacttccctacccgctattgcaaaagatctgaatgagtcaccactcaatatgcagaatgccattatcagctacgttctgaccctggcagtttttatgccggccagcggatttcttgcagaccggtttgggacaaaaaaagtgtttatattttctttgatattattcagtctgggttcgctcttttgttcattatcccaaaaccttactcatctcgttatttcaagagttatccagggagttggaggaagtttgatgactcctgtagggaaacttgcacttatcaaaacctttgataaaaatgaacttctcaaagcaatgaactttgcgatcattcctgcacttatcggacccgtacttggtcctttggttgggggctacatggtagattatctttcgtggcactggatatttcttattaatatcccgattggccttctgggaattcttttgggattaaaattcatgcctgactataaatctgatgatgtagattttgatttaaaaggcttcctgatttttgcagcagcctctctcctgctttctgtttcactggaactttttggagacatacagaatattacgcctgttttacttgtatttattatgggatttcttttcctgtattattattacaaacatgccaaaagaggaggaaatcctatcttccctttaaacctgtttcaggtaaggactttccgggtaggtattgtaggaaaccttgccaccagattaggaatcagctccgttccgttattgctgccattgatgattcagattgcctataaacagtctgcagtaacttcaggctggatcattgctcctatggctttaactgcgatcttcgggaaatcatatgtgattaaaattttagataaatatggataccgtcagactttaatgatcaatacgttcatcatcggaactctgatctgtctgcttgccattcccgatatccatacttctctgtactggtttgttccaatcatcgcgatattaggctttttcaactctatccagttcacttccatgaacactatttccattgcagatctccggaactttcagaccagcagcggaaactctttactctctgtcaatcaacagctggcaataggctttggaatagccttcgggctgattgttttaaagctgtatgaaaatacagacctcatcaagggagaaatccataatgcattccggttaacttttcttacagtagggatattaacgattttatcaggattcgtgttcaggagactacatatttcggacgggaagaatatgaagtcgaaggaagaataattgtaagggaaataataaaaggcaaaaaagcaaaatcgcaaaacggcgaaatactaatacataatgcagagcagttctgctcatttgcagttttgccatttttcggtttcgaagtttttcctcttcgcttttctcctttcacgaacttaacacagatcaatgcttttcacaggcaactatggtaattttgtttacataaatcaacaatgtgatggcaactaaaaaaatagaaatcgtagtatctccaaaacctgcgcattttgtaggcgatggattcagggttcataatttcattccgggagtacctggattggatatgaaaagaatggatccgttcattatgctggattacaattcaaagtttcactttaacggatcagacagaccaagaggtgttggtgtacatccacacagaggttttgaaaccgtaacaatagcatacagcggaaaagtagagcaccacgacagcgctggcggcggcggtgttatcggagaaggtgatgttcagtggatgactgccgctaaaggagttcttcataaagaatatcatgaaacagaatgggcaaaagaaggaggaattttccagatggttcagctttgggtgaatcttccggcgaaagacaaaatgagctgtccaaaatatcaggctattgaaaactctaagatggaaaaagttgatctaggtgacaatggttttgtagaggtgattgccggagaatatgacggtcacaaagggcccgccagtacattcacaccggttcacatgatgaatgccaaacttaaatcagggggaaaagctgattttaatttccctgcccatttcaatacagctgctttggttattgaaggaagtgttattattaatggcgaggaaacggttaaacaggaccattttatcctgttcaagaatgaaggggaaacatttaacattgaagcaaaagaagacgctgttgttctgatcatcagtggtgagcctatcaacgaaccgatttatcctcatggtccttttgttatgaattcgagggaggaaatcatgcaggctttcgaggatttcaataccggaaaattcggatatctggaagattaaaagaattaaatttatcgtaatctttaattattccttttttattaactttatatgatggcaaaccttacgggtttcagaaacctgtaaggtttagctattatcatgaatatgctctgtttattctatttggaaaacagaaccctttaatgcaaaaaattatgaaacctgaatttgaaaatatacctcttgtaaaagcagaaaaaagatttgaaatagaagtcaacgggtatcacgcatttattgattatcgtgagactatgcaccagatctctttaattcatactgaggcagatgctgaactggcaggaacaggtgcagccgcagccgtagtggaaaaaacactcaattatattgaagagagcgggaaaaaacttctaccgttctgtccttatgttttcgcctttatcagaaagcatcctgaatggaagcgtatcgtggatgagagatttgaaggatatgacaaactctaaacacttcatcaattcaattaaataacatttaaaaaaagtatcacatcattatgtcaaatatcggacttatcattgaagaaaaagcagcggatatcggtaatttcctcgtaggaagacttcttcctttccgtgaaaaaagagctgtcggaccttttgtttttattgatcatatgggaccgtcagaattaaaagattatcagaatcttgatgttccgccacatcctcatatcggtttatctacattaacttatctgctggaaggctctattttccacagagacagcatcggaagtgctattgaaataaaaccgggtgccgtaaactggatgactgccggaaaaggagtggtacattctgaaagaactcctgaatatttaaggcacagtgataaaagactccacggattccagatctgggtaggacttccaaagcaccttgagcaatcagaacctactttccatcatatcgaagcggatgatattccggtttgggaggaagacggcattcagtataaattaattgctggtgaagcattcggcagaacctctccggttcctgtacacagcaagttatttttccttgaaatcaaaaccaaagaagctaagaaaatcagcatcggaaaggatctttacggagaagcggcaatgtacgttctggatggaactgtgacaacagacggaaactcttatggttcaaaacagctgatgatcgctaaagacaccaagctttgtgagtttgatatgagtgaaaacggaacggtttatcttttcggtggcaagccctttgatgaagagcgttttatattctggaatttcgtcaactctgataaagaattaattgagcaggcaaaagtaaactggaatgaccagaatcacgaggcgtttcctctggttccgggtgacgaaaacgaatatgttccgcttcctaaggctattttaaacagaaagtaacttcagcccgatttattaccatgaaaatattagcatttgcaggaagtacgtcttccacgtctatcaacagggaactggtaaaatttgttctgaaagattttcaggatgaagaaatcaatctgattgacctcaacgatttcaccatgcctgttttctctgtagatcttgaaaagaagggctttcctgatcaggctcatcagtttttaaaagttattgaggaatgtgatgttatcatctgctctcttgcagagcacaaccgttcttacagtgctgcttttaaaaatgtttttgactgggcttcaaggatcaatgtaaaagtatttcagaacaaaccaatgcttctgatgagcacctctccaggaggctatggcggcggaaatgtgatgaatacagcaaaaacattttttccacagttcgcagcagatatcaaggatacattttcattacctaaattttatgaaaattttgatatggaaagcggagtgatcaatccggatatgctgaatgatctgaaaggtaaaatacagaattttaaaaatcaggtaaaaacaaatgactaagggaagactggaggctttcagtgatggtgttctggctattattatcaccattatggtacttgaactgaaagtgccggaaggaaatagctggaccagtctcaaacctcttcttcctaagtttctggcttatatcttcagttttatttatgtaggaatctactggaacaaccaccaccatttgtttcagaccgtaaaaaaagtaaatggcagcattctttgggccaatcttcatctgttattctggctctccctgatgcctgttgctacagaatggatcggcactacaggttttgcaaaaaatcctgtggctgtctatggtatcgggcttatcatgtcagcgattgcttataccgttctggagcatgtgatcatccgctgtgaaggggaagattcaaaactgaaagaggctattcattcaaaatataaagaatatatctctattgtattttacgtcctgggaatcgctacttcatttttttatccttatattgccataggtttttattatatcgtggctctcatatggctgattccggacagaagaatcgaaaaaacattaaaagaaaattaatatggaaacacacgaatatcccaacggcgacatcactgtcatctggcagccccaaaagtgtatccactcggctgtatgcgtaaaattacttccgaaagtctacaatcccaaagaaagaccctggataaaagcggaaaacgcaagcccggaagaacttagaaaacagatagaccaatgcccctccggtgcattaagttataaattcaacacagaaaaataatggcggtaacagtaaaagcaagtttaggaaaaacaaaatattatacagaagtaacagccggcgaaaatcagatcattactgatgagccgattgataaaggcggacagaataagggcttcaatcctctggaaattctggcaacgtcactggcaagctgtacagctgctacattgagaatgtatattgaaagaaaggaatgggatgtggaaaacatcaatgtggaagtagagcttgaaaatttcccgttaacaaaaagagctgtcttcaaaagagatatcagctttgaaggtattctggacgacgaacagagaaaaagactgcataccattgccgatgcatgccctgttcataaaatcttaaccaacgacatagaaatattaaccaaattctcatagtatgatcgaagtaaaacaaaacaacgacgaaaaacacggaagttttgaagctttcatagatggaagacgcgcaggaatgatgacgtatacctgggcgggagaagaaagatttattattgaccacaccgaggtggaagaagcctacaacggaaaaggtgtaggtaaggaaatgcttctggcagcagtagatttcgccagaaaaaacgggaaaaagattatcccgctctgccctttcgctaaggcaagtttccagaaaagtgatgaacttcaggatgttttagtgaattaacactgtttccacccttacaatacaaaccttccggaatagatccggaaggtttttttatgcacttatttttatttttaataccagtttctcatgtaaaaattgtgtctgaactaaattcacgattcacgactgatcttttttatatatttgctaaaatttaaaaatcaggcatgaatccaggaactatccttttgctatttgttttcgtctattttatcggtcttttggtgatttcctatttcaccagccggaattctgataatcagtcattttttatcggtaataaaaagagtaaatggtggctcgtagcattcggaatgattggaaccagcttaagcggggttacttttatttcagttccgggaaccgtcggaaaaatgaccgggtccgaatatatttacggaggttttgagtactatatgatggttatcgggtttttcatcggatattttattgttgcagccatattacttccgctgtattataaaatgaatctgacttccatttatacttatcttggaaaaaggttcaatgtggaagctcataagataggctcaatcttttttatcatttcaagagcaattggtgctacggcaaggctatatcttgtggtaaatgttttacagattttcctgcttgaaggattgggagttccgttttgggtaacctcacttgtgcttttgctgatggttcttctgtatacttttgaaggtggcgtaaaaacaattgtgattactgatacgctgcagacctcttttatgatcatcagtcttgtggcatgtatcacttatattttatcaaacctgaacttatcttttggggaagcttacacgattctggagcagaaaaactatactcatttcatcaattttgatcctaattccaaaacctttttcctgaaaaccattctgggaggaatttttattacgattgccatgacagggcttgatcaggaaatgatgcagaaaaatatctctgtggataatcttaagaactccaagaaaaacatgcttacgtttgcaggaacgcttcttctggtaaaccttgccttcttatttctgggaggactattatacctttttgcactgcagcatggagcagaatatggaacgataaacggtgaaacagtaacgaatattttcggatttaaggatactgcaggaaacatcaaaaacattatgggagatgatcttttcccggcgctgtcacttcagggatatttcccgatggctatttccgttatttttattatcggattgatttccgcattattcccttcagctgacggagctttgacagctgtaacgagttcgtattgtgtagatctattaaaccttaacgaagataaaaccaaaaccgaaaaagaaaagaaacgtcttcgtatgaaagtgcatttaactttcactgttgttttcttcattcttattatggtttttaaagcaatgaatgacaagtctattgtttatcttatcatggagattgcagggtatacttacggaccgcttttaggacttttcgctttcggaattttcaccaaatttcagatttcaagaaaatactctattcttaccgtaacgatcttagctcctgtacttacttatctgatcaatctggcggttaccacttatacagattacagaatcggcgtagagctgattgttctgaatggcttattaacttttattggcctatggctggtaaaagacagacaacatttaagagtagcttaattaaaataaaaaaataaagcggctgttttcaattgaaaacagccgcttttatatcataacccggatggattattctttaatccacttgattgttttatctatattcttagatttaactttaatcaggtaatctcctttaaccaggtaagacaagtcgaaagtacctgttttatcatgattcagtttattatttgccttagcgaataccagtttcccgcttacatcatagattgtaatatcatatacttcatttgaattggcaaactgaacattcagcaatcctttgcttggattaggatatactacaaatacttctttatttgcagatgcttcattcactcccaatgtctgggtgatggtaaagttaatcgggctaatattatagaagacgttcgtttctgcagctaccataattctggcctgcgttgtattcacgttaggaatggtaactgtctcggaaccatcgttcggagtagaacctaaaagcagtgtaggataagtaagacctccgtctgttgaaaggtaaatatttacagtagcggcatttaccgggaatgcagttgtattagcaacattccatgttatggtttgggtagaattccctgcccagtttactgctgtagtaggtgctgttacagtaaacggccctgagttaccatctacagtaataatagcatcatcgtttgaaacccctgcgcaacctgcattgttatctcttacagtcagtctgaattccattgttcttgcgtaagaaggtctaacttctcctttggaaacagtaccattaatcacatctgtaagttttggaaaatatctgtaaggaactgttaccggaaggtatgatctgaacagcggtgcatttcctgttggagcattccagtcacctgcaggtcctacatcattctgttcccagctgtaagtaagcggattgttatcgatatcagaagcagatccttccagtctgaacggtgtacctttaggaattgtataatcaccgccagcatttacagtaggagcgaaattattggaaggaatagtcacctgacatgttgttgactgaacttttgccgtgatagactggaatgattttgtatggaaagtaggaatactgttagccgctaagttatttgtacttccacaaattcctgcataagccataatggtaatcccgcttcccggctctacagcattggctgcactacggtttccaccaccacagcttcctgtagttgcattaaaagtatgtggccctccaaactgatgccctacttcatgagctacataatcaatatcataaggatcgcctactggatttggcgaaccggtaattccccttcctttattggtactgttacagattacgcctaatcccgctaatcctccgcctccggtactgaacgtgtgtccgatatcataattggcatttcctatcagcaaatcaatctgagtctggctttcattaatcagtgtaccggcatcattatttccgttaaatggatctgaagtcgcatttgtaaagactacattggcttcatttgctaccaataccaatcttgaagctacttcctgctcatagactccatttactctgtttacagaagttacaatcgctgaaagtgtctgtgcaacagtaggagtagcagaaccggttgctgccacagcatattcacctgtacaggcaacagcaagtctgaaaactctaatttgagttcctacgcttggacttacggttttctgagcgtttttttttcctaacggagaatcgtcttcatcttttactccgcaggttcttggatttttatcaattaaatcactttttctgtaaataatataattgttaatatcctgttttgcataaggatcaatataagtatcccctgctactacagattttatctgtgcatggaatcctaattcggtaaaatccagttttatcgtagcatacttatcgtcaattccctgccctgtaaaagtaacaatctgaggaaactgaccggccaattccggagccatcactgaagatttccagattctgaattttgcttttgtgccatcaggcattggcagtacaataactggtgcggtatctttacgatcactgtctcttaattccggaacagtattaaaataatttttcattccggccacatccaatgtataggtcagtgacttttccggttgtacggttctgtttttaggatctgctttaatagacctttcactgattaccgtaaaaaaatcctgggctttccctgaggaaacggatataatgaatatccccaaataaaataattgtttaattttcatatataatggtatgtaatttttattcattttgaacatcaatcaaagaccaaaaaattttcagtcaaagaaaaataaatcaaaaattcttgaattataaaattaattaaattaatctgattgtcacataataaaattcaaaaaaaatgaatataaatttaaaaaaacaacaagaaaccttatgtttaaagcattaaagcaaaagagaatagtttattttttttctttttaataaatcgttactcaacgtatttcaatatctttgaagtggataaaataaacaagacaataaactcattaaaataaaaaaaaacagaaattaaaaaaccatgaaaaaaattattacaattttcacatttctattaacacttagctttatgaatgctcaggagaattttgaagtatcaacattaagaatcggaccctttaaggtcttcatgccaaaggttgaagctgagaaaatcgcaggaataaaactgggcaattctaacggagagaaaaaaaacatagtaaaatataatggagaggttattcagattgatctttttgataattatatcaatgaagctaatcctagtgttccttctatcacgtatatgacgacaacaagtaaaaaatttaaaaccaaaagcgggatcggagtcggaagcacaagggatgacctcattaacgcttatagaaattaccctaatttcagtgtgcgtccggattgggataaaaacgataagccggttaaggattcgggttatttcaatattgaggacagccaggcaggaaccctattaagctttaaatttgttaataatattgttactgaaatttccgtctacctcaatgaaggctgttaaaagcggagtattaaataaatcatacaaatccgggtttttatatcccgagaccggcatttccggtaaaaaattgtaaattcgcatacaaataaatcagatataatgagtaaaagtattgaagagttaaaaactcttactacgcagatcagaagagacattttaagaatggttcacgctgtaaattcaggacacccgggtggtagcttaggctgtacagagttcttcacagccctttacggaaaggtaatgaactataagcttcctttcacaatggaaggcaaaaatgaagatcatttttatctatcaaacggacatatttccccggtattctactctactctggcaagattcggtttcttcccggttgaagaactgagtactttcagaaaattagattcaagattacaggggcaccctactacacatgaaggacttccgggagttagaattgcttcaggttcacttggacagggactttctgtagcacttggagtagcacagggtaaaaaattagatggtgatcagtctcttgtttactctcttcacggagatggtgagcttcaggaaggtcagatctgggaggcattgatgtatgctgctgctaaaaaagtcgataatatcatttctactattgattataacggacgtcagattgacggagatacagatgatgtattaagtctgggaaatcttcatgcaaaactggaagcattcggctggattgttctggaagaaaagaacggtaatgatcttgaagcggtcattgcaattcttgagaaagcaaaaacagaaaccggaaaaggaaagcctgtagctattcttcttcatacagaaatgggttatggagtagattatatgatgggatctcatgcatggcatggtaaagctcctaatgatgagcagttagacacagcattcaagcaattgtacctggaagctccggctgattattaattataaatgataaattattattgataaatgattttataatatgtttaatctctcatcatttatcaatgatcaaaaactttagtaaaaatgaaatatacatacacagaaaaaaaggacactcgttcaggattcggagcaggattagcagaactcgctgacaaaaatcctaatgtagtagcactttgtgcagaccttatcggttctttgaaaatggagaaattcattgagaaagctccggaaagattctttcagatagggattgctgaagctaacatgatgggaattgctgcaggtcttagcattacaggaaagattcctttcacaggaacttttgccaacttctctacttcaagggtatatgaccagatccgtcagtcaattgcttactctgacaaaaacgtaaaaatctgtgcatctcacgcaggtcttaccttaggagaagacggggctacgcaccaggttcttgaagatatcggtatgatgaaaatgcttccgggaatgactgtaatcaacacttgtgattacaaccagactaaagcagctacattggcgattgcagatttcgaaggtcctgtatatttaagattcggaagaccggtagttcctgtattcatccctgaagatatgcctttcgaaatcggaaaaggaattatgcttcaggaaggtactgatgtaaccatcgttgcaaccggacaccttgtatgggaatctcttgtagcagctgatgagcttgagaaagaaggtatttcatgtgaggtgatcaacattcatacaattaagccccttgatgaagagatcattttaaaatctgtagaaaaaacaggtaaaattgtgacggctgaagagcacaacttccttggtggtttaggagaatccgttgcaggtatgcttgcaagaagaaggcctacaagacaggagtttgtagcggtgaatgatactttcggagagtctgcaacccctgctgaactgatgaagaagtataaaattgattctgaagctgtgaaagaagctgtaaaaagaattttagctaactaagattagtatttataatataagctccggctggttcagagaaccagccggagcttttgtttaggttataaaattttgattgtttttctattaatgaccaccgtcaaaaattctctgaatttcactccctcaccgagggatgagaatggtcatacttccatttttcatagtattagtttttatcctctttatttattactccggcggattcggaggaattcctacagcaatcagaacaggtcctaaaatttctttgatatattcatcttctctcctttcagaagcttttgatcctgaaaaataattgctgatcctgtagtttttcacaaactgatttcttttttttccaatggaataataatagccacctctttcatcattcacgaaataggccatttcatcaaaattcatgagcttcctggatagtaataattttctgtaaatgcacctctctgatttatcaaagatatattttaccggaattctgaaaaagagatcaaacagaaagtaaatcatataaatagcccacaatcctattgtaattttaaactggtcaccagatatcttatctatgaaaaagccgataatcaagggaagagcgatcactcctaatgccagccaccatatcaaagcacgcagaaaaccataattgggcataaagcttatttcacttccgttttcctcaaatttatagcggtctctgatatccattctcaggattattaaggtttaaaatatcttctgtctcgttaaccattttctgtattcctttttcggtaagagcctgtccaatcgtaagctgcttttctcttccatcaacttcaaagtacattgacagcattacatttgtggtgataaaacctagatatttggtggccaaaacatgaaaatttctgaaattttctataggataagtttttaccggaacaaaaatggagtgttttccggtaatcgttttccggtccaaatcaatgataaatttcttggtaaaaaaattgattaaaataagtactaccacagcaataataatgtagcttcctattcttacactattaaaaatcaatgctgcgatgatgagaaaaaaaatacaaagcacggatacaaataccggttgatttttaaaaatatactggtttccttcttgtctgtaaaatttataattattcataattactgttattgttctttttatattttggtttgtgattacgtagtgaaagatcatttagagacttctgaggcaattattttatcgggcttcatatttatatatttaagtgtttttttaattcgtcatacttttaattgccgcagacagtcatccagttcagacattcacttttgtatttttgatcatttagtttagtgcatcctctatttgctgtttcaaaatttcaaaacccatacttctctccttttaaaacggatggtaaaattacttttatcctgtcaaatcaacacattctattctctataggtacagccagtttcatgattatagctatctgtttttatcatacataaccatccggaatcaaaataactgcaacaattagcataggaatcagctctcaatagtcagaactctgctatacttagggtaattcctaatgttttttaattccgggtttaaatttctggtgaattaatctacaaaagtgttataacggtcaagaacataccctgcttctctttccagattatcaagatcacggttcaggtcctgattgttttcattcaggcttcgctgtacgattctcattttacccaggaagtcattgactgaattgttgaatgcctgataactgttttccttctgtttttctgaagacggaattttttcgttaatatttttgtcatataatttttccatctgctgatattgctggaaaaatttatttttatagacatttatatccgttacatcataggaatcatcaataattttctgagtcagctccataatctccctggattgtataatctgcgttttaagcggatgatctttaagcacctctacttctgctttatctgctcttggggaaagcttgctaaataaatcattggccactgtacggttttctttgataagttttattgccttttcgttgatttcagcaactttctttcctttatcatctttccagtcttctgcctgtttgtaattgtccagttcctttttcaaagattccagctgggtcattgtacccttcatcttatccacaagattctgaaaatcatttcccaatacatccggagcctttaattcctgacgggtgtacaacatcactgaaggggtaaaaatgggcataataccggaaaactgcgggtttgcatcaacattttttacataatcttccatctgtttcaatacattctgaaaatctttgataaaatctgactgctcgtcatccattttcacgactttgttattaaaagaaataatatctctgtttgcatccccggaattaacaccgaaaggatttacctttccgctatcattctgcgacagcttttctttaactttatccagtttatcacatgatataacagaaaagcttaaaaaaaagcattcctgcaatgattaatggtcttttcataattctaattaaatattaggtttttgccaaattttttgaatcctatccgataaaagaaaacttatcttcaaatatttttccgataaatggcaaaggtttttcaacattattggcagcattgataatcccgataatcatcagtattaaaggaatgaaacccaatattcccaaaactccaattttggtaaccatcagtatgatattaagaatgatggataatacaatagaaaaaagtatcagtcccaaagactgtttcaggtgatattttaaaagactgtcagatttttcccttccgacaacgaaagaaattagccatccgaaaagggtgatgtaagatacaattgataatgttttgttgtccataaccataaaattttaaattaatattctttgatttttctaagccaaaattgcgacagaaaaagttgctgacgttcttttaagcaactacaaaacatcttcaatgcagcttacggatgactacaaaacgtctacaagaataaataaaatactgatttacagaaatttaaaaacaatccgtatttcttctttttaatacaggaaattgacaggtgtctgcaatttttgtactttcaccctatgaaattaaggtactcacttttatactgtatactttttatctgcactttatatcctgcacagaatacatttattgatggtcttaaaagccaattgaatgaagatcatatttctgttgcagaaaaattcagaatttataatgagcttaccgaatattacagagtcagtgatcaatattccatagctgaaaaatatgttcagcaacagctggaacttgctcaaaaggaaaagaattatgctgaagaggtaaaagctcttagtcaaaaaggagtcattaaacttaatcagtctgaatatgacaaggttccatctattatagatgcggcgaatgcaattgttcaaaagagtaataataaaactgcggaattatatgccaattatctgaatatctattacagaaacgcgcttggtgaacttgaaaatacaattaagctggttcagaaagttcttcccgttgttgaaaaacaatcttctgaaatcttattaaatgcaaaactgaattatcttctttatggaatttatacagaatggaacgatgcggagaacgccaccaaatatgcaaaaaaatccatagagcttgccgaaaaagcgggaaacaaaaatctacttagttctacctattcggcgctggctgtctgttattctttccaatatgaaaaaagcggaaaattacaagatctgaaaccagtcatagagatgtgtaaaaaagctgttgccttgtaccatcaatttcctggtcatgtctcagcccatgtacatgcaatggcattactaaaccttaccaactattatctgagctatcctgttatgactccggaaatccgtacagaaattcaaaataatgccaacgaaattctgaagcttacacagcatacaactcttaaccaggggatgcaggctggtgcgcttggtatcttaagcaatctggcatcacgggatcagaatgatgctttatcagaacaatatcttttaaaagcagagcagattcttcttacgcaacagccggtttattaccatgtcatgatcaatgtggtaaaaaaccttgctgagctgtatgccagacagaaaaactacaggaaagcatatgagtacgaaacaaaagttacggaatacagcaatcttctctttgacgaaggacaggcagaaacggcaaaaagattggaagctcaataccagtctcagaaaaaagaatctgagctcaagtcccttactgaaaaaactgccagcctgaaaaaagagaagctgttatacatcggtttgggaatcattggattgattggtgctttctttatgttccgttcttaccattttaaactccggtattctatagaaagagaaaataagcttgatacggaaaaacacgaagcagaaatggagattaaactccagcaagaggaacaggcaagattaaaagccgaacaggcgctccttactcttcaacagcaaaagcttcaaagtgaggtactggccagccaattgcatattcagcataagaatgaggttctgcagcaacttcagactcagctttccgatactgatattaatattcatcaggtggtaaaaggagaaaaccgagttgataatgattttgaaaagatcagatttaccatccaggaactgcatccggatttctttaaaaatgtcaatgaaaaagctaagcaaaaacttactgctctggatttgaaatactgtgcttacatttatcttgggatggatactaaacagattgccaatttacttaatgtggaacctaaaagtgtcagaatgaccaaataccgactaaagaaaaagttcggattagatgagaatattgctttagaatccttttttcagagagtatttctcggataatcaacattttatttaaacaacaacagccttttaacataaaattaaaaggcttatttttttccaatttaatatcattttttctactcaaacatataaaactgatattttttgtcaagatttctatgatgttattctcagtttttagattaaaaaccattattttttttgcaaataatatgcaaatttgcttggaaacgaatataaaaacatctgattttcgcctcttaattgtatttatttgtcatattgtacaatagaatatattactatacaagcctctgttaattttgaggttttctcaatattaactgcatcactttatacttttcaatgtttgaaatatttcaccaaacgtgctgaaatatacacaatttgcatatgcatgtgtgtacaaaaaataaacaaatcacttacaagttttatcccactgaagtgaactgaatatttatagatttgaaaacatcaacgttgacggaatgcatttccatttttagattgtatgtgtacagtacatgataaacatgagaaaccattcacccaaatgtcagggtttatatgacacaaatgtttacacaacacaaaaaacgtatcaaaatgaaaaaattaaatggaatgaagggtagcttctcttctgcagaaaacaaaaagttacaaagaaaagacttaaaatcaattttaggtggtgatgattataaatatgtagaaacagattgtggttctagctgctatgataaagagacatggaaggacggagttcgcatcagtactctacaaatagatacaagtcttgattaattctaatacagatagagggttatccctctatcttttttatcagatatattcatagagaattcatgggaaaagatacctggcattatccttcttacgcttttatagctataatttttactcttgcagcttgtaagagcagaaattataactatataatctattataataaaatcaatgaggccgacagtatacttcgttttcaaaaggatacaatggctgctgttaaacaatataaaaagatattcagacaatatcctcccaaagaccaggaacggatcaatgaatatgaaaattacataagactttcagatcaacatcataaaaattttggtgggaagaaaagtctttacaagcttattccgttagttgcacataattggaaatataaaaagcaagactccagcttcatacagctctatcaaaaatatggcattggcaggcaggaaatagaatttaaagttgaggaatggaaaagaggacttaatcaaaaacttgtagattcttttacagtcgcgtttaaacgtgatcaagacagccgtattgattcaaattatgcagatatcaataaaaatgataaaaagaatgctgaacttctgaggtggatgtttgagaattatggtttcccaagtctgcaaaaaattggtttatcaaatggtgatttctttatgccatcaggacctatattactacacatggcagattatgaagagtattacccatatttgaaaataaagctattagagtatgtaaaatctggtgaatgtcctccaagagattatgcagcgatggtagacagaaataatctgcaccataaagttccttatacctatggcgtttatcaaggatatgaaaatataaaagattctgcaaccgtcaaccgtaatcgtaaaagcatagggctaccgagcctaaagcatgctcaattgattactaaagatttcttcaaaaaaataaaaaagaaaaattgatacttattatttctcaaaataacgaaatcaccactacagaagttattaaatggcttctgaaagtaggaaaaagctttatccgggttcatgaagatgaaatttttgatattaagatcaaagaaaaacggatttatatacaaagcccgagaaattgtttttttattgatgaaattaccagtgtatggtatagaagaggagaattgaaatttaaccgtctgctctataagaattctgcaattaaccttaatatgaatgaatatcagcactggctggaagattatgtaataaaggttttagagtcgaaaaaacatatcaataagcaaagtaacagtgatattaataaacttcttgtacttgaagaagcacaaaaatcgggattagatgttccttattattttctggctgataatacagagaatgttattttaaataagacaattattaaaactattggcggaaatccaagaatggaaagcatactcaaaaactccagtggtatgatgtatacaacaactattcaggaaaaagaagatgaatttttttttattactttcttccaggaaaaaatcgaaaaagatttcgaaataagaagtttttatctgaataaaaagatttggtccatagctattttttcacaaaatgacgatcaaactaaagttgatttcaggaaatacaatactaaaaagccaaatagaaaagtaccttacaaccttccgaaagaaattgaacaaaaaattcatctgttaatgcagtctttagacctcaattgcggttcacttgatttcattaaaagtggcagtacatattatttcctggaagtcaaccccgtaggtcagtttctgggaatgtcagtcatttgtaattatttattagaaaaagaaatagcagaatatttatgaaaagagattttactaaaaaagaaaagaataaacttccactaacctttaaatatattgatgttgtaagcagtaaaagtcgtgagaagagatatttcagcataacaatctcctgtgaaaaatatcatactgatttctatgcaaaacttaatccttataaatttctgacgagattggtatagaatattttaacaagatgctcaaagaatgttattggttttgatatatggcaagtggtattcagatgatcagaaaaagaacttaatcttcaagtatttattaacttatgaactatttcaacctattcagcaatatcctaatcacgaaaggtcctacaagaattctgatctcggatctgcagagaaatatatcagaactgtatcctctggaattgtatgaaattattgtagagcttaaaagctattctattgaaactatactgaaaaattatgatcaggaatccagatcaattgttcacgaatatattgatcttctgctggaaaaagaatacggatttattactgaaaatgactgggacaggaatttccctcccctttctttcgaacatcatgaacccagcaccataaccaatcttttcatagaaatggcagacacagggatcctgaaaaaaatatatacatcagtagaaaatctgggaatcaaacatctggtgatttatagtttaaaccctttaacctcaaaagattttatagaaattgatacaatatttaaaaactcagtcttatcaggaatagaagttttttcgccgtttcatcaaaaaatcaacctatcttttgtacaggctcttcaaaaaaagacagtcagattatacagtcttatcttctacaattgttcgaaacctcctttcaaagctaaaaatgaatacaaattttcgctgcattttctgaaagatgatctgaaaatatctgcctgtggaaaagtggaactaaagtacttcaacaccaatactcctaaagtcattgaagcaattaatcacaattcctgcctatataaaaagatgggcattgacaaaaacggcaatctcaaaaactgtcctcttatgaatgaaagttttggaaacatcaatagtcaaaaccttgaagaaacagtaaaccaaccaggtttcaaaaaatactggaacttgacgaaagattatatagaaacctgtaaagactgtgagtttcgctatgtctgtacagactgcagggcgtataccgaaaatgctgaaaaaaacaaagaaggcctgaatatatccaaacctttgaaatgcggctataatccttatacaggagtatggaaagactggtcaaaaaatcctttgaaacaagaaatttttcattctctggaactcagataatatgttctcttttttattattcaaaaaccgcttttaaatgttatttaaaagcggtttgttatcttattgcaattgactaagcttatttaaaaaacttccatttcgggataatggcaagcattccgaatcctgtgaacagaaaaagattggtaacatccgtatacaggaatgtagacagataataattgtgcataaagaaatgcagcaccagtaatgccggaaacataaagatcccaacctttctgtaaaagaacatcagcaccagcccgatcatcatcagtacatcaatagaaaagatgacatagaagtaccaccttggaatctgaaggtattcatgctgcagatactcatccacatctatcccaagccccattacggtaaacaacatcaatgcggcaaatgcgagtataaatccccaccctttcttcgggtcttcatcaaaatagctgtattcttccatacctgcaaaaataaagaacttatgagagatttcataagttcttttataattattcgtttaaaatttgacttacacagagattgcgttgatcagtctgtttttgtcacttaagaattcctccatagagatcatactttcagttctcattacatcctgaatgtcatcgatctggtaaataattcttttagcatcatcagtgttcttagctcttactttacagaaaatattatattttccggaaataacgctagcctcgattacgttaggaatagttgacaattctttcaatacttcctgagtacggtttgattttgtcaaaaggatacctatgaaagctgtaaagtgataatccagcttaccataatcgatgttaagagatgatcccaaaataatacctgcatcttccatctttttcactcttacgtgaattgttccagcagaaacatccatctgctttgcaatttcagtaaaaggcattcttgtgttttctactaagaaatcaagaatcttcttgtctatttcgtccagttgatagttcatattagttaaattacaatttctttaaaaaatctatgtattttttgcaaatttacgaaaaataatttaactaaaaaatatatatcaaatattaacaataattaacacagatgataaaaatcattaaaatattctaattatttaccttgcgattttatagaatctgtttttatttcaccttttgcctctgaagtttttttgtcttttttcttctttttaaacaaagaattgaagcttttactccacacaacccctcctccataggcctgattagcagaaccgtttgtactcaccattcctatgtttgtaggcttggaataagcacgtatcaccagtgagccatcattctttttagacaaatcatattctactgatccttctgtggaaaggtaattgttttgtgcaccatcggttttggataacggaatacccaaccctgttttaatattaactcttggagaaacggctacacttaccccggcattggctctgtccccaaaatttgaattctggtctcctttcacataattaaggtcaatctggaattcgttactcatcgtattaagtacagatcccagctgtttcaggagcatattatatcctgaagattctgccacgtttcctacattcacatcgaatccacctgtattggatacgttaaaggtactcaacagcaatacagatccgaactgaagaactttctctccttcctggctcattttcgcggcaagggtttctcttacctggctggatacatccatagcagtcacattaaggtcaatctgcggatctaccaatgattgggtaatgtgcgcctgaagcaatatactgataggctgtagtttccccaggctcagatattcgccggcattggaaaccattctgatgtaattggcattaatatccaatgtaggcttcatcgcatcaccatcccatctgatgctgctgtttctttcgatctggaatgtcttattaaggatagccttggaaacgaatgtaccgttatctactttataggtaccgctcatggcaatatttccctgtctgttcatgtggaacctcagcggatctgcagatccttttacggtaatatttcctacatcgtcaccaaccagtacatttacagtggttcccttatctacagccagattaaaatcaatattcatattggctcctgttttcttcttttcttccagggtaatcaggccgtcttttccttctttcaggaacctcagcattttgaattcttctacattggaagtagaactggaattaaaggtaaaggtacttccgttaagtgccttcatattaggagtggttatactcaatcctgaaacagggccgtcaacatacaggtctccctgcccgtaaactcttccccagaacaagtcaaaatctttttgtgtcgtattcagcatcaacagattgtctgccctcattacgagtgacacccccatggaagaaagggtttcaaactgaatcgcccccgaaacatttcctttggaattggttcttccatcgtgcacttcaatattgttgagaatagcaagtcctctggacagctggattaccgtatcatcaaatgaataatctactcctgtaaacaaaagttttaaaccaaaatcttttaaagcaatatcaccgctataatcaagatcgttaagttttccattgattttaagatcccctgtagcttttccacgaaggtttccaaaaacggtctgtacaaactgctgcgtaaatgaaagatcaaaatcacgcatttctgcattaagatcaatgatcggagaagatgtattattattaacagttcctgtcagattaagactgttatttccaaggactcctgcagagtgaacttttacatcaatatcataaacattcaatgagaagccattggttgcagaaatagagatatcacccatatcattgccattcatcttaatattatcgatattaagatctaccagcggctgaagggtacttttatccattttgatcttcacacttccgttagcaagaccttttatatccatcgtatttcctcctgactgcatttccagcagtttttctacagcaaaatcattgatatcagcatctacataaaaatctttagctgatttaaactgtgcttctttaataaacaaagcacttttatcggaatataccctcaggtttctgatatcaaaatcaccggttttccttctgtaagtaatagaatgattcagttcgggacttgtatctattgcccatgtaacttcattgaattttacttcagtaggttcaaacctgaatacataatcacccgctgcatctgtagactgatccacattaatggcatattctttaagcttttcattcagttcatcatccggacttccatgtttgaacacggttgctaaatgaagtgtatttccgttttcattattccctttaagttcaaaatccttgatcacatttttattatagactactctattgatcttagcatacaattgctgattaaggtctgccgtgttaattctcactttaacactatccaccagggcactgtctctgctgatatttttcctgtcattgactttataatcaggattggaagctgccagcgccttatcagcatctgtaatttcttcctcttttgtcatgatatactttaaagaagccgcatcaagattcaagatcagattattggaatttccatcatattctccttctacaaccgctccctgaggcaacctgagatccggcaagaaataattgactaaaccttgctggacatcaaacttaagggcgaaattctgtccacgatataatttccttggcggtggaccaaccaatatttttcctaatccgttttctaccattccggcaagatctgccaggctgtatctccctgaaattttacctgtggcagctcccggagcatctacatctattacgcgggatcctgcttctataaatgtttttaacttagcattcggaatattatatttttgagtagcagtagcaaagtgaagattattggcattcacatccaaagtaaggtcattaatggaagacatagccattttcccttcaacctgtccacttaccacctgagtaccaggtttattggtaaaataattcatattcagataagtgacatcagcattaacatccattgctactcttgaagtactgaagtctatcaatcctttgaccgtagcttttgcctgttcatcattaacggttataagtccgttatattttttatgatccaacagcccgtccagataaaggttgttgatcgttttatccataatttcaacacttgcaatctgagatttcgtagtcagacgcatggtattgacatcaaagctttgtccgttaagatcaaatttaccggaaatcaaccccactgttttattcttggtgatcacagaggtgttaagatcttttacatcaagatagcctgaatattttggcatagctgtgctgtaacctgtcagagtaagcttggagatttttgcctgcccaattcctgtcatcagatttccgttatccacataaatctggtccgggttcacttttgctgttccgttgtactttagcttcccgaaatcatcagcaaaattcttcatctttttggagataaatgaaggcatcattgctttcagatctttgtaggtaaaatctgtggaaagatctttcgtttcgatagcaaaatgtcctttcagcagattgtcaaccttcattgttttcgtggcaatattcacatcagggtttctgatcaggaagttttccagatgaaacttgttcagcggaccagtcattgttcccgaaagattgaatggtttgatattatcccagtttgttacaaaatagctgatatcataaccgcttaactggcttccctgcttgatattcatatcccatcgtaccttatcggcaaaatctgcccatgagccgtcatgaagattgaatttgatatctccctgaagcaaggtatgatctgtattcagcgtaaggtctttcagtgatagaaactgcttcgttaacgaaagttctgttgaaaacgtatctacaagatgggcttttccccatcttgaagttacaaacgacatattattgatcagcgccgaaacgttcgggccattgacttttacattgggagcttttaagttgaattgtgttgctgtaagccattttccctgttcgccgggagaattttgattgacaatggaaactttggagtccataatctgtattctggaattcagctgaaaaggaggttttttcggatctcttttctttccgttgtcaaaaagttctacaaaccttacaaaattagaaatactgtctcctttataggtaattacttttatatcggcattgacaagtgtcagagaattgaaacttaaagaattactgtttccggaaatggcatttacggcaagagacatccagtctgagtctgcccgaaattcacgggctgtaataaaattaaagcctttataatcttttacttttaagccttttatggttacgtctccgaaataatttacatctacactttctgtagtaaaatcagatttgaaatcattattaacaagcttcagtgcctgatcagctgcccattgctttgtcaccggaagattaatggcaataagtactcctccaacaagcacaattccaagccaaaagagaatcaggagaagttttgcccaccaggtatagctggtaacatctttcacagcctgcttcccaaactcttcagctgtttccacaggatgatgtatggcatctgaagccagttcagatgcttctttcactgtctcccgaactttttcctctacattttcgacagttttctgtacctgattacctaggttttcagctactgattttttattctcattctcgttattattctctaactttgccattattatgagcgactctataattttaggtattgaatcgtcctgcgacgacacctcagcagctatcatcaagggaaattctattctttcaaacattgccgcgaaccaggccatccacaaagaatatggtggtgttgtgcctgaattggcttcacgggcccatcagcaaaatattatccccgttgttgaaaaatctttttccaaagcaaatatacaacaaaatgctatctcagctataggatttacacgcggacccggacttttaggatctcttcttgtaggaacatcatttgctaagtctctggctatgagccttaacgttccgttaattgaagtaaatcaccttcaagcccacattctggcccatttcatcgaagatgcaaatcctgtgccgcccaactttccttttttatgtcttacagtaagtggcgggcatactatgattgttctcgtaaaagactatttcgatatggaaatcattggaaagaccatcgatgatgccgcaggagaagctttcgataaaataggaaaaatctttgaccttgattaccctgccggacctatcattgacagactggccaaagaaggaaaccctaatgcttttcaattcaacaaacccaaactggagaactatgattattccttcagcggaattaaaacttcagtgctatatttcattcagaaagaagtcagaaaaaatcctgattttatcaaggaaaatcttaatgatctttgtgcatctgtacagaaatccattattgagatactgatgaataaacttgaaaaagcagccaaagacctcaatgtgaatgaagttgccatcgcgggaggtgtttctgccaattctgcattgagaaaagctatggaagacaataaagaaaaactgggctggaatatatacattccaaagtttgaatatactacagataacgctgccatgattgctatggtagcaaagctgaaatttgaaagaggagaatttacagatctcagaacaacggcaacggcaaaatatgatttataaggatgcggagccacgaagtggtgacgtaaaaagcaaagggttttagccctttgagatagagataaacaggctaattgtaaatagctacaaagtagcgggataaaaatgggacagtctcttgttaaaaattatgttcatattgtattctctaccaaaaacagagaaccaatcattgatgaagaaatacaggaagaattattttcatatctggcaggaatctgtaaaaatatggagtgtaatcccgtaaaaatcggaggctataaagatcatgtttacatcctttgtcttttatctaaaaaagtaactcttgtaaagcttttggaaagtttaaaatctcattcttcaaaatggattaaaactaaagataaaaaatattcgcatttttattggcagaatggctatgggtgtttttcagttaatccaaaagaaatagacactgtaaccgaatatatcagcaatcaaaaacaacatcatacaatcaaaaatttcaaggaagagtttttaatgtttcttagaaattataatatggaatttgatgaaagatatgtctgggattaatatttcgctctttcagagctcagataaacaaacattaattcagacaaagacctgcagtctttgctaagtattgtgccacttggtggctcttaaaaaaaataaaatgaaactattctacggagaaatcaacggaaataacgtaataatcaacgatgaagagcagcagcatattgtgaaagttcttcggatgaaagatggagaagatattcatgtaacagacggcaaaggaaaactggcttccggaaaactgattatagaaggaaagaaagctggtattgaaatttctgagatcaaagaaaatatgcctgaattcaatcccaggcttcatattgccattgctcctaccaagaatattgacaggatcgaattctttgtggaaaaagctgtggaaatgggcatttctgagattacgatcctgcagactgagaaaacagaacgtaaaaacgtcaatattgataagatcaggaaacaggctgttgcggcatcaaagcaaagtttgagatttcattttccggttatcaatgatttaattaaaattcaggattttctgaaaagtattgatccggaacatacatttgttgcgcactgtcatgagaacttagaaagaattgctctgaaaaatattcctcagctagaaaagcttacatttttaataggtccggaaggtgatttttccgaaaaggagattgcatttttagcagaaaataaggtaagagctgtatcacttgggaatcaaagactgagaacggaaacagcaggcgttttcgtagcagcatggaattattataatatgatataaatatgaagagaaggttgagcaaccttctcttctttatttcagattgactatttccagtcaatattattttctctcagatatttttcaaagatctgctgtccgcttctgattgaattgacagcccaaagtattttcattcttaaaagcttttcttcattcaatttataatcaatatcagattttataagcttctgcttcaattcatacatacagattgaagctgccacagaaacattgaagctccttgtaaagccatacatcggaatagccaatgtttcatcagcaaaatctaaaatttcctgggaaacaccctccatttcagttccaaaaaccagagcaataggttcagttacttcatattcaggcaacattttagcattcttttccagtgaaacagccactattttatatcctctgtctttaatattctgaaaagattccatattccggggaagcttttctacttcaacccatgtgtccgccccttttgtgacccgaagattgggttcaaaactgtattcttcctgcaaagccactactttatggaaaccacaggcctccacagaacgtacgattgcagctgcatttctgaactgataaacatcttctactaccggaagtacaaaatctgaactttccttggaaaaatgttcgattttcgtcagtctttcttccgttaaaaattgttttaaatattcataagtttgcgataaatcattcatctgcatttagttatttttttcaatagccctatgaaaccgctacaattttcattttatttttataaaatttcaagataagcgtttcattcattttcaaatctttgcaaattaacgtaattttgacctatgaaccctaatcgggctccaattcttaattaaaattagtacatgaagcgaaaagtcctgctcatctataccggtggaaccatcggaatggaaaaagattacgaaaccggaagtctccgcgcctttgattttggaaatatattcgaaaagatgcctgaaatgaggcttatggaatgtgaagtctttgttcatccttttgccaaaccgctggactcttcggatatgggacctgaagaatggagagtgatcgccaattatatccacaaaaactacaatgactatgacggctttcttattcttcacggaacagacacgatgtcctacactgcttcagcactgagctttatgttgaaaggattaagaaaacctgtgattatgactggttctcagcttccgattggtgatctgagaacggatgccaaggaaaatcttctgaccagcctttactatgccagcctgtatgaaaacgatgaagcggttattcaggaagtagccatttactttgagtacaaattattaagaggaaacagaacattgaaatattctgcagagtattttgatgcgtatgcaagcccgaattacccgattcttgggcaatccggagttcatttgaatattattaaagataacctgttccgttgtgatccggaggtggaatttcatgtggatgagtatatttctgaagatattttattctggagaattttcccgggtatgcatttgagccacttcaaagaaatccccaaaatgaaggttctgatccttcaggtttttggttccgggaccattttcagcagtgcaaaaacacaggaaacgcttcaggaaatcagaaataacggaactgaaattgtggtggtaagtcagtgtatttcaggaggtatttcattcggaaagtatgaaaacagtaatattttctcaagaatcggagccatcagcggaagagatatgactgccgaaactgcgattactaaagcaatgcaccttattggcaatccaagctactccggaagcttcgcagataatttcaccaaaagcctttgtggagaaattacggattaatttgtaagaataatttggatattaaagaaaatacactatttttgcaatctcaaaaagaaaggtgtccgagtggttgaaggagctaccctggaaaggtagtatacgggtaactgtatcgagggttcgaatcccttcctttctgcaagaaaagtcttaagtatatacttaagacttttatattttatgctttaatttaaagcttaccacttagtgtttttaaaagctaaaactcactttttacaacactttagaccaataacaagtcatttttttgccatagcaacaaattttacaatgtactactcaatctccattggttcatattgaatattttgttgttttaatactattggtgtcccatcttcattataagccttaccagtataaaaagcattaggattctctttataagttcgttgtacatttctaaacttttctcttgtagtccttaatatacttttctcatttcttagataaataagcttgggggtttttgtaattcccactgcttcaaaagtatatttcttatcagtatcttcaacttctaaaattaaaccaggtaatcctccaaaaatataaggtccattattaataggtatgccagtggtgtaccatgcaatgtaatttcttcctctatagctaactgttgccttattacacttatgccctagtaatattttttctcctttctctaagttccagttaagttttggttggtcttcctcatattgatatatagatttgaacctctcctgaactgtcattatattattatttttgaagattatattattccataaaactcttattttcataaactcacccatttctttagagccaatcatgtcctgtttactatatttttcagatagtgaatcctttttcaactgattataatctaagaatttagaaacatgatctcccaactcaagaatacacatcacctcttttttgctactaggagagagggcattatctaaaaaatttactttatagtatatattatacgaacttgttccataattagccacttcataaggagaagttttaattgaaaaattcggcgaaataatgccctgcccactaatgaatacaataataaaagaaaatataaatagatagaatttcataatttcatataaataaagaatcagcaacttaacagttactgattcatggttaaaataattttttaatattacgtatactgaccagtaaatgtagatgctccagcacattgttgattagtaaactgagtagccgccgcatctagctcctcaaaactagaataatcacctgcatccagataaaatacttttccacaccaagtagaaactcctatccaattataaaaagcagcttttactttattagaagtattgctattaacagatttattatcagtagtttttgcttttctgattactttgttatcagcactacctttagcactcataaatcctgctacaccaagagcagcaataaagaatatttttttcatcgttaaaaatttaattattaaataaatatttcagattgcaatctgcatcaattttattaaatatttatattattcacaacaaaaaatacaaatattttattatgttaaaaaaaataaccaattttaatatacatttcataataataatttcactaaatacaaacaatactaattacaccattaattaatttcgatgaattaggattattttctaagtatttctactcatccagataattggtaatttatacgctacactatttgctttgttgttcgttactttgaagtataatctaatcaccaaaaaccaacttaattatgacatcaacaagtgtaaatgcaaattcttcaggtcagttagtactcggaaacggagcacaattctgggtgtatctttcaccgcaaaatgatacctctaaaatgatctctacatggcgtgttaccttctcgcaaggagactggagtgactttatctcaagtgagaatccgaccaaacaaatccaaacccctaatctttcagggatttttgatatcagagtagaattattaagcgggtctaccggtacatggcgtcagatccctcctcaaacaggaagtcacaatgaaataggttgtaattccaactgtgcttctatggtaggcattgttgcagacagtaccaaccctcctatcggagccatcaatgcccatttctggacaacatgggatgcgatgtgcggagtaagacaaaactgataataaacagtccataaaacaaattgccacaatatgtagaatattgtggcaatttaatttcaatctggcaatggatatttacaataaaaaagaccggacttttaatccggccccttataattgtacttatttaaaactttaaagaaacacttccaagaaaacgtgacggagcctgtggcgttaaacgtacagaccatgctttttcattggtaatattatcgaatttcaggcctactctgtattttggctgatcatagaaaattcctaaatcaaacattttgtaagccggaataatcactttagccgtttgtgtattggtttgataggaagaggatcccatatttccaccaccgcctattcctaagccttttaattttccttcaggaatacggtagctgacccagaagttgaacatattggcaggtccggacaatgcaggccttaagccatttaccgaaggattggcattggtaaatttactgtcattataagcatatcctgcaacaacattgaatccatcaaaaggacttgcagtcagctcagcttcgaaacctttacttacctgtgttccatcctgtatggaataattgatatcatcaggatttgttcttaaaatattatctacacggatattgtaataacttaacgtacctaccagtctgtggttaaaaatatctgcttttactccaaactctaactgattggcatattcaggtttgaaggtattcccgttgatatccgttccgcttacgttattaaaaccgttcataaagtttccaaacaaggaaactttatttttcaatatttcataaacaattcccattttgggtgaaaaagcggtctgttcataaggtcccgattgtgctccactgctgcttaagccacctttgatttctcctgtggttatatcatacactcctttgaactgaaaccggtccacccttaaactcgccattaccataagctgatccgtaatattaaaaacatcagaaacataagcagcataggtattatcactgttgttttcccttctgaaggctgaagtagcggtaagtgcatctatcgtattgctattcactctgaagtcagtcgaaggatgaacaaaattaaataccttggtattggtatggtaacggtcaaaatgattggagttattataaaaatccaatccgacaaccattctgtttctgaaacgtccgatacggaaatccccgatgaagttctgttgaatattggtagcaataaatgaagtcgttcccaccatcacctgagcgcttgctgtagaatctgttttcccgttgatggcagaaatatatccgttaatggtagatcttgcgcgggatagtattgtttgagaagtccagttttctgaaactttataattaagctgggcgaagatgttcagcatctgtgtttcgtaagccagatcatcactcaggaagtttttataatacgggaacttcatatcagcaatagactggattttgttacttccggtataaggattaaatcgtacaaccgatgttccttttgcctgattgaactctacatccaacaggagcgacatacggtcattgatctgataagaaaaactgggagcaatagccagtgagttggtaaatccgatatcctggaagctcttctcggtggttcctgccgcattaagacgaaaaagagctgttctgtccttatttaccggtgtattgacatccacagtcagtcggttataattccagcttcctcctacataccctacttcaccgccaaaattattgtaaggttttttcgttaccctgttgtatactcctccgtaactgctagccacacttttcccaaataaggtagctgaaggtcccttaatagcttctatacgttcaaggtttacaggatcaatcactgaaaatgcagctcctgcaactccatttcgggcattgggttctgtttcaaatccccttgagcggaatgtcactcttccctggttggcaatcataggaactccggcacccggtacgtttttggaaatacttcccaaatctacagcaacctgttcctggaataattctttggtaaccgtattgtatacctgaggattttctaaatttttcaaaggcaatctggctacaaaaccgctttcttttttcgaaaaacggtttgtatttttcattatgactacttcctgtatagcctgtatattttcctgggtaagctgataatccagtgttgttgtttcaccagcttttacctccaccgggaggcgcacttctttagctcccagaatctgtaacttcacagtataagaacctgcgttcaggtttacaaaatgataatttccttcgtcatccgtaagggtttgccgattcgcttccggcaatgagacagatattgccctcaatggctgtccgtccaccatatttacttttcccgagattccgccctgcagattctgtgcttgtattgctgttaaaccggttagtaagaataataaaataagaaacggctttacgcattgctgattcttggttgaaatatcattctgtcttgtttctacggaatgaggcatatgcttcccgggaaacatacattcattaggttgtatcattttttcagccttatttaaagtgattataaataaaggtgcaaaataacggaatcgaaaactctcccacaacattaatttgaattattctaaataaatataaaaatatagcttcgaccttaagtaaatttttatagacttaaataaatgtttaggagattatttacttttttaaaaattgatgaaattaacttttccacaaactgctaacatattatccacatcttatccacaatccgttttaaaccctattcctaattctatcctaaatcaagttcttgttttgtctcgtttttaaacagtattgaaagattttgaataaacattctatgaaccagacttataattttgctgtgataaagtattctcactatgtaactgcggtattctcttctatcttacggtctcgcagtcatttaaaattaacagtaaaacgactatccgtcatattgggcatgaagaaaatttttgcaggtatattcttattgggatgtataggaaccactatcaaggcgcagatcagtccgccggggctgggagacgccaacaatgcattctggggtgcctttggagttaaacagcagctggattctttagggaaaaagcaggctttgagctatgttgccatcgggagaaaaagcagcccggataaccataatttattttcaaagcaggctatcattgttttgaatcatgaggtataccactcttttgccccgcatcagcaatacagctatgcactgagttaccgcagacaaccccactatgagaataacactccttatgaaaaagaaaataccgaacaggaattcaggatctacggaagatatgcttacacttttgatctgggaaaaaagtggaagctgaaaaatacggtccgacaggaattcaggaagttttttgacgcagactttcataaagcagaggaagattttcagctcagaacccgtatcaagagtcagttaacctataatttatctcctaaaaataatcagaagctggctttaagtgcagaagcattgttttccataagtcatctcaacgagccggatgctgaatggagtgcctttggatatcgtgaaatgcgtattgccgcttattatatgtttacaatcccaaactctccttttacagtagatgttggctatatggatgatctgatcagagacagcagaagtattcatcatggaggcgttcattatcttgctgcagacctgatctggaatataccttacagaaagaaataacaaaaaaaccacctttgtacaaacaaaatcccgatcatcactgaccgggatttttgttgaaacataagtttccttgcaatataattaagtatgaatgtttggtgtaacgtttagttgcaaagcttcaggaattcgcggctcatctgtacattaaatttagcttccgctttggagcgggcgtaaatcgtatgtttaaaagcatgtaccattttcagtttctggtcaataaattctgcaatctgcaccacagagaacaggaaatccctgtacaccgccatattgaccgtctgcccataatacggaaggtacgcttttaaaaagggtattgctttctgatggcggttatagctgatgcaatatcctaccccttctactgaggtaacaatagcatagttattaagataatcatgaatatttttgttaccgtccagagcctgaggattttttgaacaaaacttattgatcttatccagaatgtgctgggcgtactccatcatggagatatttttaaattcaaaaacctgattcatcctgttggcgggtgaggtttcgttttcgcaatcaatacagaaagaaatccctattttttcatggtaaggaaaaaagcagtctttcacttcaatggaggcatccggctttaacctgtcatctgtaaaattgtaatagacatatggactgtaaagttcagcaagcgcattcaggtagtctgtttcgctggtattatgatattcttcaaaccatttttcaaggttgtcataataattactttcgaagtcgttaaagtttaagtaaaatggcaattccatagctctgtaattttgatatgacaaagctatatccgtaatgcgacaaaacttgacgcaatatattttttgtgaaaaatttttggttaaaggtcaatttttgattcgcaaagtcaatcctcaataattattaacgctgatgttctcaaagtttattaatatacatagcttatttgttcgcaaaggcatttcatttagcagagagacacactttttctttgctgattgaaacgcctctgcgatcgaaaaaaataaacatcataaaaaactttgcgaacgctgtgtttaataagatgcgaacttattaaaattcacaagcacagcgaaccgaccgttcaccattaacatttatttatcataattcttcatcacatactcaaagtaatggatcattttcagatagttttcgatgctgagatattcattggtgctgtgaatactttgctgttcggcactgttgatcttgatcggcatgaaccggtaaacgtttttacttacgatttcatatttaccagcatctgttcctgccatggtaaggtatggcgtaacaatcgctccgggatgaatttccttaacgcctgcttctattattttaaaagcttttgtattggttggagaaatagcagaagcttctctggtattgtcaatttcttctacttccacatcaaaaccttcagtggctttcgcaatatgatcttttacatctttcactgaatttccgggaagcagtctgaaattaaccacaaattccacttcaggagaaagtacgttggtcccgtcacttcctttcatcatcgttaatgctgtggtggttcttaccaatgcattggtggtattgtttttggtgagctgtgagatcaataccggttttaaaagccattgattggccagcgccattcttgtggtaaaaggcatttcaccgccaatattattaaagaattctttgattagaggggtaataactggtttcatctgatcatcctccaaacgctgcatgatgacagctgctttcccgatagcactttccataggaggcatagaggaatgtccgccaagaccttttacttttatctttgcggacaggaagcctttttcagcacatcctactacggcaacatcagtatcaattcctgctacatttccttttctcatgatcaatcctccttcgtcataaacagcatcgaatttcaatcctttctttttaaaataatctgcaatctgaacggctcctttttgcccgcccacttcttcatcaaaaccgaaagccagataaatatcacgctgaggaatctgtttgtttttaatcatagaattcatagattccatcaacgagaaaagcattcctttcatatctattgctcctcttccgtagattcttccattggctaccgctcctgaaaaaggggcaaaatcccagtcttccgctacttttgaaacaggatcaagcggtttgtcatccggccggaatacattttcttcattatttttgacatctgcatctccgggaggaacaacgtccatatgggaaaggaataaaatgggttccagagcaggattgcttcctttaagcctgaacaccaatccatactgattcacctcaacattttctgtattctgataaactaacggataagatgtttttaaataagctttgaactgatcaaacggcgcatagtcgaattcacccagactacctgtagaaactgtgggaacctttattcctcctgacagcctcattaccgcagagtcattttttacaggtttccaaccttctcctgctccgatattatttttcttaaacggataagtataggttttaatcaatacaacagcagccagaacgacaatgattcccagaaggattaaaagaaattttttcatagtagatagtttgtgaagtgattttattcaataaatatagtaaagtatagggtgtctggcaatttaaagctatgctttttcaaacaacccttatcatttaatgagataaaaataaacagataggtccccttaatgaaagcaagatcgtcatcagtataaaaaagtatgaagaatattctgcacattatctccagcgcaagaggagaacattcttatagtaaccagctaagctcagccattctggaaaaactgttacaaaaaggtaacatcaataagattactgtacgaaacttagttaaagatgctcctccatatgcagacgaggtgtccattcatgagttttataaacaccctgaattatacgatgaacaaagcgggcagcttctttcgtacgcgaatctgattgtggatgaagtgcgtgaagcggatattattatcattggaacaccggttttcaacctgggaatttccacgcctctgaaagcctggcttgaccagctgatccgcgtaggaattacttatgtttttgatgagcaatggaatcgcgtgggccagcttaaagggaaaaaagtatatctagctgttgcttccggtggcagaagtactgaaggtgcaacggattatatttcagcttatcttggggatgttttcagaagttatgcaggaattacggacgtagaaacttaccgcattgagggaaccatggaaaacggatttacagcggattatgaaagtgtgctgaaagattttaattccgtcaatgaaatgctttaaagcgggtgttattgtaaacgcaaagttttctattcttaatgctgaatataagggagcaaagatggaatcaacaagttgattggatgaagctttatgatttcaatggtgtttattattttgttttaacgcaagggcgcaagggactttaattatgatacgttttttaaggcgcaagaaaatcgaagattttcagcagggaaataatgtgaaaatttcatcagcaaaactttgtcgtctttgcggtttatcaacaacgaataaacatctttaattaattcaggatttcattcatttcggttaaaatgatgggttttccatcggtaattacaatggtatgttcgtgctgggccatgtaaccgcctttattgcctaccatggtccatccgtcttttaattctacagcaattgtggaatctgtggagataaatgtttcaatggctaccacagcgtttttcttaaaacgtctggaatcaaaacggtttctgtagttaagcaattcatcaggctgctcatgtaagcttcttcctactccatggcctgcaagattcttaatgactttaagacctcttttcttcgcttctgtttccattaaatgtcctatgtctgctattcttacaccgccttttatattgctgatcgcctttctaagaatgtctttggatgcctccaccagtttctgatgtccgtgaatatcttttccaatgataaaagatccgccgttatctgcccaatatccatccagctctgcagaaacatcaatattgatcaggtcaccttctttcaacactctttgatctgtgggaataccatggcagaattcattatctacgctgatgcacgtccagcccgggaatccataggtcaggtaaggtgctgattttgccccgaaactttccagtattctagctccgtattcatcaagatcttttgtggttatgccgggttcagcatattctgtcatctttttcaaagtaaaggcaacggcttcacttactttttgcattccgagcatctgatcttcgctggtgattgacatatttgtttgtttattgttgagaactacaaagttaggaaattaaaacgttctgagatagcctgttttcataaagtagcagagagcatttatggagtggctcgtgatgctttaagaaaaaagtaaccgcaatgcgaatattttaccggacattttttcacctttactttacagaatgtattatctttgagtcttcacaaattgattaaagaatggatcacaaaatacatcagggaagaaatgtaaaacgtttcagagaaatgctgggcatcaagcaggaagcattggcacttgatctgggcgacgactggaaccaaaaaaagatctctttacttgaacaaagagaaaccattgaaaaccaactgctggaaaaaatatccgaagtgctgaaaatccccgtagaagcttttcagaattttgatgaggaacaggcggtgaacctaatttcctgtacattttcagataatgcaatgtttaataatagaatcgaagttcaaaatattaatcctattgataaaattgttcaacttcacgaagaaaaaatcgcgctttacgaaagaatgctgaaggaaaaggacgaaatgatgagcagactggagaagctgcttgataagtaaagctttttgagataaaactttcaataaaatgataaaaaccactgctgttagccgtggttttgttttattatcctactttggaaaagaattctgctctccgaagtctcctgactttggagcatattgtattggaattacttttgttattggctcaaagtcgggagacttgtgtagcgataaatttaactttttttttaacaaacctgtctgaccataaatttaatttaatacaaaaatatttcttttcagcgacagaacctgtcgcataaaaaataaaaaagggccaactcaaaagaactgacccttccaaaaaacattaactgtttattgatagaattatgatgttttatttccagccgccacctaaacttttatagatgtcaactactgtgctgagctgtttctgttttgcctcaataagttccattttagcatccagtgcatctctttggttcaaaagaacttcaagataatctgctctggaattacggaacaactgattggcaatatcaatagactgatccaaggctttcgtttcctgagactttaactgataatactggtctatatttttaaccttcgacatcaggttggcaacatccagataagcattcagaatagttttgtcatattcatacaatgcctggatctgttttgcatctgctgtctggaaattagcttttatcgcacttttgttgatcagcggtcctgccagttcaccagcaagattgtaagcaattgattccggcattttaacaaggtatgaaggtttgaatgcctctaaacctaatgtagccgaaatttccagggaaggataaaattcttttcttgctgcttccacatccagctttgaagcctttaattccagttctgcctgtttgatatccggacgattggccaacagctgtgacggaatcccggtatataccgtttgaggaatagtagacataaagttttccttcgttctaacgatcggttgtggatatcttcccagcaaagcattaatttcattttccttctccgtgatttgttgacggatagtatattccgcagctttggattttgccagttctgcctcgaatttcttcacagcaagttctgttgcagcagcagcttctttctgaattttggaaatttccaatgccctttgctgaagcttgatatactgctgtataatatccaactggttatcaagtgccagcaattcataataattatccgcaacttcttcaataagattagacaggacaaagtttttaccttctactgtagaaaggtaatgagctacggcagattctttttcggttctgagttttttccagatatcaatctcccagctcgcatttaagcctgcttcaaaatttccaagcggatccggcatttccttgcctggctctatttctgtggtagcatctccggctccctcgctggtatagcgtccggattttttcagtcctgctcctactcctgcagaaacggttgggctcaatcttccttttttagctaaaacaccacttttagcaatctcaatctcctgaagagtgatcaacagctcctgattattttttaaagccgtttcaatcagggttacaagatttggatccgtaaaaaactgtctccacggtgttgttccgctattattgttagcgtcctgctgctcttcctgattaaagttctgaggaatattttcttttacctcatcttttatgacagtcgccatgggcgccttacagcttgcgagtacaagcgataaggcaatggctgtgattatatttttagtcttcgaattttccatcatgttcataaggttcagtttgttctgttaaaggattctcttcttcatatctcgccaatcgtgacttatcagcaatggttccgaagatataatacaatccagggataatcatcagcccgaaaacagttccgattaacatacctcccgctgctgcagtaccaatcgttctgttaccaactgctccaggccctgttgcaattaccaatggaatcaatccggcaatgaaggcaaatgaggtcattaagatcggacggaaacggatggcagctccttcaatagcggcttttgccacaggaattccttcttcggctttcttctgtacagcaaattcgacaattaacaccgcatttttacctaaaagaccgatcaacattaccattgctacctgagcatagatattgttttccaatcctaaaagctttaaacataaaaaggctccgaaaatacctgtaggcagtgataaaataaccggtaacggaagaataaagctttcatactgtgcagaaaggatcagataaacaaatcctaaacacacaaggaagataaatacagcttcatttccacggcttacttcatctttggaaatacctgcccagtcgataccaaagcccctcggaagtgttttatcagcaacttcctgaatcgcctggatcgcctgtccactactatatcctggggcaggagttccgctcacctctgctgagttatacatattatgtcttgtaatctctgataatccgtatactttttcaagcctcataaaatctgagtacggaaccatctggtctttatcatttttaacatacagcttcagcaggtcagtcggcagggcacggtattgagggccggcctgaacgattaccttatacggtctgtcaaaacggatgaaacttgtttcatagttggaaccaatcaatgtagagaggttatccattgctttttcaatcgttactcctttttgctccgcaagatcattgtctatcctaagcatatactgcgggaaacttgcagaatagaaagtaaatgccgatccaagctccggacgctttttaagttcttttacaaaatcgttacttacctgctccattttgtgatagtctccacttcctgctttatccagcaaacgaagctcaaaacctcctgcagctccatatccgggaacggaaggcggctggaagaattctatattagctcccggaatatttttggctttttcttccagcttttcaatgatttcggcagcagattctttacgctcttcccagcttttaaggttgatcagacaggttcctgagttagatccggtaccttcggtcaaaatctcgtacccagcaagagaggaaacggactgcactccatcaatatcttctgattccctcaaaagttctctggcaatctgattggttctttccaatgtagatcccggaggtgtctgaataatagcatagatcatcccctgatcttcagccggaataaatccggatggtaaagagttgctcaggaagaatgtgcatgcacagaatgctaatagtaacggtaacgttattgtctttttcgtaactgttttgttcagcagtttttcatatctccctgctccttttgtaaacaggttattgaatttatcaaggaaaagtgtaaccggagttttctttttagcttttccgtgattatttttaaggatcaaagcacacaatgccggtgtcaaagtaagggccacaacccctgacaggataatggacgaagccattgtaatggagaactgacgataaaataccccaaccggaccggacataaatgcaatcggaatgaatacggatgccattaccaatgtaatagcgataattgctccactgatctcatgcattgcttcttctgttgcctttaacggggaaagatgcttttcttccatcttggcgtgaacggcctcaatcaccacaatcgcatcatctactacaaccccgatggccattactaaggcaaagagtgaaatcatattcagcgtaattccaaaggcagacattactgcaaatgttcctaccaatgaaaccggaactgccagtgcaggaatcaatgttgaacgccagtcacccagaaacaggaataccacaatagcaaccagaacgaaggcttcaaataaggtatgaataaccttttccatagaggcatccaggaatcttgaaacgtcataactgatgtcataatgcattcccttcgggaagttattcttttcaaggtccttcatcagggctttcacgttcttgattacatcacttgcattggagccataagattgtttcacggtgatcgctgcagaaggttttccgttcaatgttgaatagatatcatacatggaacttccgaattctatatcagcaacatctttcaatcttaccgattctccgttaggttttgcctttaatatgatgtttccgtaatctttttcgttgttgaaacgacccggatatttcaatacatattcaaaagactgtgagcgttttcctgaactttcccctgttttaccgggagatgcctccaaactctgctcattcagtgattccattacttcatcggctgaaatgttgtacgcagttaacctgtcaggcttaagccagatacgcattgcatattcacgggttcccaggatatcagcaaaaccaacaccgcttacccttctcaattcagacattacattgatatctgcgtagttgaaaaggaatttctgatcagcttttggatcatcactgtacaggttaatgtacatcaacatgttaggttcttcacgcgtgatttttaccccttcacgtaccaccagaggcggaagtttattgactactgaagatacacggttctgaacgtttactgccgctacattgggatcggttcccagatcgaatacaatctggatagacgcttctccgtcatttccggcatctgatgtcatatatttcataccgggaaccccgtttaaccctctttccaaagggataacaacggatttaatcaacaattcgttgtttgctccgggatattctgcggtaatatttactttgggtggagaaatggatggaaactgtgtcaccggaagttttaccaatgacaatatccccataaatacaataatcaatgagattactatggacagaactggtctgcgaatgaattttttaaacatactgcttcattttagagaccactactctgcttttaattttaatgattgaagaactttcttaggatcctggaactttgttttcaacttttgatcatcctttactttctgaactccttccagaagaatctgatctccttttgagattcctgagcctaccacataaagatccggaagttcataagctactttgatatttctggactttgctactccgtttttatcaacaacaaatacgtatttctggtcctgaatttcataagttgctttctgtggaatgatcagtgcgttatgaacaggcattgacatctgtattttacctgtttccccgtttcttaaaagtttgtctggattagggaatttagcacggaacgcaatatttcctgtttcgttatcaaattctccttcaatagtctggatttctcctttctgtgtgtaggtttctccgtttgcagtgatcagagatacctggttgctgcctctgtctgctgcatgagtctgataacttaagtattccggttcggaaacattgaaataagtataaatgcttgtgttatctgataaggaagtcaatagatcaccttcatccaccaggcttcccagtttcagaggaattctgttgataacccccgaaaacggtgctttaatatcggtaaaggaaaggtggatctgagcaagcttcatttctgcattggcagcatccagcttagcttttgccatagctctttcatttttggaaacaatattatttcccgctaatgtacttgcgtttttcagttcaatagaagcctgttctacttctgcttttgcttttaataattctgcctgatataatttaggcataattcggaatagtgtctgtcccgcctgcacgtattgtccttcatcgacaaagattttttccagaaaacctttttcctgggctcttacttcaatgttttttacagattgaatctgggctacgtattctttgttgattacagtatccattactacaggggatgtcaccggatatacggtaacttcttctttttcttcttttttcttattgcagccaaccgccagcagaagggcactcagcgcaattcccgaagcaactctttttatcataattctagagtttatataaatcgttaatgttttgaatagaaataaacggtaataaaaggggtacggtgtgctgattaccaacatttacacaacgtaaagtatttccacccgtaaatcaggcagaaaaagaacagatcatgaattttaaattctaatggaacgaatcagaataaatcttttggtggcaaagccaagaacaaagccgtgaatatcgggtctgaaccgtttgtaactttttaatccaaaaatatagaccaggctgaaaactccggcaaaaacaacaatagcctgccatacatcagatagctggaaatcattttcggtaagttctaaagtggaattgtctacattgtcggccatctgctgaacggaaagcttttcaaaagtctggttcaggcggttggctcttttgggcatatgatgagaaacatgaccggtatagtcatttcggagagttttaacgttgatcctgctttccactacaaacagcagaaaaagaccggttaaaaagtatactataaagtttctcattttgaagttgcaaatgtacacccagtttatgatattatcatagcagattaacaaaatttaactctcctttaaattagctgaataaaaaagtttgaaaaatagtaaacatttcccttattcaggcataatccgggcaattctgaatatcacctgtgcatcttcgaattttcaaatattaagccacatttttgatttaaggaaattttaattttaaagttgttgcttttttgaacatttaaaccctgttaagctttgttttgaaaatatttttttaaattaaaatcaaaaatattaaaacctaaactttatcataattttagattattaacattaacttattgttcttctcttctttttgaattatttttgccgaaaattgacacaccaatgaaaaatgaagaaaaaaatacactattctactggaaacaaatccgttaaaaatcctgaattaacaatagctatactcaatattcactaataaattattatttcctgtttcgtgaataatgttcaaaaatcagtgagttaaatcgatataaatttaaaatttacgttactttatctaaaattaacatatttttaataaaaatatttgtaaatttatatagcattaacaccacaattcatgaaacactttaaaatcacttatcactatgaaaaaattattattcccggtcctttttggattgaccattgtttccctaacagcatgtaaacatcccggaaaggaagctgagaccattactgctgctaccccggaaaatacagatgagatcacaaaaaatgtgtatgttgacaactatggagaaaaaatagaagtaacaatcaacaacactaaaaatacagccacaatacatttaaacggcaaaacttttgacctcaaaaagagtgatgcattacctgaatatacagcctccaatgaagagtatcaatactctgatattaagggcaatataactttcctgaaaaagactgcagatatggtcttgtttcatgttaaacagtcaaaaaaagagtccggaccggcaaaaatggcatcgtattagcatagggaaaagcattcatattaaaaaaaataagcattatgaaaagtttatattattatttatcggcacttgttatcgcaacatttttggttgtttcctgtacgacacaaaacgcacaaaaaccaactaatgatattacaggaaaaacctggaaacttactgagttgaacggcaaaccaatagagctgaaaaatcctaaaaacaatccttatttcaaacttgaaatgaatggaatgagatatgaaggacatgcaggatgcaacggtttgggaggtacgtttgaaatcaaacctgaagtgatgagaattaagttcaatcagggaatgtctacgatgatggcttgtgaagatctggatattgaaaaccagtttaccaaagcaattcttgctgctgataattattctgtaaatggaaatactcttactttaaacaaagccagaatggctcctttagctaaatttgttcttcagtaatcgtatattattacataaaaatataaagacgcctcaatgtatggggcgtcttttttattacttacttttcttattgtacaggatataacagaccaaaagacttatatttactaaaacagcaaatgaatttgatagaataataggaagctcatcttttttaaatccataccatacccatagtgacagccctgaaataaggactaaaagcatgagcaacgagatatcttccacattcttttccctgatcacttttaccagctggggaatcatagaaacagaagtaagaatcccggccactatacctaatacattttcattcataattgtaagctttgtatatctgtactaagatacattattgaaatctgttcaatgatacttcttcatgcaacggaacattttcttcaataaaacggaataaatctctcgaaaaatagcagccattcaggataccacgagctcccagtccgttaaaaacatacagattgctgaatgtctgatgcctgccgataattggtcttctgtcttttactgttggacggaatccaaaatgtacttcttccacttcaaaatcatacggataaaattcagagagtccattgactaactgtgccaccgcagattcatcaatatgatgatgaagctgttctctatcatacgttcccccgtaaaaatagagcccatttccggttggaaacaaaaaatgtttcttcttaatagtgatattttcgggaatcggttgggaaagtttcacttttatatggtgtcctttattcggatttactgtaatttcagaaaagtatggattatcttttactcccatgccttcacagaagattatatttttgaagctaaaatccttatagaccgattcagaagggttcaatttcgtataatcaaatttttctttgatcaaatgaccatttttttcaaaataactgaatagaccactgaaaaaaccattgacattaagtctggcagactgattcacctttccggagagaaaatcgttttttactacgtttaagtgatcaaaatttttgtcaaggaaatctgataattcttcattttccgattttttaagccagagattctgttcgttctcatcatgaaaaattctatggataggagcattgatcaggtaattctctccggtataggattctatttcctgaagactttctttcagaaaatctatttgttcctgtgctttccagaatgtagtaaacttcttcaagactaccggattgataattcctgccgaaacctgagaagcactttttcttccttcggaaaagatcacaaaagatttgttatttttaatcagctgatgagccagaaaaagtcccgcatatccgtctcctacaataatataatctacatttttcatatgagaaatttcatttgtttaaaggtcatatgtaatcgcctatttcattgattgttgatcggtaataaacaaagggcgatttcataataaaaaaacctgagtaaaaatactcaggttttctataaatatcaagtgaaatctagtaattccacatatcattttccatttcaagaatctgtgctttgattctgtcactttcttccagctgctcatctgcatttttaggaatatagtctttgataacaccatctcctaaaccgcttgaagacttatagataatagaagaaaatcttcttgcattgataacatcatcgaaagatagatcagcagacgaattttttctgttgaaaacataattgtttgctaaaatatcacgagcacttgggtaataaatccagaataaatcgatcaattcatcagctccggccagaggctggccgtcaggaccaattcttccgacagatgtaggatccggacccatagcagcgataccaagtggtctgtacttcatctgaccatctcttttatcgataaaccacatacccattattttaagaacttttactttatcagtagtagttctgatgatatctgtaagtcttttcttctcgtcttctgtaagtgttcttccagagttcaggatatcgatagcttcttcgtcaagtcttacactttccagtcttttctgaatggcttcaggtgaaagtcttgtaacaaagttttcatcatcataaacttctttgatgtctcctttaagagctccatcaagtaataactgatataaagatcttgtagaacttgaaagaagaccatccggattatcgtaatagaacggctggttgatcttatcattcatatcaatgatttcccaaacaaacatacttttgtaaatatccttgtcatcaacgaaaccatattcaagaggctttactttattgctgataacagtatcccctgcttttctcattgattcagctctcatctgtctgaattcctcaggagaagcagcattcagaatagtttgggaaaatgcgaatcccgaaactaaaacgaaaagggtgctaatatattttttcataatatgattttacaaattaaccttattgaacattaataattacaggtgaaatttccttaagcctttggtttccaagccctgtagctgtcgcctgaatatcatagatctgaactacatcaccaggtctaaggtttctaagcataccttctgctcctgataatgagctaccctgaatcagagtacctgcttttcctggaagcttaataataaagctgttaacagtgaatgaaacagggaaatcaaagtctggtaaagtagcagtaacaatctggttaggtatagaacctgccggcataaagtttacagctttacctctgatctgaccttgtggtcttgggatattcttaattctatattcaaatacctgagaaactgttttaccatatggatctgttcctgataatgtcaacttcactacatttcctgtagtaggagtaacattccatttaccctgacctgtactcttcacagtagctcctgctgcagataatgaaagtttagaattgtcagcacctaagattgatcctgaaacagggttctcaagtcctctatacattacattcatcttatcagcagaaagcaataatcctttttcaagttttacttctcttggtcctgcaattacattataagtatgcgtccaagggaaagactgtggcttccctgaagcatctgttaatgtaatagttcctcctagtttatgttcaccgattccggaacctgaaatctgcatgatacctttaccgttttcaactttgcttactccagaaatgctgatcttgttactgttagaataagttcccaacattacttttacttcagcctgttttcctgcctggatatctaccggacctgaaacaataggctcatagcttgagaatttgatattcgcatctactttttcctgaagtaatagtgccaatgcatccgactgaacgtttctggcatcattttggataatttccagattagatattgcagcgattaacggctgatggtaaaatttattctggaaccatgtcttttcatttggagatgttcctttaggatactccgcaataagagacttattagctctggctactaaatcctgtaactgagaattgcttccaaaagtagtattgatgtagtttctaacgtcatcaattttagctttcagatctaatgcattcttcgaaggggtattttcatctccttctttaaagaagtattcagttgttgcttcattgttgttcaatgcagcaaagttctcacttacatcaatatcttttcctgttttaggatctttgtcatgaaactcagattgtttcttcaacaaatctttaacatcctgagcagattttactaacgcatcaattttggttttcaatactttgtactgagcccaaggctgtgcgtaggtatccggaacctgctgagccttagcttctaaagttctttcaaagatcttctcgttttttctttctgttaaagttctggtttcattcaatgctctggtagagtcatagtatgatctgatgatttctgcatcaatatttagggccatcatcgcgatgaacaccaaatacatcaggttgatcatcttctgacgaggggtctgttttccttgtgccattctcttttctttgttttttaattaagtagttaaatttagaaatggttaggaattaagacttcatagcagttagcataccaccataaactctatttaagttattaagattagttgttaaaccttgtagctcttgattgaatttctcagactgttctgcagatttctgcatatccgcaacatacttgttagcaaattcagattgtctcttaccgctttcaagctgcattgcataaagagcattcatgctttccatgtgctgggcagctttgtttaattgctcattatatttatgggtagaagcagatacgtcaacagtttggttgatctgatcgacagagcttgagaatttatcaattcctgttcttaatctttcaaataactgaacgtctaatcttgcgtcttcaagcattttatccaatttgctggaaagagagttttctaattcagcaaactgagcacttgtatttttagttgttacattagagtgtaaagggtttgggttggcatgcttatccaataattcaggataaacattttcccaggcataagactcctcagttttaggtgggtcaaatgcgaaaatgataaagataatcgcttcagtaataagccctactgtaagagccatatttccgttaattggtcccagtgtaatgtgagtaattttaagccaagctccaagaattacaattgcagcaccgaatgaataaaagaaattcatccaagcatctttagtcttaaacatattgagttagtttttttaatattaaataaaattgttattgaaaaattgtctgattagtttctgttaattcttcttggcttaacagctgcttcaggaatatcctgtacagttctgaatccgatatagcttcttgcggaatcttttctttcccaatctcttgcaccagtcattagcgcataacctatatctttccaagatccacctcttacagatttcttcgtatctaatttatctttagtagaaggatttaacgtagaagtaaatccagctgaagagttgttgtatgaagatgatgtccactcagaaacgtttccagccatatcaaataacccaaatccatttttcttaaatttcttaactggagctgtatatgtataagtaccttttttctcgtcttccatgtagttacctctcttaggtttgaagttggcaaggtagcaacctctgtcatccattaaatatggaccaccccaagggtaagtagcattttgcattccgccttttgcagcgtattcccattcagtttctgttggaagacggaactctaatggtctttgtttttttctttttaaactttcgttgtaatctgttttcaatttagatctgaagttacaataagcccttgcctgatcccaggtaaccccaacaacaggatagtctttataagccttgtgccagaaatactgttcaaacaatggctcattgtaagcaaagtggaaatcttttacccaaactgtagtatcaggatagatcgcaatactttcgcttttcaggtaattagctcctctttcgttatcagcaactgcagcatccatatctccccaacggtaagtatatttaagcttgcttacatctaaaattctttcgtttccgattcttgaggaagtaggcagatacatagattctaaaacttctgcgtattctacatccggatattttgatgtgctccagtgtaaaggaattttccaatctaatcttttgcttgcatcatagcctccgtcttcccggccaccctggccttccatatattcttgataaggtgttaaattttcttcttttttagcaaggtatgcataatctcctatgcttgcccctttacgtccgccttcatcaccgccttctccggcagcttcagcaagtaaagttcttgcgatagagtctcttacataattgataaatactctgtattctgcattagtagtttctgcttcatccatgaagaaagaagaaacagtaactgtcttcaatgctgctttttcaggtgtatttgtcggatcctggtctgctaaaccagcaacaaacgaacctgcaggaattgcaaccattccgtatggtctttccgcaacaaatgatttagttttttctcttggtatcaattctccttttgttcctggcttccctacagaagagctgccaccacctgaacaagataccgatgctaccgacgcagacaataataaaagaaatatccttttcatgttaatttttataattaagccgtaaatatataatttttttaagaaacttttaagattttttttgaaataacggaagaaatctaaatttattttatttacaacaactttttattccacggtaacagattttgcaaggtttctcggttgatctacgttggctcctctataaactgcaatataataagcaagcagttgcagaggtacggaagcaacgattggagagaaacattctgaagtttcagggatttcgataacataatctgccatttcgctcacctgacggtctcctttattaactacagcgataatttttccttttctcgctttaatttcctgaacattacttacaattttatcatagtgaccttttcttggtgctataataacaatcggcatgttttcatcgatcagggcaatcggaccgtgcttcatttctgcagccgggtatccttctgcatggatataagaaatttcttttaattttaaggctccttctaaggctgcaggatagttatatcctcttcctaaataaaggaaattggtagctttcacaaaatctttcgcaatattctgtgtaagctcatgagtagtatttaacacttcttcaattttcttaggcatagcatcaagctcagcaattaagctcatgaactcagcatttcctaaatttccgttgtgttttcctaatttaaatgcaattaaagtaagaatggtaagctgcgctgtaaatgcttttgtagaagcaactccaatctcaggaccggcgtgtgtatatgacccggcatctgtaattcttgcaatggaagaatctaccacattacatataccatatataaatgctcctttttcttttgccagttttaaagcagccatcgtatcagcagtttctccggactgagaaatggcaattacgacatctttatctgtaatgatcggatttctgtatctgaattctgatgcatactctacttccactggaattcttgcatattcttcaatcagatattctccgataagacctgcatgccaagaagtaccacacgcgataataataattctgtttgcatttttgaatttctccacatgatcccagattccggccattttgataatcccttcatcaacaagaagtctacctctcattgtgtcatgtacagatttaggctgttcaaagatctctttaagcatgaagtgctcgtaacctcctttttctatctgctcaagactcagcttaagctcctgaatttccggctcaattttagagttttcattgattgttctgatatctaccccattttccagagagattgttgccatatgaccttcttcaagataaatggcttcttttgtaaattctacgaaaggagaagcatcagatgcaataaagtattctttatcaccgattccgattgctaaaggagaacctaatcttcctaccactaacactccagggtaatcttcgtgaagtacagtaattgcataagctccgtatacttcattcaatgcatatcttactgctgtcgggaagtcaatatcaggattaagatccataaaatactggataaggttcaccaatacttctgtatctgtttctgatttgaaagtaaatcctttttcagtaagcattgttttaatcgtatcatagttttcgatgataccattatgtacaattgctatttttccattgttggacaaatgcgggtgggaatttctgtcactaggaactccatgggtggcccaacgggtgtgccccattccaattttagactttccttttagttccttggaaatatttaccaaatcttccactttaccttttgttttttctacttccagtttgttatctggactttccaaaacaattccggcactgtcataccctctatattccaatcttctaagaccattaattacaatttcataagcgtcttgaaatcctgtatatcctactattccgcacatattttattttgtctagtgttgtttgttgtttattgtcttctattttttcgtaccataagtcaccagtaactggattctttttggattggtattcgttttatctactcctgtaagaataattctgttcatgtcaaatgctcttgtcgtattacgaactcctaaaagggttcctgtagcattggcagcaaatgatccggcactgattattaaaggtttattaggaatcagctggggatttccatttgtatcattttctttcttctcttccacaagatccttgattgttttggttactacaaaatcataataaccaggattttctttgtaataatacaatccaagcccgtttgtaaggtctgaagtaaatttcagtgctgatgttgaataatcgatagctccattatttaatgtattggttaaaagtgtaaacctgcggtcttcagtagaacctgtatttttccatgtttcaggatccaggtacactctgatcttagcacttacaatacctgctttatctttattatatacatccttaagctgcgcaattgtttcatctttaatttttacgatcacagaaggaccacccattccctgaacaaaaagtcttgcatcaccatcattaggattacttgtagccaatgcagatgcaacagtcgaaccggatctgctgtattcatagagtcccaaatgcgcattagcacttcctaaattaaagttaagggttgtctgcggtcttgtggtagttccgttgtctgttttatcatatttataatacatgataagctgcagatcattaggagaaaactggtaaagatatttatccgtttcatccacagaaatttttatacctttaaaatacctgataaagttagcagcatcctgaagctcaggcttaccttttttatcaagaatatgagtctggaaaaagtccgtattactcaacttcattctaaatcctaagtttccggtaaatacgactgaattgtcagatttttttgtaatggaaacggaactgattttaccatcaaatactcctgatcctaacagttcaccagtacttatcgctttattggaacgtttgaaactgtcatcatttgcatctatgaacgtggttacttcatgtacattgattttcattgtttttgaagccactttaccgtatttacgaaccgggtaagttttcttctcaatggaaactgctgtagctactccatctaccgggaaatcacttttatcgaatgtatttgttttcaatgaatcactttcaaagaaataagtattcgccgttgtattcgctggtggtcttactacaaggaccacagaatctacttttggatttgctccgttaaagtcataattatctactggcattcttagctgagtaacataagaagctctctgcattccgaattggttttcagtaaaagctcctagaacgccaacataagtagcggcacctgattcgttcaatccactgatcagtcttgaagcatcacttttgatggaatctttattatcgtaattatatgctataacaggatatgaaatttcattgccttgtactgcatcaccattaaacagctgctcaccaagagaatccggatcaggttcacagttataaaggaatgtacttccgaaaaacgccatcaaaagtatggcgaatgtccttttaagattatgagtcattaaaatgtgtttttaataaagttgatttatagaatctatgtcaagatattccgacttttgggttgttgcttcgttgaaggccttatccaggtcttcatccagaaactcgtcacccttcacaacggcatccacatagttcatactttcaataacaaaacttttaatcgttgggttatctaacgcttttaatcctgaaatattatcaaattgcagtttttcactgatctttttatccagatcagcatctttctcattgtaaagagaaagtacaattttagcgtctttgaaataagtatctgattcgtagtaagttttaagataaattggaacaaaagaggacatccatccatttaaatgaataacatccggcacccagtttagcttcttaatggtttcaataactcctctggcaaagaaaatagccctttcgtcattgtcatcgaaaggatttccttcatcatcgaaataatattgttttcttttgaagtattcttcattgtcaataaagtaaacctgaagtctttcccccggaagagacgctactttaatgatcagaggctggtccaggtcattgataataatattcattcctgaaaggcggattacctcatgaagctggaactttctctcacttatttgtccaaatcttggcataaaaactcttacatcattgccttcttggtgcatcttaagtgccattttgtttaccactgcagccatatttgtatcttcctgatatggatacatctctgtagtaatgtacagtattttttgattcggcataaactttctatctaatttttgtaaaaatgctttaatgtgcaaaattacaaaaaaacatccaacattattttaattaacatttttttacgataattccctttttcaaattaataaaagcacatattattatgcgatatttttactatttttgaaatagtattaaaataaactatggaagttataaaaaacaggaaagttcttcaggatttcattgagagacagaaagaaatgggaaagagaatcggctttgcccctactatgggagccttacacaaaggccacctttctctgtatgaagaggcaaaaaaagaaaatgaccttgttatttcttcaatttttgtaaatccaacccagttcaataatcctgaagatctggaaaagtatcctagagatattaaccgagatatactcattcttcagaattccggctttgtagatgctgtttatattccggaggtagcagatatttatcctgaaaaggcagaaagtaagcactatgattttgatggattggaaagtgagatggaagggaaatcaagacccggtcattttgacggggtgggaactgttgtagaagagcttttcagacaggtacagccagacaatgcttattttggtgaaaaggatttccagcagctcgccatcataaaaaaaatggtagagaagaaacaccttcctgttaaaataaccggagttcctatttacagagcagaaaacggattggcactaagctccagaaaccaaagacttcatgaagaccgcaaagaagcttcaaaagtgatctatgagactttaaaaaaagtaaacgactggttcaggacggtttctattccggaaatcaaggaaagagtaactgacatttttgatgaccagccgggaatgaaactggaatatttcctgattgccgatgaaaacacattacaggaaactgattttttctataaagacagaaatttcagagcctttattgtagtagtggtagatggagtacgattaattgacaatatgcatctggattaatcattcagaattttaataatatatccctgactttttgttggggattttttattgaacaaaataaagataacaaaactgatttcatacaaaaatcaaaggcctcctgaaggaagcctttgaaacaccaaatcacaaaatattaatatgaaaaaaatttacttttcagtaaacttgtgacccggctgggattcgaacccaggacccatacattaaaagtgtattgctctaccagctgagctaccgagtcggtcacaattaaaatgaaataaatttcaatattaattataaattttctttgcagtgcctgcgactggactcgaaccagcacatccttaggaaaccaccccctcaagatggcgtgtctaccaatttcaccacgcaggcaataaaatcacaaaacagtaatctttattgctagtgacccggctgggattcgaacccaggacccatacattaaaagtgtattgctctaccagctgagctaccgagtcggccacttattataacaagttttcatttaagtaatgtcccttgttttaagtggtgcaaagatatgacttttttctttatctcaaaactttttcgcaaatttgtttaaaaaaaattcatggtaatttcattgatcggatacatgggaagtggcaaatcacacatttccaaaatattaagcgaaaaaatcggttttaaactgattgatctcgataaagagatttccagacgaaataaattaaccatccctgagatttttgaaaaaaagggagagatttactttagaaagctggaaagggaggcattggaagagatattggcttctgaagaaaatgtggttttaagccttggcggaggaactcctgtgtactataataatatggagatcatcaaccataattccaagagcgtctttttaagaacaggagtaggaacattggtggaaagactttcaaaacagaaagaaaaaagaccactcattgccaatatatctgataaagacttgccggaattcattgctaaacatttatttgaaagaaatcagttttacagcaaagcacaatttactgtgggaacagattccagggaaccagaagacattgttaacgaaataatagaaaagctctatctctagagcttttacttttatattaatcttcgttctcctcttcactgtctgtctctccaaaaaaatcatcccagtctgtaaaatcggagtcgatatcgtttccaacatattcatccatttctcttctgtcttttttggtaggtcttccctcccctttatttctgtaataatcctgtgacatcttacgaagtttcaacaattcgtattgttctttatcggtcacatcctgtatgtgaaggggtaccagcttggctcctatcctgctctttggaatttgaattacctttatcttataatcaatctgattcttacggattttaattgtatccccttcctttacctctttagatgactttacggcagacgttcctatagaaactctattctttttaatctcctctgctgcaatacttctcgtcttataaaaacgaatgctccataaaaatttatctattctcatatttttttatacttttgccgttatattatttgtaaagtaattaaagttttttgaaatgaaaaaaatatttttatatatccttgcaggatctttgtgtttttctgcttgtaagaaagatgattcgattgatacctatgtagagccggaagatgttgctacacaaaacacatacgatgatcaggccattaagaaattcatggatgagaattatctggatgcgcaaggtaatataaaagctttcagttctacagatactgcggatgacactgaaaagaagctgtctgaactaagtcctgtaacactaccttcaggaacaatctatattgtcagaagcggagctcagccaacgccagctgattctgcaaaaaccattaaggatgatgatattatcaaaatcatgggaagagcatattcttaccttgcagttaattctgacggaaacacttcatttacttcaaaaactgcatttttaaataccattgatggaacaggcgttccagttattgatcctacgtattattatgtaaagcaatcaatactggaagctggtacaactgatgcggcaaaacagcctggttattatcaaatatcaggtttcagggaagctttacagaaatttaaagcattcaataatcttttgaatgaaacgccttataacctacagggagtaatcattgttccttccagagctgcttttgcaagaaaccctcattatccgtatttaaacatgtcttacagaaacagatcttttgtattcaactttcagatttatggaagagctgacagacctgatggagaaaaacaaaagtaacaatagaataataatacaaaataaaaatagcccccaaaatgatcattttgggggctatttttattttgtatcaaagtgaattacgatcttgccttctgttttacatttcctaaaatatccgggaaataaaggtctgcaaggtggtcaaactcatctcctctcataaacatggtagcatctacttcttcataagaacttcttcccgcagcagcaataagttcgttgcaggtgtgaagggtatttttatggaagtgatatactctttctgccttatccgtcacatcaagtcctttaataagcattttatcctgtgttgcaactccagtaggacaattgtttgagttgcatctcaacgcctggatacatcctaaagagaacataaatcctctggcattgttacacatatctgctcccattgcaatggctctcagaatatcaagactggtaagaactttaccgctggcaatcactcttaatttacttcttacattatagttgttaagtgtcctgtttacaaatattaaagccggctctaacggcattcctactccgtcagaaaattccggtggtgctgctcctgttcctccttccgctccatctatggtgataaagtccggataaattttaagaacattcatttgtacacagatatcttcaaattctttggtatcaccgatacaaagtttaaaaccgaccggctttcctcctgaaagatctctcagctgctgtacaaacctcaacagtcctgcagcatcagagaaagcggtatgtgacggtggagaaataacggtcattcccggtgttacgtgacgaattgctgcaatttccggagtatttttcactcccggaagcactcctccatggcctggttttgctccctgtgataatttgatctcaatcattttcacattaggaagggttgaatatttggtaaacaactcagggttgaattttccttcatcatcacggcaaccaaaatacccagttcctatctgccagcacaaatctcctccctccagatgataaggcgagattcctccttctcctgtattatgataaaagttcccttttttagcacctctgttcaatgaaatctgtgctctgtcactcaatgccccgaaactcattgctgaaatattgaataaagaagcgtggtaaggttgtgtacattgctcaccgccaacccatactctgggaagttcttctgatggtgactttgcataaatagaatgcttgattccctcgtattttctgtggttcacttccagctgtgtcccgaaagctaccgtatcacttaaattttttgcacgtctgtatactgcagaacgctggtttcttggaaacggtttcccgtctgtttccctttcaataaaatattgctgcatttcgggtgaaatactttcgaaaaaatacctgaaatatcccaatacaggaaagttccttaaaatagcatgtttcgattggtaagcattgtaaacacccaatgcataaattgcggataacagcgtcggtatccagtaatgcgctctgatcagtattgctataatccatgtagcaactactaatacaattccccaagataaaaacttatctctcatgaatgtagtatttaaagtttaaaaataaatttagtagaatttttgcaaagagcctatgcttttgctaaaaaattttcgtaggaggattgcacagaaaccgtgccatctgacaggattttttctaaattcagaaattcgatttggtttactgatgcaggatcaaagtctttctggactctcacatagttttctgtgaagccaaacatttttccgtctttattttcgtgctcccaaagaacaggaagcgtttttccaagttgtgtctgataaaatgccatttttttcttttcagaaagaattctcagcattttattacgtttttttctttccgctactggaactactccgtccattgatgcggcttccgtattttctctttcagaataggtaaatacatgaagataggtaataggaagttcattcaggaaattataggtttccataaatctttcctctgtttctcccgggaatcctacaataacatctacaccgatagccgcatcaggcatcacctcgcggatcttgttcactctgtcgttgtaaagtttggtcaggtaacgacgcttcatttttttcaaaagatcatcgcttccggattgtaacggaatatgaaaatgcggaacaaagcttctgcttttagaaaccagttcaatgctttcatccttcaaaagattgggctcaatagaagatatacggattctttctatcccttctactttatccagctctgaaataagatcaaggaaagtgtgctcgtgtcttttatttccgaactcccctttaccgtagtcaccgatattcacacctgtaagaacaatttctttgatgtcttttgcggcgatttccgtggcattacggagaacattttcgatcgtatcagaacgtgaaattcctcttgctaacggaatggtacagtaagtacatttgtaatcacagccatcctgtactttcaggaaagctctggttctgtcaccaatagaataacttccgataaagaagtcggtttcttcaatttcacatgaatgaactattccttcgttttcagatttctccaaatcatcaaggtagcttagaatattgaatttttctttagctcccaaaacaagatcaacgccttcaatctgtgaaatttcttcaggtttcagctgtgcataacaaccaacgataaccaccaaaccttccggattggctttcattgctctttttacgtgaagtttacattcacggtcagcattttctgtcacagaacatgtattgataacatacacattcgctttttcatcaaaacttaccttctcataacctgcatctgttaattgacgggcaatagtagatgtttctgcaaagtttaatttgcagccaagtgtatgaaacgcggcagttctgtgaaaagtagacatttgttactcctgaattttatgggtgcaaagatagtaattttaataagaatgcaagattgattcaatctattgtttatattcgtccctcacttcaggactgttttgaaagcagacaggtgaagaattgttttgctgatctgtacttgaaaatctggttttcatttctgtattaaactgttgggaacggtttctggcaatagaaagtgtattccagtcttcattttttatcattttggcgatataaacaatctggccgatatggtatggataatgagccagctgacgaaaaactgcatccatcacagaatgcccttctcctctgatatatattgttgaataaagattctcatcatttattttgttaagagcattaaaaaaacaggcccaccctttttcccaatactcaacgacttcttttttagttgtaaaagagttgacaaactcatcatcacggttacgataagacttttctccgtcttcagtaaggaaattggtccatcttgaaagcatatttccggcaatatgtttcactattatagcaatagaattactttcttcattatactgccagaacatctgctcgtctgtgagctgatcaaaggttttatctccaagtgatttatagtactcaaaacgttttatgaacaggtctttcatgctttctattttgctacctaatttaaaaattttaaaatataaaaccacttcaatatgaagtggttttttctatctgttttattattattctctgtttttcaccagaacccagcctgtatatttaatggctgtattccttttatcattttcattccatgtgatagaataccagtaagttcctgtaggcactcttcttccgccctgggtaccatcccatttatagccatttgatctgtctgcctggaagatcttatttccataccggtcaaaaacattcatgatcaggttttgtttgttagccagtgcagaataatcgattacatcatttattccgtctgcattaggggtgatgacattgatcagattaggtacaacaattccgatttctatcggatcacagtcataagcatcttttacatacactttatgatcccctcttgaaaggttattgaaaacattggaatcctgccagatgatattatctattgaatatttataagccggagttcctccaattacagatactgtgatggtattattcgaaatatcaataccggaaacaaccggctgctctgaagggattacttttacagtctgtgtcgtgatacattctcctgttttaagtttcacccagtatactcctatccctgctttaatggtttgagtcgtagctcctgtactccattcatagcttttgaatccaggccctgcatccagagttgtctggtcctcggcacaaatcgtgacatctttaagtttatcagaatataccggcggaataacgactaaagtaattctggcaattgtgtaacatccctgggcattcgaaacccttacatatacaaacccattaggtgcaatataattattggcattcagtatctcattagtttgattaagagcatctgtcaatgaaggataatatttttttgtcggattggtctgccctgttactgaagcattgacaaggttgaaagaggctgtggatgggctggattcgatgaagcatgatcttaaggttgcctcattcactaccaccaccggataaaacttcagggtaatctgtgctacagcggtacaaccgaattcggatattaccttcacgtagataacgccttctgcagaaacaaatgccattggattggtaatttcattagtgccggcattgagatccgccatcgtgtgataatattttttggtgacattcgggttggcgataacgtctgccgtagtcaggtcaaataaagctgtccctccattattattgttacactcggtcaatgttacatttttaactgtgatagcaccattcttgaatttaaatgttcctacctgcttacatttattaagcggattagatgcatttgtaggatcggtataactgatactgtaataataaacagtggttgtattaacagtgattggggttgtaatcgggttattccctgttaaagcatcattctgacttacatgataacttaccccaaagttttgattcccgttaagaattcctgtggataatgtagaaaaatcaaataaagctgtaggagaacatattaccacttctctcgggtcagcaggattggctgccggaattccgggaggattaaatggctgagtctggatacttggatccgtaaatggtgaagccagtgttgcagttccgccccacgtgagagaaaacggagccgtggtagaactggtgctgcttacccagttatcaataaacaaataataagtctgtcccggcaaaacatcaagatacttgcaataaggggttagcgaacctcctgcagcacttaaaagtgtgcttgtcatattcaatcctgtagcaggaccaggcccgataaccgttgcagcattacaacgtattggcgaacctaagcttccacaggttacattaggaccaaaaattgcccagtcataatcggcatccggattgttcgggacgaggtcgaaagtgagtgttcctcctgtagcaatggtgattttataccatattgagttgtgctctccggtaaagtctatacagcttcccgagttgaccagttcttttatattaccatatcctgtgggactataagtgatatttgagtttccgcaaacggacagtgcagtggcacaatcagcctgggcatagaaagtatgagagaggcatagaagtatgaaaagtaaaatttttctcatagattatatgtttatggttatattagttatacatcacattgatagtcaatgcacaccaaatatacctatattttaattaaaaacaataaaaccataacaattttaaactattacaaattaaaaaacgaaataatttaaaattatttatattattttcaattaaaacacaaaataactaaacatataaaaacactcaatttacttgatacttgtaatatttccgcaaagattctcaaggtggaatattttatggaaagggcttttcacttccatcagatgttctttatcctgaatgaaagtatatcgtgaagcaatggaattcatatctgaaacaataaccagccagcattcatccacagaggtgtcatagtatggaaatttttcgttctttttttcaatgagttccagaatcttttccgaacagagttcatcaaacaggttcatgctgtattcatgagtgataaaaacattcctgcgatggaaagattttctcagactttttacacagccaacgggtttattttttttaatgcttttgtaaatactgataatgttttcctgctgtacttccaggctatcaaatttagttgccggatggaattctaaaaaataaacaccacgatatttcgtagtgtcttcctgttctaataatatttctgcctggcggaacattttattcaaagtactttccactttcttcatttccagatggttgatcacttcagtaagttctattccgatttttttgtcgtttaattttgcgataaagtccgggctctcgcaggtaaggttttcaaatttcacttcggggaagtggtgcatgaaagagttgagaagaaggatctcagatttctttctgtatttttcacggtcatgcagcggagattcgtctatggtacgatgatacttctctataggcttttttttcaaatgcctgttcaggtaatataaactcagattcttgatcagatcttcatcagagaatgtctttttcatgtgtgatttttttatttaattaaagaacacatgtggccattggctttcatcattaaaagtttttgataatcaaaaatttacattcttaaaggtaagtaaaaaaacaattcaatgcgtagtttttaaattaatttatctattaattaatgtaaagtttattttcattatttatacctttgcttttttaaacacaaacctacatttatggattttaggaatttcagaataccctacaatatcaatcctcaatattccaaaaaaactgtttatttctcaatggagtttgctcttgagcaggtactgaagatattttcgggaggacttggctttctggcaggatctcatatgagaagtgcttacaaccttaagcaggatcttataggcatcgggatcttatggaagtttggttattatgaccaggcaagaaatcacgatcagaccttacagcctgtgtggacaagaaagatgtacagctttcttgaagacaccggaatcaaattccaaattgaaatccatagtgctccggtttgggtaaaggtatggtatcttgacccagaaattttcaatacggcacctatgtttttcctttctacagacgttccggaaaatgatcatgtttccaaaacaatctgtcacaaattatatgatgccaatgaatccacaaagcttgcccaatatattttattaggaaaaggaggtgccaagttattggatgaaatgaatattgaaagagaggtttatcaccttaatgaagctcacggactgccagcagccttctatcttttaagaaaatataacggagatcttaataaagttaaggaaaaactcgttttcaccacccatactccggaagaagcaggtaacgaaaagcatagcttcaggttatgttatgacatgtcttatttttcaggatacagcatggaagaagtaaaaaagattgaaggatctgatgatgaccgtttcaatcattctctctgtgcattaagaatggcaagaatggccaatggggtttcccagttacatggtgtagtttcccgagctatgtggagtaagtatccgggcatttgtgaaataacttctattaccaatgcacaggaatttaaatattgggcagataagcctttatataacgcaaaggatgaaaatgatgccactgttttcgacttccgtaaaaagtatctgaagaaaaaacttttcagcattgtcgcagatcagacagggaatttattcaatcctaatgtctttaccattgtatgggccagaagatttgcaggttacaagcgtgcagaacttcttttacatgataaagaaagattctacagacttctgaataatccaaaatatccggtacagatcatctgggcaggaaagccctatccaatggattactctgctatttctactttcaatacgttggttgaagaaagtaaaaatcataaaaatatggctgttcttacgggctatgaactttctttaagcaaatctctgaaacaaggttctgatgtgtggcttaataatccaagagttccaagggaagcttcaggaacttcagggatgacggctgcaatgaacggttccgttaatttatccacagatgacggctggatcccggaatttgcaaagcatggagaaaactcttttgtagttcccaaagcagattatctgaatatgagtatttatgaacaggacaattatgatttaaacaaattatatgaaatccttgaaaacgaaatacttccaacgtattatgaccaacctgacgaatggagaaaaatccagcataatgcaatgaatgatgtgaaagaccatttcaacagcgacaggatggcagatgaatattacaaagtactttataatacaacgaaccagtgatatagcaaaaaggcaaaatagctaaagacaaggcgattaaaaacgaataacacatttgttattttgattttcaataaaaaaaccggaaaaatattccggtttttttattgagtttatttactttttttcttggaaggcactttaaggcctttttccctcgcttcagaaataccgatggctacggcttgttttctgcttgtcactttctttccggaagaagatttcagttttccttccttgaattcgtgcataacttttcctactttgtcctgagctttttctgaatatttagtcttgctcatgataagatttttttaagattttggcagggatacccctaattcataaacacaggcatgtttcaaatattttgaacgctctcttgatgttaccgactcaaaatgatcattcttgatcacaataatcgggtcttccgcattttcaatttcaaaattagctaaatacctttcatccggtggagactgctgttgttttgctttaattttctgcagttcatccgcgtattttctgaatcccgggtctgaggaatggataaatttatattcatcgcctgcatacacatagtaatgaagttttttctctatcaaacccgcttcatcattaatttcgggattatcattcccgtctctgaatactacttccaccaatgttcctccttttttacgggcgcattcttcagcgtctttaaaactggaaaaacctgtataaacgattcgatcattcattacataacggttcagtttctggttgtatgcattcgtttccataattattatttgatttgattatagttaatgttattcaatttttttgccaaaaagcgtaattgaaaagcttttttacacatttaataaaattattatctttgaaatccattaatgctagaaatgaaaaaactacttttaactcttactgtggcggcagtatttcaaaatgtatcagcgcaggaaatcactttagataaaatttattcaggatattaccgtggaaagggcattgcaggaatctcttccatgaaaaacggggaaaactatcttgttattgaaccatcaggaattgccaaatattcttacaaaacttcacaaaaagaaggaaatcttgtagacggaaagtttgaaagctatattttttctgatgatgaatctaaaattcttctacagctgggaagccagcctatttacagacattctttccttgggaaatttgatgttaaagatttaaaatccggaaaagtaatcagcttgaatgaaggaaaaccggttcaggaacctacattctcgcctgatgcaacgaaagtagcctttatttctgacaataatctgttctaccaggatcttggttcaggaaaaatcacacagattactactgatggtaaaaagaattcaatcctgaatggcttggcagactgggtgtatgaagaagaattcgggcacgcaagacaatacgaatggactaagaattctgatgcgatcgtatttgtaaagtctgatgaaagccaggttccggagatctatattccaatctacgggaaaaccctttacccgactgaaatgcgttataaatatccgaaagcaggcgagaaaaactccgtagtttcagcacagctgtaccgtcttgacaatggaaaaacaatgcagctgaacttaggttctttcaaaaattactatattccgaatgtcttccagacagcaaaaccggatgaaattgttttaattacttccgaaagaatccagaatgcttccgacattttaaaagtaaataccaaaacaggagctgttcagaagttgtttactgaaacggatgataaatggattgatacagatagtcctactctggaatttcttgaagacgattcattcctctgggcttctgaaagagacggaaaccgacacctttactggtatgacaaagatggcaagcttaaaaaacagatcaccaaaggaaactgggaggtaaccgattattatggattcaatccaaaatctaaagaaatttacgttcagacgactgaaaaaggaagtatcaataaggtcatttctaaagtaaatatcgaaaacggaaaaacccagctgatctccaatgcggaaggaaacaattctgctaatttcagcaagaactacaattatttcattgaaacttcttctaccgctgcaaggccatatacttatgttttaaaggatggtaatggaaagacagtgaaagaacttcagaacaacaacgaacagttacagaagttaaaggctgataattttgttgaaaaagaattcgtcacgatccccaatgctgttggagatcagatgaatgcctggatcatgaagcctaagaactttgatccgaataaaaagtatcccttatttatgttccagtattccggaccgggatctcagcaggtagcgaactcatgggataacggcaatgcgatgtggttcaatcatcttgtgcaaaaaggatatattgttgcttgtgtagacgggcgtggaacgggttacaaaggagcaaaatataagaaagtaacctatatgaacttaggaaaatatgagattgaagatcagattactgcagcgaagtggttcggaaaccagtcttatattgataaaagcagaatcggaatgttcggatggagcttcggtggatatatgaccagcctggctatgaccaaaggagcagatgttttcaagatgggaattgctgtagcaccggtaaccaactggagatattatgattcagtctacacagaaaggtttatgagaactcctcaggaaaatcctgatggatacgataaaaactctcctacagaatatgccaatctgttgaaaggaaaattcttattaatccacggaactgccgatgataacgttcacttccagaactctatggaattctctgaagcattaattcaaaataaaaaacagtttgattttatggcttatcctgataaaaaccacggaatttatggcggacagacaagaccacagctgtatcagaaaatgacggatttcattttgaataatttataagaatcatatttgtatctcaataaaagacctttcagaaattctgaaaggtcttttattgtttttttgttaaggatattttacggctttgtccagctctatgggggtgttatcttcttttatctgtttttgaatactttctgtcatttctttaaaacttatattgacagggttttcattaacatctccagttcttgttttaatatttctggcttttatttcagcaaatggatcactgtaataatcaatttgtaattttttataaacatcccaggttatttcttttcctttccgtaaatagaacatattatttttatcagattttttaattctgataagtttaaaatcaaaatctttctgttcatccgaaagctcaacaattaaaccaggaagtccataaaatatatatgggccttcttgtagcggacttgcaccatcaaaccaggccaaccatttgcgcccaccatattctgctacagctttctgacattccacgtcacctattttcattttatcagacagaatctgccattgtagcttgttattaatattaatgtaatataaatcataaaaagcaggatgtgtgacacttttataaactgtattacttattaagtttttgaatgaatatatactttcaaaagtaggtttacgactctgccaataaccatttttttgcatcagcgaatctgcttcgcgcgctttctctgacctgaaaacagattgcttccccagaacatccaaataataatattcatgtcttacattttttttatcagtccttaaagtgagctcatatataaaagtaatattctgtgcagtcagaatattcgctacaaataataaaataaaaagtaatggtttcatgaaggaattaataatattcagtattaaaaaatagagaaaagagatacaaaatgtatctctctaaaaacctgtaactgattaacatcattacatacaagcattatgtgactcaatcacctgcccattttgtaccgtataccaaaagccacattctaatccatattgcgcacatacatcaccagctcccggctgacaaaaatcttttaggcctccttggacaccttttaacttttctctcgaaatcttttttaattttttcataataaatgtttttaattatatgtcttgcgacatcccgaaactaaaaaacaaataccatatagaagcaaaataaacttgtatatctgttgtataacaatgatttacaacatgtacataatctgtacaaattaaattcagtaacataaattactctttacacttaaaattttatatttatttcattaatcacttaagcaagtattatttattttatcaattaaaattaaaaacctatttttgggaaatttgaaaattgattatatgaagactaaacatcctaaagggctgccttatctgttttttacagaaatgtgggagcgtttcgggtactacctgattcttggaatctttgttctgtatgttattgagcctacgggtatgaaaggcggacttggacttccggataaaacagctgatgacattttcggaacttatattgccttaacttatctgactccatttatcggaggattcctggcagacagggttttagggtatattaaatctatttatctcggtggctttttaatggctgcaggatatataggaatgggtatttttaaggatttacctttgttttatacctctcttgccttaattattatcggaaacggtttctttaagcccactatttcaacgttattaggaaatctttattctgaagaaccttataaagccaacaaagattccgggtataatattttctatatgggaatcaatatcggggcatttatctgtaacattattgcggctttcatgcgtaataaattcggttggggtgaagctttcatcactgccggagtaggaatgcttatcgggatggttatatttacagtaggaagaaagcattatatccacgcagcacagatgaagcctgtacaggaaggtgacaccaagctttcagaaattctgatcaaagtatttgttcctgcgatcattgccggagcaataggctggtttattcctgacaatatttttggaagtgacagtacggatgcctttatttttgcatgtatccctgttatttacttttatgcttctctttactttaaagctaaacctgatgaaaaagcctctatcggcgcgttactttccgtatttctgatcagtatgttcttctgggcggttttcaaacaaaacggtacagcgttaacaagatgggccaattattatacggacagaagtgttcctgcttcccttgaaaagcctttggaaggtatttatatggtagatgggaagagttatgaagacaaggaaactcctgtttatgataatcagttccgttcccagaaagatgataacggagagactaaaaaggaaatgggaaaagatgtttattttaaaaacatatcccctgaacagcgtgctgctcttgagaaaaatcctgaaaataaagtttatttatataatacggaattgttccagtccatcaatccgttctgggttattgctttgacaccggttgttgtaggattctgggcattacttagaagaaaaggaaaagaacctttaacccctactaaaattgttttagggctgtttatttcaggactttcctgtctggtgatggttttagcagtaatggcaggagacaatggtgctgtaaaggtatctccgttatggctggttgccagctatggagtaatcaccgttggtgagctctgtctttctccaatgggactttcttttgtttccaagctttctcctgcaagaattacggccctgatgatgggaggtttcttccttgctaactctgttggaaacaagctttcaggaattctggcaagcacatggtataattatgaaaacaagacaaattatttccttgtgaacttcgctttgttaatatttgctacacttttaggtctttctatgctgaaaagactgaacaaaattatgaaggaaaaaggacattaatccttgatattatacagattagcaagctgcggaatagttccgcagcttttttatttaaaaataaaattaaaaccttgccaaaaacccaaaataaactatatttgtcagtcttaacaaaaattaacaatagaaatggataatattgaagcattgagtccgaaaccggatgaatttgtagagaataagagttccaggcatcctaaaggattatgggttcttttcggaacagaaatgtgggagcgtttcaacttttatgggatgagagcacttttgacgctcttcatggtaaattccttattaataaaagaagctgatgcagcgatcatctatggtggatttctagctttatgttatttaacacctcttttaggaggatttattgctgataaatatatcggaaacagatatgctattatcattggtggatcattaatggctatcggccagttccttttattcatcagtgcctctacattctccgcagatatcggcagtgctaagcttatcatgtggctggcgttattcgtgatcatttttggtaacggattcttcaaaccgaatatttcctcaatggtaggaagcctttatccgaagcaggaaaaatctaaactggattctgcctttactattttctacatggggatcaacatcggtgcgtttctgggtcagttcatctgtccgtacgtaggagacgtaaaagatgctgcaacaggtgtaagagatatctttgctttcaaatggggattcctggcagcttctattgcgatggttatcggaacggtaacattctttatccttaaaaacaaatatgtagtaactccggaaggaagacctatcggtggattaccaaaaaataatacaagtgctgactttgaggaaggagaaacacagactgctaaattctctggtcaggctttaggaattacaggaggaatattcgttattttattctttgtattcagataccttcttgtaggtgagtttggattcaattctgtagaaatggggcaactgatcaaaggaatcatttatccatttatctactcagccggtatttcacttgctttcttaattatgtcttctgctgaaaataaggttgaaagacagagaatctgggtaatctatatcgtatcattctttattattttcttctgggctgcttttgaacaggcaggatcttcattaacatttatcgcggataaccaaactgacagaaacattttcggatggaatatgccgccttcaatggttcagatattcaacggaatcttcgttgttattctggcagttcctttcagtttaatctgggataaattaagagccaaaggaaaagagccggtatctccgttcaaacaagcgatgggattggcattgatcgcgctttcttatttcatcattgcacataacgtaaaagaccttggaaactcaggtttattggccatcaaatggttaatgttgctatatttcatccagacatgtggtgagctttgtctttctccgattggtttatcattggttggtaaactggctccgaaaagatttgcttcattactgtacggtgttttctttatttccaacgctgctggttatgcattggcaggttccttaggagcacttatccctgcaacaggtgataaattcaagaaagctgaagaaatgggtattaacctacaggatgttttagataaaaaagtaacccttacggcagatcaggctgcagctttcgataaagctcagttaccattacataaccctacttttgtaggattcgaaatccataacttatttgaattctttatggtattcgtagtactttgtggtattgctgctgtaatcttaggtttaatttcacctatcttaaagaaaatgatgcacggtgtaaactaattgtatcaacaaaatatcataaaacctctgccaagtcagaggttttttttattttcgtatgatggaaatttccgaagattctttattccaatccgtaaaggaaatcattagacaatcgcgcgaaaaagtgtttcgtatagcgacttctacgctactgctcacttactggcaaattgtaaaattgattgttgaaaatgaacaacaaggaaaagaacgtgcagaatacggaaagtatacactgaaaaaactttctcaaaagcttaccttggaatttagaaaagggtttgattatacgaacttttctaatatgcgaaagttttacacagcgtttccaattgttgacacattgtctcaacaattgagctggtcccattacagatttttcccactcaaaatgataaaaacaatttatttgccagcaaatacctgctgtacctcccaaacgaagaaaaattaaaacaaattattgaccaggacggaatccgttttgaactggatcagaaagataaaaaccctaattagaacttaatcatatatcattatgagcttaactttagatgaaatacaaaatttcaaaggaaaatatcccagacagatctggagcctttttttctctgaaatgtgggaacgcttctgtttctacggaatgcgtggaatgctggtcttctttatgatctctcagcttaatttccatgaaaaagaagctaaccttcaatatggtgccacacaggcattcgtatatgcctttacttttgtaggcggcctttttgccgataaaattttaggattccgaaaatccttgttctggggaggtctcctgatgatcgtgggaagtttaatcctggctacagatccccataaattctttttcttaggaatagcattcaccgtagttgggacaggtttcttcaaaccaaacatttcatctatggttggacagctttacaaacctaatgattctagagcagatgccggattttcgcttttttatgcaggtattaaccttggagctttactaggtggttatttatgtattgccattggtaaaggagaattcttaagtaatgttattgcggaagaaatgagatggcatattgcttttggattggcttcaatcgtaatggtagtaagtttaataaattttgtattcacacaaagaacattaggtagtataggattacagccgggacaccctttagcagaagtaaaaacagctccgatcccaaaatggaaagaatatggagtatacattttatcattgatttttgtccctatcattatgaccatggtagcgaaaacagaatatacggattattttatgtggacaatcgggccattaactttaatctatttattctatgaaatgtcaaaagtaaacgcctctgaacgtaaaaagctttgggccgctttggttttcattattttctccattatattctggggtatttacgaacaaagtggaggttctttaagtatttttgcggctaaaaacctgaacaaagatcttttcggattagatcctaatggtgttaataactcagggggagccttctttattattttccttgctccacttgtaggacttctctggatctggctgaacaaaagaaaaattgaacccaatacgattatcaaattcggattaggatttattttcctgggattaggatattatgttttatttgccaccagactatttgcagatcttcaggggattacttcattgaacttcttcaccctagcattattaatcattacccttggagaattatgcctctctcctatcgggttatctatcatgacaaagctttctaccaagaatcttcagggaatgatgatgggaatgtggttccttgcttcagcgtatggacagtatgttgcagggattatcggagccagccttgcgacatcaaaaggaggttccagcaactatgatgctttgatcacttatactgatggatataaacaattgggattgtacgcggtaattgccggagtggtactaattttgatatctccgtacgtgaaaaaattaatgcaggatgtaaaatagaaaataagtaattatgcttatttttacctaaatatcacaatatgaagaaaattttaagcatagttctcttacttctattaaattttcactttgctcaggtaaagtggatgaccattgaggaagctttaaaagctcaaaaggaaaatcctaaaaagatacttattgatttttatgcagactggtgtggtccctgcaagattatggataaaaaaacatatgggcattcagtaattgcacagaatctgaatgagaattattatcccgtaaagttcaatgcagaagaaaaaaagagtattgagatttttggaagaacattttccaacccaaatactgaacataagaaaggaagaaattctctgcatgagtttacacagtatatgaatgtcggcgctgttccaagcacagtatttctggacgaacatggtgatcctattaccattcttcagggggaattgtctgccaaagaactggaaccttacctggaactaatctcaaaagatttattcaaaaagattaagaccagggaacaatgggaggactaccagaaaaagttcaaatccaaaatcaaagagtaattacattttcaggcttcaattactttatataaactaagactttcaattttttttggaagtcttttttattttaccgaaattcggacctttgttttttcataccatattcggttcccgaatcccagataagaaatgactttagaaacttccatagaatatgtaaaaggaataggtccggaaagagccaaactcattaaaaacgtgttgggactgtctactgtagaagatatgctgaacttctatccgatccgctatctggataagagtaaaatttataaaatatcccagcttcaggaagaaagcagtcaggaaatacaactgaaaggaaaaatcacacaggtgcaggaaatccagacgggcaaaaccaagagattatctgctaaattcaatgatgataccggcagtatggatcttgtgtggtttcagtattcaaaatggctgaaagagcagctgcctgtcaataaagaggtttatattttcggaaagatcaatgttttcaaccgccagttttctatgccgcatcctgaaatagaggctgaagaaaaaaaagaaggcgatacccgtttgaaaccgatatatccgagttctgaaaaactgacaaaaagaggattaaatcaaagattttttcagaatgctctaagaaacatctgtaaagaaattccagggcttatcgaagagaattttccggattacctgatgaaaacctttaagttcatgtcaagacagcatgcttttctgaatattcattttccaaaggatatggagcattttgacaaggctgattaccggttgaaatttgaagaatcatttttctttcagctaggatatggcttaaagaagcttcatcataaaacccagtctcatggtaatccttttccaataattggtgatcattttaataacttttatgaaaatcaccttccctttgaccttaccaatgcccagaaaagggttttaaaggaaatccgtatggacatgaaaaggccaattcaaatgaacaggcttttacagggagatgttggatcaggaaaaacaatggtggcacttcttaccatgcttattgcgatggacaacgggtttcagagctgcctgatggctccaacggaaattcttgcccagcagcactataacggtattaaggaactgttggaaaaaacaggaattaatatccgtcttctgacaggctcaaccaaagccgcagaaagaagaataatccatgaagaactggaaaacggaacgctttctattttggttggaacgcatgctgttttagaagataaggttaaatttaaaaatctgggattggccattattgatgaacagcatagatttggagttgctcaacgcgccaagttatgggctaaaaataaaattcctccgcatattctggtaatgactgccactcctatccccagaactctggccatgagtttttattctgatcttgatgtttccgtgattgatgaaatgcctgtgggaagaaaacctattattaccgctcatcgccgggaaaaagacaggttgtatgtctataatttctgtaaagatgaaattaaaaaggggcgccaggtttattttgtatatccgcttattgaagaatctgagacattggattataaaaacctgatggaaggtctggaacacgttatggattatttctcagaatataatgtgactatgcttcacggaaaaatgaaaccggatgaaaaggatgctgcaatggcttattttgcatcaggaaaagccgaaattatggttgcaacaacagtaattgaagtaggggtaaatgttcccaatgcttctgtgatggtaattgaaagctctgaaagattcgggttgtcacagcttcatcagctgagaggacgcgtgggaagaggcgccgaacagagttactgtattctaatgacatctgataaattatctaaggaaagcagaacccgtatcaggacaatgactgaaaccaatgatggttttaaaatttctgaggtagatatgcagcttcgtggtccgggagatatcctgggtacgcagcaaagtggtgtagtggattttaaaagattagaccttattaatgattcagcgatcattaaaacaacaaaaaatacggtggaaaaaatactggaagcggatcctatgctgtccagacctgataatcagatcatcaaaaattattacatcaggtattacaaaggaaaaaataagtggagtaaaatatcataaaaaaaccgcagaaaaagatttcctgcggcccccttataaaactgttatttagaagaaattactttttggtctctgtaaaatttattttaatagtttagacttaatattttgtgatttggtgtgaaaatatttatataataatatgatgtagtcaaagccacaactattaaaataaattataaaaaacaaaatgaattattttttccaacttgcttattataaaaactaactgtgtttcgatggagatgagggaatgaaacgaataaaaatatctccaactacttattgagttttcatgattgtaccgttttgtttaaagatcttctgtgctttaaaattggaaaattaatataattcattttgttactaacatcgtgatttatataattttgttatagaaacaattacttttcattcatctgtatcttccactttataatgaaatttgtgtctgagtttacttttacaaatgtcagtatattaattcagatcctttttatattattttaatgattagttataaaattttcacctatttgtgaatagtatgcattaaatatgattttcaatcagttcacaataaattaacaaatcctttatccatcatactttcaggataaaattatctttattcaatcctgaagtatgatactgccaattgatcgttataacttctgtaagcacctttttcaacttatcaaaagactctggttttttcataaaaatattggcaccttttacaaaaatatcttctatttcattttcaggaatcggttcagaaaaaatcgctgtcaccatattgctgaattttgaatttgaatcaatttcttccagacataccatgctttcttttccgggaatcatatagttaatgaaaacaagttcaggtactaccgcatcatgattattcagatactccatcaggtttttaccgttattgaaacattgaacttttatagagattttcagctctttcaaaatatttttaaaaaaaatcaaggtgttttcatcgctatctgccactattacgttcaggaattctttattcatactgcattttagggtttattaccgtgctttgtattcttcttcgtctgccaataatcttttgaaactgagatggagtgattcccgttgtatttttaaactgggtacttaaatgcgccacactggaataattcagtttatgggcaatttctgtaaggctctgcttgtttcttatgattagcgcttttgcatgctcaatcttttgcagaataataaaattctcgatagaggtataggcaacttctgaaaacaggttggaaagatatccgtagctatggttcagtttctcagaaatatagattgatgcctttacgggaataatttcatcagagaaaacaagttccacaatagcatcttttattttctgtacaagagcggttttctggctttctatgatttcaatcccataatcctcaaggtttttcttaaaaagattgtgctgttcctgggttaggggctcatagaattccacctcgccaaagttcagcaacctgtacttcagcccgtgttctttaagtttttcgtccaatacctttttgcagagggcattgaaatcaaatttaacatacattttcatcctagtatatataaagccaattttatttagtaaatataacaaattatttcatttaaaagtgaaataggtgtatatttttacattttgctttatatacgaaaaaactcctgtattatttaatacaggaatttaaacactaaggatgaaaaaaatatactgataaaaagctgaatcagctcaaaaccaagcatatgaatgtattgttaaaagtgatttggttctgaaacaaagatgaatcaaaaaaagaactcacctgttatagaattacaggataaagttacaaaattttaagtcaatcaattgtgaattagaaattccatcagataatcatccattacaaaaccgtttccgatatcaaaaactccctcgtcgtaaactttgtagccctgagattcatagaagtttctggcagaattgtatttattgacattcaggattattctgttgtttccattctcagaaactttctcattcagaaactgaagcgcttcttttccaaatcctttccccttactttcgggaaccagataaatacggtgtagtttggttgtattttcctcataattgtgctcatatccgataaaaccttcatagctgtcattatgttcatcccgaataagataataatgataatccgggttttgaagatgactcagaatctcagattcagagtacatttcggagagcataaactccatttgttctttcgaaagaatgtctgcatatgcattttcccatgacctttgtgcaagatcctgaattaaagggatatctgatgctgttgcctgtattaatttcatgattggatatattatgatgattaaaaaaagtgaaaagcctaaacttttcaccctttatatgttgttcaatgatgactgacgaattttaagaaatgctcaaaattcattttcatcattaaatgttagccatttcagccttaatttttgcatgaagcccttctgatgcttttaccaaaggaagtctcagataatttttaatgattcctttttcagccagtattaccttaataccgcaagggtttccttcagcaaaaatcaaacgggtaatatctacaagcttattgtggatttcataagcctcttttactttaccttcaaaagccagctgtaccatcgttgagaattctttaggatatgcctgtgcaattacagaaatcactccgtctccacctgctaatgttacaggcaaggtatactcatcatctccggatactaaagaaaatccttcaggtttctttctgagaatatcaaaatactgtaagatattcggtgccgcttccttaatcaaaaataaattagggaattcttttgcaaggcgaattgttgtatctgcttctatattctgtcctgttcttgaaggaacattataaatgataatattttttcccgttgatgctaaagctttataatgttgataaagcccctcctgattaggtttattataatatggagatactgaaagtactgcttcaaatgcagaaagatctgcttcttcaatctgtttcttgacctcaagagtattgttgccgccaattcctaaaaccaaaggaagacgtttattattcaccttaatgatatgctcaattacctgtttcttctcctctgcagaaagcgttgcggcttctgccgtagttcccaatactactaaataattggttccgttttcaatattgtattcaaccagttttgttaaactgtcgaagtcaacggataaatcttcattaaagggtgttaccaatgcaacacctactccttttaaaatgctcatctgttagaattatttttgccaaatttaatcatttacagtaagaatttgtaataaataataatgttttattatacatatagttatatttgcatatactaaaagattatgaaaaataaattcttgttactaggaattgccctggcgtcccttactgcatgcaaaacggcctctgcgccgcagcttgtgaatgtaaagacccagaaaaatatttctattaataatgagctaaaaaatgatgaggagtttgtaaaatttattgagccctacaagcaaaaactggataaagaaatgaaccagaagatctcccacaccaatgtagatcttaccaagcagggtgataacagcaatctgggaaatcttttagcagactatacgtttgaaggaggtaatgaatggcttaaaactcatcttaagcaaaacgtagacgctgcactgatcaatatcggaggaatccgcaccacaatcggaaagggagatattttactgaaaaatgtatttgaagtaatgccttttgaaaatgaggttgtgattgtaaaaatgaaaggtgcagatttacagggcctttttgagtattatgcaaaaacgcaggtcaacaatcccgtttctcacttatatattgaaacaaagaacggacaggttatcaaatcgttaatcaacggaaaagtagcagatccggctaaagattattatattgccacttcagattatcttgcgctgggaggagacaatatgaaattctttgccagaggagaatccattgcaacaggaattaaaatgagagatttatttattgattattttaaaaagtctccagaagttgtagccaattcagatgttcgtttaaattttatcgggaagaaataatggatagaaaaagttttttaaaagcaataggtggcggatctttagcaatggctttagctcccaatataatgatggcggaagaattaaaaattcttgatgtaaaatccgcaaataaactgactattcttcacaccaatgaccagcatagcagaatagagccttttgactcgagctataccaaaaaccctaatcagggaggcttcgccagaagagcgagcttaattcagcaaatcagaaatcaggaaagcaatgtgcttcttctggattcaggagatattttccagggaactccttattttaatttcttcggaggagaactggagttcaaattaatgtccatgatgaaatatgatgcctctactatgggaaatcatgatttcgacaatggtctggacggatttttaaaagtccttccaaatgcgaagttttcttttatctgttccaattatgattttaagaatactgttcttgatgggaaaacttcaccttatcagatattcaacaagaacggaatcaaagttggaattttcggagtaggaatccagctggatggactggtaggtaaaaaacaatatggagaaaccgtttactccaatcctattgatgtagcccagcattattcaaatttcctgaaaaaagagcagaaatgtgatctggtaatttgtctttcacacatcggctacgattacagggacgaaccggataaaataagtgataaaattttagcggctaacacagaaaatattgatattatcctgggaggccatacgcatacattcttaccggaacctcaatcctttaccaacagacagggcaaaaatgtccttgtcaaccaggtgggatgggcaggtctccttttaggaagaatagatttttattttgatacaaacaaaaacgtacagcatatttcctggaacaatcaggtaatagatagcagcataaccgcataatatgaaaaaactctctataatttctcttggtattttagcatccctgcagctgacaaaagctcaggttatttcatccaaaaagtgggcagatctgttttcctacaacaagattctggcaatgaaagaagacaatggaaaaatcattgcagccacagaaaacggaatattctattatacaatgtcaacaggagaaattacgaagttgtccaaagccaatggtctgcacaatatcgggattacagcttttgattataatccacagactaaaacaggtcttatcggttatgaaaacggatctatggatgttattaccccacaggaaattaaatatattgttgatattcctattgctacgggttataacggaaataaaaagatcaaccacatttctataaccggagatcaggctgtcatttctgttggatacggagtttccatatttaacctgcaaaataaggaatttggcgattctgcatttttcctaactggtggggtttatcaggccagtaatgaagctacgatattcgggaataaagtatattccgtaaccgatacaggattgaaaagccatcaaatgaacactactttcccggtatactctacctggacaaccgaaatacccggagcttttaaacatatagattcggaatcagagctggcttactcaactgcaacagcggcatatgtttacaacaatggtgccccgatacaactcccgacaactttcgagaatatacgtgatgttgtgataaactccaataatgttgtggttacagataacagggtttatacttatggtatcaacggagtggcacaaaatgcagtaagccttggtgaagaatgcaatactgccataacagctggtggaaaaatcttaggcggaacagtattatcagggataaaggatgaaagtaacaatacttttaaaccttccggcccttattttaactatgcctataacattaatcttttcgataataatcagcttctgatctcttccggcgccagaacaaataattataatcacccatctattccggcgcaaaagccaagtcccggtttttattactttaatggtaccgaatggatctacccttctttctttcttaaaaatcctccaagcaatgtcaatgtcctggatgctattataagcccttataacaataatgaggtactgttcaccaattatacaatgtttgataatggtgtctacagaatgaaatataatgctacaagcaaagattttgaactggtaaaatattataatctgggggcccagccttattacagacgccctgtaggttttgctgttgacccgcagaataacctgtttgtatccttcggatttaatgatggaaacccgtctatgggaatttatgataaagcgagcgatgacttccttatcaagaaaataatccttgcgagcgatggaattcaaaagactgtttattatgaaaatatgctgtggactcctctgccaagatccaataatttctgggtctatgattataaaaatgcattgaacctttccgatgatacggactatatcctggacagctctaatggatttaatagttcgggaggaatattatcagtagcatttgataagtccggtgatgcctggattggtacagacggaggtctaaggattatgccaaacgctgcatcagaaataaaaagtgcccagcctaaagtagaacctatagttatagagcaaaatggtttgggtgaagaacttttcagagaatcggcaattcttcagattgcagtggatgcaggtgattataagtgggtatctgttgacggtggtggtgtttactacctgtcttcggacggtcagagaaccataaagcattttacaaaggaaaattcacctcttcctacaaacagtgttacggatataaaagttgataaaaaaacaggaaaggtatattttgtaacgtataatggtattgtaacctatcagggtgatgtagcagacgtcacgtctaattttggtgatgttgtggtatatcctaatcctgttgtgtattccaatttcaaaggtaaagttaccattaaaggtcttgcagaaaaaaccaatataagaatcgtagatgcagcaggaaatgtagtacattctgccgtagcacgaggaggttattatgaatgggatcttaataatcagaaaggaacaagagtagcttcagggatttattttgtcctgatgaccaatgaagacggatctgacaaagctaccgccaaaataggagtagttaattaatgaattcacaaaacggatttttactttcatttataaaatatggagaaaacgatgctgtactgcattgttttacagaagaagaaggttttcaaagctatttcctaaaaggaatttatgctaaaaggaataagaaaaaagctctgcttcagccgctgagccagctcaatttttctgtcaatccatcacggggtaacggaatcccgtctgtttcaaagtttgaactggtaaaaaacaatgacatttatacagatataaaggtcaatactgtcattttctttatttcggactttctgagccatattcttaaatatgagaataaaaatattccgatctattccggtatagatgattttgtaagtgaactgaccaacaaaaattatcaggcacacctgctttttttactggctattttaaaaatacagggagttgctccattattaagcgaaggaaaatttttagatcccgaaacgggaactttttctccgggaatatgccatcagctattcaatgaggaaatttctacactatggaaagaagcgctttgtgcagaaaaattttatgcaacaaaaatccattcttcattaaggaaagatttcctggacagtcttttagtgtattatcactatcatatcacggatttcaaaactcccgcctcactggaaattatccagcagatatttgagtagctaatcaacagatctactgtttactttcttttgttttttcagtatcctcaggcatttcagtttccgattctgcaattacctttttggaaaatctcggctgcagaatcttggcaataagccccgtccatcctgtctgatgggaagctcctactccacggccgttatctccatgaaaatattcatagaaaaggatataatctttaaagtcaggatcggtctgaaatctttcatactgaccgtgaaccggccttttcccgttttcatcttttaaaaatattttcgcaagcctcttgtttaaggcatctgcaatctgatcaaggtttgaataattaccgcttccggtaggatattcgactaaaaaatcaggactgtaatagaagaaaaaacgctgaaggctatcgataatcaggaaattgattggaaaccacacagggccccgccaattgctgtttccaccaaacaacccgctatcactttctgcaggagtatattttacggtataatccgtttcattcagagttaatgtgtagggattattttcgtattcttttgataaagcccttactccataatgactcaaaaattcatttgggttcagcatccggtttaaaagtcttttcagacggtggccacgaagtaatgataaaaggtgtttggaatcctggcctttgacctcccatcttgagaccagcgctgccagttcaggcttattatccagtacccatttcattcttttcttgaaattgggaaggttttcaatcatttcatcatcgatgacctcaacggcaaacatcgggatcagcccgacgatagttcttaatttcagatacatatgagttccgtcactggaagtaattgcatcatagaaaaattcatcctgctcatcccaaagactgaaattctcatctcccatattatccagtgaatgggcaatcgacaggaaatgttcaaagaatttcattgccatttcctcgtatactttattgtaaagagcaagttcaagggcaattctcatcatattcagagcaaacatagccatccagcttgttccatctgactgttccagctgttctccattgggcaaaacagaatttctgtcaaaaacaccgatattatcaagtcccaggaagcctccttcaaaaatattattcccattaaagtcttttttgttaacccaccaggtaaaattcatcaacagtttctggaaagcactttccagaaattccaggtcaggcttatcttttaaatattcatcaattttaaataccctgaagaccgcccaggcgtgtacaggaggattcacatcactaaggtcccattcgtaagcaggaagctgcccgttgggatgcatataccattcaaacaggaaaagtttcagctgatgtttggcaaaatccggatctatcagtgaaaagctgatggtatgaaatgcaagatcccatgttgcataccaaggatattcccatttgtccggcatggaaataatatgctcgttgttaagatgcttccagtcgaagtttcttattgtttcccgggactttggcggcggcatttcggcagggtcacctttcagccatttttccacgttgtaatggtaaaacattttattccacaacattcccgcaaaagcctgtctttgcaccaatttttcatcatcagaagaaattcctttctgaatttccgcgtaaaattcatccgcttcattctgcctttgctgaaaaagtatatcaaaatctttaaatggatcccgtaaatctttgtcggacagtctgaattcaaatattttagtttctctggctttaaaatcttcatcaataaaaaaagaagccttggtacctgcattttgcggatttaccgactgggaatttcccgtcatcacaaaattattgattccgtctttgcaatattttgattcattagagcattgataaagcttttcattgttggtttcattgttacagaacagggtttttaaagactgtcttgcatacacatttttaatatcaatatcctgatgatttactgtaatatggtcagcatcttcagcagacagttgaggcttatagccatcatacccccagttccaggtatttctgaaccagactgtcggtaaaatcacaagagaagcttctttctcagatttattgacaactgttaacctgaccagaatatcgtgctggctttcctttgcatattcaataaagatgtcaaaatattcattagtatcaaaaattcctgtatcaatcaattcatattccggatcgtcttttcccctctccgcattgatttttaccagatcttcataaggaaaagcattctgaggatacttatacagcatcttcatgtaagaatgcgtaggtgtggaatccaggtaatagaaatattcttttacatcttcaccgtgatttccctgtccgttggtcagcccaaagaaccgttctttgatcattttatcctttttattccagaatcccacagaaaataccagcttctgaagatcatcacagatgccacatatcccttcttcgccccaacgataggttttggcttctgctgtttcatgattggtataattccaggcgtctccgttttcactgtagtcttcacggacaagaccccattcccggttacttacataaggtccccattttttccaagaaatatctgagattctctgctgttctgacatatgtgtagttatgagtaatgagtaataagtaataagtaatatttagtattgtttaaagcaatgagagcaacctcaaaacattaaactttgaactgttaaatcttgaactgcactatcctcctgtagaaaaactttcaaacgtagtcattccgccatctacaaaaatgcttgttcccgtgatataatcggcaagatcactggcaaggaaagcagctaaattcccgatatcctgcggctgtccgattcggttataaggaataagggtaagaagtgaattaagcgcttccggagtatcccaggcattcttgttaatcggagtctgaatggccccgggacaaatagaattaacacggattttatctgcaccatattcctgggcaagagtctgcatcagcattcttacagcacctttactggatgcgtaattggcatgtcctgcccatggaatgatttcatgtactgaactgatgtggataatctttccgcaagcgatagaacgggatgtatctattccgcgtcttaaaaattctttaatggcttctcttgcacatagaaactggcctgtcaggtttacacctatgacagcgttccactgatccatcgtcatttcggtaaattttgcatccttttggattccggcattattgatcaggatatctacggtttgatattcagcgactacatcccggaacattttcactacctgatcttcctttgaaacatcacattgataggtcatgccttttccgccggcatctgttatttctttcaaaacagctttggcttcctctgcagatctttctgaagaatggttgacaatgaccgttgctcctgccgaagctaatgattttgctattccggaaccgattccgctggaagctcctgtaaccaaagccacctgatttcgaagtgatatttccatgttttgtaatttgatgttactcaaagttatggaaagatatcagcagatgaaaaattatgattttaaaattttattaaagtttcttgtacatgagatattgaggcccgcttctaccaattctggttttaccatcgtaaatgtatcctaccttaagataaatatgataagctgaatcgtttttctggttgacggccagtacaatttcatcacagcttttaaaacgatcttttacaaaatcatcggctttcaacatggctactttcccgattccttttccctgcatttggggattaatggataaggaacgtaataaagctgagttttcattatcagtaagctcaaatttatcttttccaaaatcaagtacaaagaaacctgcaggctgatcgttgtaaaatatagtcacgggaaatgctttgttatcatcccgctcactgatgctttgtaaggcttgctgaacagtcgctgtaaaacgcatctgattttcatccaaagcataactcaacgcagaaagatcctctggtttaaagaattctaattgtatcatattagtgatggtaaatatcttcatacattacgcctgcacggatttccacaggaagtttattttcctccgggacaacaggacaattgtaatcgtaagcattataagcacagaaaggatgataagatttattaaaatcaagaacaatcgtgtctcctttcggaattttcagatccatatattttcctcctccgtaggtctctttttcattggtagcgtcgcggaaaggaaggaagagatagtctttatatttttcctgtttaatcaaagcaagactttggtatagcgtaactgtgtaagatttaccatctaaggtaaatgttgctttgccatactcctgataggtctttgttttccctgaggaagtaggaagctcaaagggttttgtatcttttgacttaacaaattttgcagttatcctgtatttggcattaaagggaaaaaatggatgtcctttgaaatttttaaaattatcacctcttagaggggtctcttttggattaaaatattcatcattaagttccttctgaaatttctgtacctctttctcttcctttgaaatcgttttctgagaaaaagcccataacggaagaagtaaaaagagtactatatattttttcataagtataaattataagtaaagctatgaattttcataaacaacaaaaagttaaaattctgataaaaagtataatctgttgtaaatacaacaagcttccgctgatctagcatgctttttgaaaaacaaagctcatggacagaaaaaaattcatcaggacaagtgctttggcaatatcataattttatcttctaaaagttaacattcatccaattttctgcttttaaaataaatcaatattgaattttgttttctaaaacaaaatttaaaataaacagaagaaaaacaattaacaaaacaaaattccaactaaattgctaatattagtaaaacaactgctatttctttctttaatagactaaaacaattttcgctatatttcctattgataaaataaatagaaaccagaactaaaaccttctgttgttaattctacttattatattttaaaggcaccaagtcctttttatgtatactttatagattttatttaacgattgtcataattttgtatagtgtttttgtttaagggggtttttactccaatcttcccaaataccagtatatggattgtacccacattttaatggcttagacgtatctaaactatctttatttatatgtgttttttcagtaaaagccctgcaatcagtacagatatacctgaattcacagtctttacatatttctatctgatctttagtaatgttccagtatttcttaaaccctggatttttgataacattttctaagctggtgtcatgaatgtttccaaaattttcgggcattaaaggacagttttttatattaccatcattgtcaattccaatttttttatgtaaacaagagttatgattgaaggcttccagaacttttgtgatattggtgttaaagtattttatatcaatttttccacaggaagatatatctatgttgtcttttataaagtttaaaataaaccggtactcatctttcaccctgaacggaacttttttacaattgtaaaaggtaagatgatataccctaatagtttttacattcagttcttcgatgaaatttctgtctatattattgtgataaggagaaaaaatttcaattcctgataaaacagaatcggcgaacgtttgttcaattcggataatatcttcaacagtaaaataatttttactgtgaatcactaaatattttattcctaagttttctacagattgtttcaatttttccaaaatagaaatatcactgagttcaataaataaatcattgataaatgatggattgttatactcgtatgaaataggtggaaagcttttatcccaatcattttccgtaataaagccgtattctttatctaatagtaaattcaaatattggctaaaaatttctttagattcatcatcataaagagttgagatttcttctatagactttacttttaattcttcgattatatcataaaactccaaaggatatacttcagatgtttctctttgcagatcagaaattagtattctttgtgcacctcttgtaattagagtattgctgaataaattgaaatacctcatagtaatctagtaagagctttaaacggcttttcccggaaataaaaattagatctatattttttagattctaaaaaatatactgtattactgttacgttttacatttgttctacttccaaatttcgttatatttttaaatgttaaagggagtttatgcttttccccaaatgtgtttatcatagatattctgctatttctttttctaatgaataattacatattttagataaatacccaaattgccctattgggttcacttccaaaaaatagtatttctctccgcttttcataaaatcaagagaaccacagttaagatcaagaagctgcatcaactgatgaactttttcttcaatctcttttggtaggttatatcttacatttttattacgcttttcataattataatttctaaaatcgactttagtctgctcatcattttgtgaaaagatagctattgaccaacatttaccatttaaataaaatgttcttatttcaaaatccttttcaattttttcctgaaaaaaagtgggaaagaagtcttcattttcaaattcttcaactacagatgtgaacatcattccattcgaatttttataaaaagattcaagcattgcgtttcctgcaatagtttttacaatcgtttctcctaaaataacatcatcagtattttcagccagataataggacggaacatctaaaccgactttttctgcttcttctaatactaatagtttatttactaagctattactctctttattgatatgttttatagtttcaagttttttctttacataatcttccagccagtgctgagtttcgttcatgttgatattaatggaattatttttatatcgaatacgcttaaaattcaatcctccccttctataccaaacactgcttatatcatctaaaaaaaatcggttagaagaactttctaaaaaaaatctttttttgatgattttaatttcaaatatttcatcctcatgtatacgtataaattttttctccagtactatcagccattttattacatccgtagtagaaatatcattattatcagaaattattaatatcattttttacttgaattattctttaaaaattcttttgttatttttcttctaactttgaagctttgtagcccaataagccttctattacgattgatatttgctgaatcctttatgatttcttcatcagtacttttcacgccatatacgggccttaaatgattaatctgaacatatctttctaccatttctacataatctcttggtgggagatctccggatcttacataatctaccaacttcgttttgaaatattcataatcttctatttgagacatatgatttaaataaactaacattggcattaaaacaccatcatccgtttcaagtccaattttttgcaaagacggataaccataattattaagagtccattttagtagttcagcatttttcttgaaattttttaatgattgttgtcctgttatagaatctttagcctgatccctgataaaagctattctaaaagaatcaataagctgtttgtttagagactttttccattctgtaactttctgctcaacagttatactatcgattccatactttttatatagcttaaaaaaatctttgtcctctcgtttgaacttccagtatggagcaactagcgggataagtttataaagacttttttttcctccaaagtttttattgtatttatcagaaaacttaatataattttcatattcttccattcgttcatcatttctcggctgatatttacggaatagttttctaaattttttaatagccgcaagagtatcattctttaatctataagtactatcaatagaatttacactattgtaatatgcaatataatcatgttgattatttcggcaggatgttaaaaaagaaaaactgattaatagaataactccgcttatcttaatacatatttttttataattcattaaaaaagattttaattgactcccttataaaaccaaaaaaagctaaagagaaatcctctccttagcttctaaatgtttaaatgtactgcttaggcaggttctgtaataacagcaactagcttattgtctacatatactcctgtatcgcttccacttcctgtttcataagtccactgcttacttgtttctgccattaacccacctgtgatttttgataaatcatttaattttttgttttctaatgaagagaaattcttcattccatttagttttttcataattgatattgttttaaggatataaatatataaaacattaattaaataactctacataaaagtgatttttttattatgttaaatacctaaattaaagccttttacaatgaaaataaaaaccatattttttcactcattttagactaatcgaaagtatagaatatttttatataagtttatgacgttttttctaaaaaatccttaattatttatctttacagaatggtaataggtacaagacttaagcaagcaagagaaagtaagagaatgagctaggaagaattggcacttatatcaaaaacaacacagaaaactatatcaaattggagaacgacaaaaacattccccttttagattatttttgatttaatcagatggaagagttttaacttcaggatattttttacctaaagaagcagttaattgataagctatatgcttactcgataattcgatatctaaatcttcaatttcagaattgttatgatctaataatcatacagattaatgaaaccattgacagtttcaaaatggctataccattccggcagaagcttttatttataattgattttgtgattcaactctaaaggattattttcttcgagaatagatttttgcgcttctctgatcatttcattcatatctttttcatttccctcaggatctgtaaatataacttttttggcggttttggtattccaggggtcattataatatgattttcctagctgctcatattgtgtccagtcgattttaattgtttttgtccttatatcaaaccaattgctgcctttttttacctgtattaaattgaatgagtaatcatgttctgtatcttcaatggaaatgattaaaccaggtaatccattgaaaatatagggaccatcattaaaaggcaattccgtcgtaaaccaagcaatccagtttctaccaccataactaacttctgctttttgcgatttatattttccaatagttttttgttccggtatgattttccaatttagctgttcatcaatcggtagaacataatttgcctttaagtaagtaataattttctctatttttttattaatgatatcttttttaatataaaattgattttcaacccccataatatatcctccacttttattaatgagcttcagggaatcagcatttttggacatggaatctctaaaaatagaagtattattctccaaatccaaaatcatattttcagtattaatattttcaggtttttccttacttgttctatatttagcttcataaataaagctaaacttttgtgaaaaaaaagatgttgatagtagtaaaaaaaataaaataaatttcaatttgtgtggtattttcatagaatctatcgttttttgagactggattgattaagaaatattgttggataataatacaattataaaaaactaattgttcatctttaaagtatcaatcttggaaattgtctagaatttacctaatcatttaaaactttcctatatttataaagtaaataaaccttaaatatcaatataacattaacaacaaccataaataaaaataagataatttttattatcaaaaacgcagtgtcaatctgttttgtagattcgtctgctttttttacaaatgaaacagatatagtatcatttattttatattttacatttttatttatactaagattttttttaagaagaccgtaaataatagtgtctgttttatctgatatagaataatcattttcaaagtataatgaatctttttttttaattaactgcttttccaagtctattctgaatttatcgtattcactagtcctatccttgaaagtactatcaatttttttatattcgttctttattctaaaagcatttttcttattattaagcttcctattaataacaaatatggaatcagattctaatttctcgccatttacaatatataagtcattataattatgtctcttcgctctaagtgaatcttttttattcattggttcaaaattacttatagctgtatattgtggttctagtttataatttaaacgtttactactatacatttcatttttatctgaaggaaaaaaatctgccataatggaactggctaaaaatagtaaaacaatggaaaaaaaaattatataaaatttatatataggagcctctttttcttcaattacttctacactattaacattaataattctgtgatgaaattttgctcctaatttattcgcattatagtaagcattaatcctaacaaaatccttatttttaatttccttagtattaaatttaagtgtcttgtgttcaatttctaaattacaattaaataacagtgttttatctataactttatactttttccattctcctgttttatctgtggtgattagagaaataggttgttttatttcgtcttcttgaatatcttcatctccaagcataataatagtaccagaataaaaaaataaatatttacttaactcttcatctttaaacatcattttaaattctgaatgattagaaaaatctacattattcatcctaaaatgattgtgcagtaataatatttatttttttttacgaattctttgatataaaattatagctagaagggtagatgtaataagactaacaatagcaatccaatcagaggaagataatacatttaacatggttatttatcgttttttgagttttgttaataaactaaatatattaaggattacatgtaccttttataatcttaattttgaactttcaatgtacatactataatataggtgctgtctgacttatttctaaataatattccaattttcctaaagtcgaataaaaataaggatattttttaccatcaataatttctaagtttggaattttcctatttacaatttgagcatcattttctccataagtaaaaatttggccacctcttgcaaattcatataaattccaagatattacatctgtactttcaaaatatgatgtaagtctattacatattccactgtctccacttgtttttactggcagtacaatatttattaattcagtattttcattaaaaatctttgatgtgatatgagttgatttatattgtatcccatctaacctatcgttatttcttatccattgcagaagtaattgtggaattatatattcaggtttaaatgtatccattgggtctttgacctttacactgcagcacattattataggaaaagtcataaaaaatctgtataactcattaatatctgtacaatctttagaaggtggagttagatcaagtagttttatttcttttatatttttaaattttatagcctgaattttatcgattgacggacgatttaattcttcccaacagatgtaaatcgttctacccagatataaactaggaaaccccggtatgctaaatctttgggttgagaccttatttcttaattcaaaaggaatgtgaaacatttctgaccttttgtacagataattcttatcacttaatctaattctgaaaaaactttcatttaatgcatattccttttgattaataattgcatataaatctttaaaatcattacggaagactgtatgaagcttttcataagccttgaaaggattcccattataatagtcttcaaaacaaagtattagactttcaatgacttttccttgaacttcttttacaaaatccgatgaaatataatttttttcaatataaattggtcctggatctaaatcattaactttttctagaagtagttttaatttagtaataataaatgttttaaaattatcgtttgtagtttgatgtaacggtaactcaaaaattttatcctttaaaagttcctcgaatttcatgagttttcaatagttaaaagttattttatagtccactcaaaataaactaatcattattttcaattcctttattcattgtaatgattaccagtggatgtttttgtgagattactttaaaatattattcaattatctccaggaatttcgtaaacgtcatagaatcctacttttctcttgcctgatttattagtaattaaaacttcttttgcttttttatttttgatttcttccatgtttgatataaaaggatcaaaaacatatgatctcatatagcctaaattaaattctttatcatgcacatttacttttacttcagcatttcctccaaaaaacattatatgctcttcttgatttatattcaaaaaacctttatcaaaactttcatccagaacagcccttaatggtggtaatggcaattcaattaaagtattttccgccttagctattatagattcaagtgtgtgataattattctcgttaatgtcgtttctacttatgtccttaaatcttatcatgtgcaaagtttcaactttgcataacttttcaagatagttaatatagaactctaaatcttctgggattttatttgcaatgagtttttttgtaaagacagattctccatttaccaaaaatgaaaagcgaattccttcaataattttagcaaaggatttataatattctaaaagtactcttggatttttaataacttcatttatttcagattcataatttatattagctcctttagcaccttgcataaatgtaatagacccttttgctacatctgtttcaaaggataatacaactttcccttctactatatctttgtatacttttacgttaaaatccattacagacataccatcttcaaaaataatatcaattttaccttcatacgaaggaagtttcataatgtataaaaattccatgtctgataaatcttgaagtttgaaattatctacatgcattacaaaatcagataattcagttttaggaattctgaaacttttttctgcggtttttccttccataaaactttttaatttactaataaagtctttgttatttttagttgtgaaatgtactttctgttgtaagacaccatcaattttttctattttttcaataaaaaagttcgaggctgtattggtgccaactgttacattatatcctagttttttagcaaatttgtaggtactgtcagttgaaactttattactttttaggtctaaaaatatattttcatttatatggtcgaaaattaaaggaaataattcttctccagtcccctcaataaaatttataccataactacttagcttattctttttaggctgtgttaacgaaggagcaataaagaaaacctcttttttattgtcaccaagttgttttaaaatatcagtaaaaataaaatcgatattagtatcttctagagaataacctataaatagaatacagtttgtcgccattttatcctttaccgcattccaaaaaacggaattttggctgttagggctaaagaaattcgtataatctgtttttctaataattattgaattactgtcagctaaatgtccatgaattttatatatatgtgtttttttagtattagctaaactaatatgactattattatataaaacttcacaattttccttataagcaccttcaaatagtccatcgtaatttgttgttatgattgttttaaaatgaggaattgatgaaattatatcgtggacaaaagtagactctggtagctttgcataattttctttcagtatatttataacttcattattgctttgatataagtgaaaaatatcatcagttaaatctgctaatgaccgtgtcggttcaatatattcttttgcgctagctggtaaactattgtaaaaaatactttgaagttgagctcccataggatatccggcatattttgataaaccggccccagcaaaaagaatcacgtcttctctgcgaattaattccaataacctctctaaatttggtgttttttgcattagtaattatttgtactaaatattatcttattaattatgtgattttactatactaacttttaactattttataaaaagttgctttacttccaatattaaaagctttcataatttcctcaattggaacattcttactttcataagagctctttactaaaggtgcgattttttttatatttttcgatcataccctttggtcttcctccgtttttacctcttgccctcgcagccttcaatccagaatttgttctctcaatcaaaccatttctttcgtgctcagctaaaacacagaaaatctggaaaattaattttccactcgctaaacttgtatcaatgtgttcagaaatagatttaaaatgtatttctttttcattcagctctgtaacaaactgaattaacccaagtgtagtcctcccaatcctatctaatctccatacggttaaggtatcccctttacgtacgaaatttaataaatcgttaagttgcggtttttctgatttaataccactaaccttatcaataaaaatttttcaattcctatattctttaaagcatcagtttgtaaatcgagattctgttcaaacttgcatacccttgcatatccaattaacataagttcattttactcatttatttcaaatatattgtaatttgttttcatgtacaacgaaaatgaacttagaaaagaacaaatagctttactaacgagatattaatagatgtacgggaaactgacctcttaaggataaataaaaataaatattctataagtaatcagtttacggaaaaccgtagaaatgaaaagaactccaattaaggagttctttataatcgtcttcttcaatcattgaaataggctcaccaaagagactaatcaaggtcactaaaatcatccaccggagcgtaagggtttaccaatgaactggtcaggagaacagcacggatatcaggattgttttcagcccagtgaataatctgttccagcttttcttccctttctttcatattaataagactctgatatttttacacgatatacgtcagaagaatttctcttgattgattctacaaaaaaacctccttcttcgggaataacttctttcagatcaaaacttttgcaatctttcggaagacctgaaaatatcagggtaaaccaaaagtctttcataaaaggaaccggtgtccagtacggtgaaattgaaatattttctgcgtggatcagcttacttctatggtcagactgattatcaaaaagataggtcgaatgccagatcctgatcagatttcccaaaaacggagatgccgggaaacaacaatgcacaataacctgcctctcttcttctgttttcgcctgaagagattccaggatttcctttgcaatgaccggttttacaattacttcttccacctttttatgagtaataggtaatgagcaacaagtaatcgggattacttattgctcattattgatgttaatattctaattctaatttttcttttgtataatttcttacttcatcggtaagcgcaggattttctgccagtttctgtccataggatggaaccatttccaggagttttgctttccattctccatgaagtttttccgggaagcatttttcaagcacattcagcatggcataaactgctgtagaagcacctggcgacgctcccagaagagaagcgattgttccgtttttgttcacaactacttcagttccgaactcaagtttacctccttctttttcatctttcttaatgatctgaactctctgtcctgctacctttagttcccagtcttcttctttggcatctttgatgaattcacgcaaatgctgcattctctgagattttgtcatggcaacctgctggataagatatttcgttaaaggaatattgtgccaccatgctccgaaaagtgatctaagatttttcgtgttaacactttcaggcagatcaagatagctcccttctttaaggaatttggtggagaatcctgcaaatggtccgaaaagaagagctttcttaccatcaataattctaaggtcaaggtgtggaacagacatcggcggtgcatctaccgttgcctgtgtatatactttagcctgatgtttttctaccagttcctgattatgacttaccagccactgtccggaaaccggaaaacctccgtatccttcactttctttaatatccgaactgtccagtaacggaagcgcatatcctccggcaccaatgaatacaaagtcggcaaccacttcctgtttgtgattattgatcctgtcttttaccttcatttcccattgaccattctctctggcatcaatatcttttacttcatggtacaggaatacttctacgttggaatcttccaggagatgtcttcccatctttcttgtcagtgttccgaaatttacatccgttcccatatccatttttgtagcagccattacctcagactggtttcttttgctcattaccaatggaatccattctctcagtttatcgtgatctgtagaaaattccattcctgagaacagaacagattctgtcattttatcgtgacgcttttttaaatattcagcatctttttctccgaatacaagactcatatgcggacatgaattgatgaattctttcggctgatgaatatatcccttagtaatcagataagcccagaattgctttgaaatttcaaactgttctgcaatgctttctgccttggtgatatcaatagatccgtccggcttttccggagtataatttagctcacaaaaagcggagtgccctgttccggcgttgttccatgctgctgtactttctttggcaaaccttcctagcctttcgaagattgcaatttcaagatttggatcaaattcatgcagcagcgttgccaaagtggcgctcatgattccgccgcctatcagtacaacgtcgtatttaggtttcggtgttctgcttgtaagcgattgtgacataattttaaattttacttcaaatttcgggaaaagttttaaaaaccggaacgcgtttaacgattttaacacgttattttttgagtcagaaacacttctttagtacacaacaaaaagccatcgaaaatttcaataaagtactattgaaatcattgatcattcttatataaaaatgaataaaaaaacttaagcactggatgcttaagttttaattatttacaaacaagatttaataataaatcccagtttaattcagttttgccgtcagttttttaaactgtttctcagcatttttaccttcataaaggatggcatataccgtatcaataatcggcagcttaagatttttctgttttgccgttttataaatggaatctgcagcataatatccttccgcaaccatgttcatagactgaatggcagattttaccgtataaccttttccaatcaggtttccgaggtttctgtttcttgagaaaagtgaatatgccgttaccagaagatcacccagataagcactttcgttcacatctcttggtgcttcatagatggcttccaggaaagtttccatttcacggatcgcattggaaacaaagaccgctgtaaagttatctccatatcctaatccgcttgcaatacccgcgcctattgcaaaaatatttttaagaatagcactgtattcgtttcctaaaatatctttacttgtatgaactttaataaagtctgagctgaaaattccttcaagcttttcagctgtttcatcttctgctgctgcaatcgtaagataagaaagtctttccatggcaacctcttcagcatgacaaggtcccgcgataaccgcctgatttctgaaaccgattttaaattcatcccgcagataatgggctaccacatcatttacttttgggataattcctttaattgcagagacaaagatcttatcagaataatcacaagtcatcttatccagtgtatcagacagatagatcgacggagttgccagaacgataacgtcacacgcagaaaccagttcattaatatccgttgtcagttttaaacttttaagattaaaatgggcagccgtaagataagtcgggttatgtccgcgaagctcaatagctccttttacaaattcatttcttacgcaccagtgtactactttgcagttttcaacaagcatttttacaatagcggttgcaaaacttccgctacctacaactcctacagaaacatcctttttattcttttttggattcgaagattctgaaataattttctttttagccataattggaatgtgaactgcaaagatattaaaacaaagacggaacgcaggctttgaaaccatgataaaagccattttctgaaaaaattaacacttcaacacaattaaacagctaattaaccgttaaatacagaaaaaactgaattttaattaaaaataactcacaaaacttatttttaattaaatttgcagcttcaaaaccgttttaaatttactaagagaagaaatatgaaaaaatttctaaacagcaagaagaacgtaaacattctcctgggagggcttttattagtagtttttgcacaaggtgtcttcatagcaaagctcttttctgaaagagatgataaaacctacgaagtgaatcttgtaaaaataaacactgaaaaagacagtgtagattacctcaaaatgaaaactgatcttactcttgtagatcagaccgttgaacagctcaactccttcctgaaatccaaagacattaccaacgaaaaactgatgatgcttaatcaggacagtatttcaaattctatttatctttccaagcaggctaaccgatacagccagtatctggtggatcttcagaaaaaactgatgcaggtaccattaggaatgcctacagatggctatatttcttctaattttggcgtaagaaaaaatccgattccgttcaaaacggtttttgcttcagtaagatcaggtgcgccagcagaagctaaatcggcagttgctgcagctccaaaacctgaagtaaaagctgagcctgttgaaaaggtcatagaacttacagacagctacggaaataaaagagaagtaaaagtgatggttactccaaaagctgctcctgtagcttcaacatcagccccggcaactaccaaagttgctacgggcaataccacaacacaaacaactgttgctgaaaaaaacaacccacctgctgaagctgatcagatgcaattccacaaaggtctcgatattgctgtggcttatggttctgatgtaagagctgccgctgccggaactgttattttctcaggacagaaaggcggttacggaaactgtgtgatcgtttcccatggtaacggattggctacattatacggacatttatctgaacttatctcaaaagtgaatgataaagtaaaagtaggtcaggtcattgctaaatccggaaataccggacgttccacaggacctcatcttcattatgaagtacacaaaaacaatactccggtaaacccgaaattgtttatgaatctataaaaagaaaactgtctctctattatgatataaaaaaacagctgccaatgcagctgttttttattttaaaatcctaagcgttcctttcggatgggtgaatgtaccatcggaacctgcaatatttgaatacacaatatttttattgtaatcctgaacatgagtgacattaaagccaagatgaggctcatgccaatacaccataaaaacattctttgctacttctacagcagtatattcaaccgtatcggtactgttttttgaacttcctgctgttcctgtaaatgtcatggttttgttgtctttaaaatcgagaacgaattttactcctccaaaatccacttccaatttatggccgatggccggatatggtgattttaaatcccattccatttctttaaggaaaacctttactcccatctccagttcttcttttcccggaagatcaggatattttttaaccataaaatcaacaatagaagatgaagttttgttctctgtcactgcttttttataattttccaagtaacccttcacaaaatccagagattgtggagatgtagatggttctgcaaaatgggaaggaatgacctgctccggatttaatgctttcatggaatcaatctgccctatccactggtcaattgcttttacattctgagtgtctgccatccatagatgtgagtctacagaaactgaaatgccaccggcaatggttttaatggaagggatccaaagaaagctgtgcgcaggatcttccggattctgtctgatctcaattttgtttccttcaagatcatggattgaagcagctgcctcaggaactataatttctgatggagcatccgccttgagttgcggtttccatactcccatcttatcatcttttgaagctgatatcaggtaagctgtctgagccgttgagataattttagcgttaggaaaggcttttttaatgacatccaatccaaaataaaaatcgggatcactgtgcgaaataaaaacggttttcagattctttcctgttgcctttatctctttcaccagctgttcagcatattgtttctgaaactgggcatctaccagtatagcgtctttatctccgtaaataatggtagaagtaatcgggaaaatagctttggttcccggattatatacttttactttgagatttcctgcaaatatgctgataaagcccagtattgcaagtaacgaccataattttttttgtatcatttctgttcttttatatattaataagctgctgtaaaacgttcacggatgtggttgttctgttctaattcatctaccagagctactgctacatcttctacagacagacggcttcttccgttttcatcaaataccggagtttccagtgcagttcggtattttcctgttctttctcctacattagcctggttcatttcaattgcaggactgaagaatgtccaatccaacgtgttattttctttgattttatttaaataatctcttgctgctgttgcaccgggcttgtaagcttcagggaagtccggagtatctacaatctgaacgttatccggtgtgtaaaggcttcccgctccacctactacaatcagtctttttacgcctgactgttctactgctttctcaatgttctgagaaccgtttaagaagtcgttgtaaagattaggatttgtccatcctgcattgaatgtactgattacagcatcattccccttcagtgcttcagctaatgcatctacattgtttacgtcaacacttttagcggttacattttcctgtgtttttaccttcgacgcatctcttaccaatgcttctacagcatatcccctttctgccaattctgttactacatgtgatcctacaaatcctgttgcaccaattactgctacttttttcataatgttttattttttaaattaaattgtaataatttttgttacatttaagggtaaaaaaattttattcgaactgatcggtaaattcctgtaatgatttgtctcctaaaaaattaataaccaaatgatctgtttcctcaaataaggtatttaaatgaatatttatttctttcccgacactgcatgcgggattgggattctgatttttctttcctaatacttccgtatttttaactgctttatagatctcagaaattgtgatcatatctgcattttttgcaagctgacttcctccttcttttccctgtctgctgataatcagacctgcttctctcaatacgctgatctcctttcggacgatcaccggattcacattgatactaccggccatccagtctgaagtaagccactcctgaggactctttgccaataatgtcattatatgtactgccgtagcaaatcttgtattgttcattgtaattacagggcaaagatacacattttttaaatgtaacaaaatttattacagttaaatttttcttaaaggattaatttgtccagatcaagcagcagataattgatgttctgattaatggtacgtgttgccgactgcatctgattgagcatggctgcacggttatgaagatcatccgccctgtaatacccgccatcactgaaaatgacagatttgtctgccgcttctttattatcgtcaaactggtagtgaagccatctcatcttcatattcccgatgatggaatgttcttccctgttggaaaattttttttctgtatacatataccagataaaaggcggaaagttgggcgattccagcttttccctccagatatctctcaaaagatttctctgatggataaactctactttttttcctttgggattaagagtcgctaaaccaaagcccgctcctaaaacccctcctccgatatcaattgcattgctccaaccctgatcatgaacaatacctccggctatagaagctgctgctccggtaataatggaataaaggatgagcttattgttttttgatgagttcaggttatccacataatttccaatctgggctactctttccccctcacagtcaaattctgcggctactgcatcaagttctgtcagggcaatcgtgattttactgtttatttttgtttttaactgtaaaactttgacctgcgaagcaagggatgagtcttttttaagatcaataatctgatggacctcatctaagttatccagtgcattcaatatcaggatactctgatcggaaaatatctctttcaattctttattggcagccaggatagagtctgcattataagatggaattttattgctgtagttatacttaaaaggtgctttacaatagctgtctttcagcgtaagtatattctgctgaatagcctgattcttctttgagacacaagaagtaagaagcccgaaaacaatcaaaaggtaaaaaagttttttcattcagtcatatgtttgtgccggattgatctattgtaacccaaccgcaatttgtctcagctttacaattcatcaacacgaatataatacaaataaaaaaaattacctgaaatcaggtaatttttttatctatttttaagaaggtttacttaatatccagcaattcaacttcgaaaacaagggtactgtttggcccgatctctttgctgatttcctgatctccatacgctaagtgtggaggaataatcagtctccatttactgccaacagacattaactgaagagcttccgtccatcctgaaattactctgttcaaagggaaagacgccggagttcctctttttacggagctgtcgaatactttcccggaaatagttgttccgtgatagtggcattttacagtagacttaggacctggtttcggaccgtcaccttctgtaatgatttcatattgcaagccgcttggtaactgtactacactttctcttttaccatactcttccatatattctttaccgtctttcaggttcttttctgccaattcttttttacgtttaaataacatatctgctactcccatattataattttttacaaagataaggctttttagggttgaaagatggaaatgagagaatggaagtttaaaatccaaaattcccataaaaacaatcatacctttaacaatcagtaagttaaatatcttattcattcgaattcaacaatcatattattttacatttattagcttaaaaggtcttttccacaaaattcaaataattgtaatacttgcttaacacagatttcgaaacttggcgttataattggatttaaaaactaaatgccaaatccaataaaatataataagaagtttgatgaactgaatgaagaggaaaaaaaacttctggaaatcaataaaaaaacaattgcagattttgttgaacaatcctcttccatcagtgatgtcaattatgctacaaggaacgctcacgccaaaacctatgcagcagcaaaaggtacgttcgttatagaacctggccttccggaattactgaagcctttttttgacagggaaaaatttgacctgatcatacgattttccaatgcccgcctgaaaatcaaaaattcgggaaaagatattcctgcctatggttttgcggtacagatcagggatgaaaacggaggtttactggccaattatccattagtcaattttcctttgtttcctcttaactctgtttcaacttttctgaaactttttactgctgtcaatatgttttatatgaaaaaatggaggagcctattaccgatgttttttcagataatcaaaatgttcccttatgtttgtaccggtgatatgctgcgtaatttaataaagcttttcagaaaaagaaatgactttattctgtcgtttgattattactcggtaggtgcttaccgtctgggagatcagatcattaaaataaagctatctccccaatctgtggataaaaatgtaggaagaaagcaaaagataggagacgctttaaaaagttatctgcagactcatgattttaaagcttatgttttagtgcagatctgttatgacgtgaaggatcagccgatcaacagactgaatgttgagtggaaaaactctccttttattaaaatcggtgaggtcagaatcaataaaaattctttgctggatgcaaggaactgtaccaatgaattgctttcattcaaccctttcgaaagtaaaatatttttccagcctgtaggaaaaatacagaaactgcgtgatgaagcttataaggtttctctgcagacgagaaggaagattaataaattgctgcatggaaaaaacagctaaaataattatgaattatgagtgatgaatgatcatttattgacttgacgtttcagtttcctttaaaaagcttttaaaaacaaaaatgactgttgtactaacagtcattctattttatctgaattttctttcttcttctttgattgccagatcattgatgcttgcatatctttttgccatcaggccgttttcatcgaactcccagttttcatttccataagccctgaaccagtttccctctttggtctgatattcatattcaaagcggacagcaatacgattgtctgtgtgtgcccaatattctttcttaagcttataatgaagttctttttcccattttttctgaagaaatgttacgatttcttctcttccatttacaaaggtatctctgtttctccattcactgtcgatagtatatgctttggaaaccttttcgggattctgactgttccaggcatcttctgccaactgaattttttcaagtgccgtttcaagagtgaaaggcggaagcggatgtttctgttccataacttactgtattagattggtaactattttttttgatttttcgatcaattcattggatttgaaaagctggctttctataatgctgctctcaaaaagcatgtaaatatgatcggaaagctcatcattattaagcaattctaaaaagaagttcctgagatctgctttatgggattggataacactaaggattttgagattatccatgggaatttccgataaaatattcaggaaactgcaaccccggaagttttccttagcattcatgtacaccagaaaatcaaaagctttgatgagtttatattttggatttttttcttttgataaaaaactattgagttcatgaaaccaatattgatgtcttacattcagaaattccacacacaggtcttccttggatttaaaatgctgataaaaacttgctttggctacttctgcttcggaaataatctggttgataccggtagaattgtatccttgtctggtaaacaattgaaatgtggtttctatgattctttctcttggagatttcatatcggatttcttttctggaacaaatgtatgaaaaaaaataatatacagaccagtctgtctgtttgattttttcataatatcttttagaaaaccaaaaggcacgaaaaattaatggatactgtgtagtaaggcgcaaggattttatctccgataaaatttaatatctctaaaaaagagaataattattgttaaaaatctttgatttccttgcgccttaaaaacgacacagtgcttatcctttttgcgcctttgtgtttcccaacaaaagcgtcatcaacaaaaaagcccctagagctatactccagaggctttcatttattttaattatgattatttttcttctaattcttctttcttctcttcttctttttcagggaagatgatggataaaagaactgagattaccaacactccccctacaattcccaatgaaaccggagacggaatatggatccacggtgcaatcaacattttaactccaatgaaagacaagataatcgccaatccgtatggaagtttgctgaacatgtgaataaagtttgcaagcaggaagtataatgatcttaatccaagaatggcaaagatatttgatgtataaaggataaacggatcatttgaaatcgcaaagatcgcaggaatagagtctacagcgaaaagaacgtctgtaaattcgataacccctactaccactaaaagaggagtcgccattttgattccgttctgaatggtgaagaatttatctccgtcatagttatcggaaactttccagaagcttttgatcagtcttgcacctgctgtattgctgtagtcttcatcttcatcatctccaccgtctccccatgatttgacccctgcataaacaagaaataatccgaacagtgtcattacaacgttgatttttactgcttccccaaagatattcatttcaggaagataggtaagattaatcaatcctactcccgcaaatataaatatggccctgaagatcagtgcaccgatgattccccagaaaaggaccttatgatgaaggtatttcggaaccttgaagaatccaaaaaccaggataaaaacaaataagttatccactgagagcgctttttcaatccagtaagcagcctgatattgtgtgaatttttctactgccagagcatggctttcaggacttccatcggtattgaatacccaatataccactcctgaaaataccatagaaagtgagatccatacaacagaccatatggtggcttctttggaagatacttcgtgactttttttgttaaatacccctaagtccaggagcagcatgataacgactgttactgcaaatccccacaccagaccagggtgcagttctaaaatactttgatgttccacttgagttatgttataatatgataaaagcaatagatgtacattgtacaaatattgctattttatttattttccgactgacaattgattatagataattcatctgtaccgtctggatcgtctgttccagttttttgtcagctgtagggtctccgatagcattgaatttccattctccgtttctcttatagaaaactcccattaccatagcgacgtgccctttgaaggaagcatcgtttgcaatatcatattttgcaaaaacttctcttacattagtaggtgttccttcataaatacggatagaagcaaaaggaatggttccgaaatcctgacctctgtagctgttcagcaccattgccacatgctctacattgggttccagattactgaagtctaccgtaatcacttcgttatccaatccgtcatcgccgtctacatcaccggtaaggtcatctccgctgtgtcttacagaaccgtttttggatttaagatttccaaaatagattacttccgtaacgtttttgtttgaatcatataaaatacagcttccgtccaggtctactgcttcttttttagttccgaaaaatcctttctttacaattgctccccagttgattcctacgcaagcctgggatagtacagctccattttcttttttaaggttaattctctgacctttttgtaagttgatagccatttttttatgtttagttgttatttattttttagcaaaagggcgaaaaagccggattgcgaaaaaagcaaatttgcgattttactgttttgcaattttgcctttaattattattcaaattcaaattaagcattgcccgcaggatatttgtctcttcattgaaatcaaatatcttgctcatgatatctatattttccaggtttcggatataatctttcaaaacagcttccacttctgccggaaggaaacgttttctttcgttcatggtgtgctccaactgttcatttttgcttctcagctgatcaataatggaactttggttagactgattttcagaaatatccagcttatccagttctttgtcgaaaagatacaatttcttttcatccacgctgaaaataaaataatcatcagtctgaaagatcctgaaaagctcataatcgtgggttccgataaggtagccacatacaaaacggactttaaaaccttgtatattgagccttcccaataatttcctttcaatagaataatctttgtactgatacgaggggaaagaatcagatttcagcagagtttcgtctgcatccgttctgtaaaattccctggcatattttttatgaaagtacagtacattatcccaattggctgtaaagcgatcttccgtaagatcctgatacaaggttttcagatgttgggaaaatacaccgctgtacattttcctgtcggtctgaaagctgtctacccgtctttcttcaaaacctgaaatatatttattgttgatgttaatttcgttaataacagccagcatatcattttctttctgctttttaattttggtcagaagttctatgagactgtcagtatactgcaggtggaaaagttccagtttattataatccaaagctgtattttcctggaacagattgtggataatatcagttttgatataaattgatatgatgtcaatatgttcaaaaaaattagcgagaagcttaagtctggttaaccttcttttgctttgtgacaatatggttgctgcatcatctcccacctttgtatcctataaattaacctctgacatttgctttaagttcatgctccaatgtctgaagatcctgatccagttttctcctgttatctgcaccctgtttctggatttgcttcacttcattcaatgtattgatcagcattgatgttgtttctctcaatgtttccacagatacgatggtctgctcgtttgctctggcaacattcacagaattctggcctagacgctccgcattctttcttaagatttcttctgtagtggaagaaactttctgctgaatttcaatattctgctgctgtctgtacattgccacagccagcgaaagctgatttttccagaccggaagtgtagtggtaaggatcgtctgagctttttcagcaattgatacgttgttattttgtaccagcctgatctgcggaagtgattgcatcataatcacacgcaccaccttaaggtcagccattcttctgtctaatcttgcaatgaaatctctcttatccgcaatctgataatcctgataattctgcggattggcttccattacagcaagctcgcctgcagctctttccattctgatatttcctgcaatgacaagctcttcaatctgcttaatagaattcacattgctttcaaaaatagtctgaagcacagcattgtcttttgtagacgtgatgattcctgcatttactttatacgagatctgctcaatattattgatgatcttatcgtattttgcaaaaagattttccacctgagtcattacctttttcataaatggtaatttgctcaggaagcttttcactttatttccgttaagctcgtctacatctacataattaagctccaccaaaagatcattgatgagccctcctacttctcctgaatttgatcttcttacattccccaggaaactgtcactctggttggataatgttttctgaagatcagctccgaaatttacgatggaacccggattgctctcatcaatagaattggcaagaacttcatatttctggcgttcttctgactgcagctgcgtcaggtttacatttccctctctgtccacaagaactcccggcgctgcgttttgaacaggctgagaaggagttggaggaaccattggagttggttcaaaggttttaagaggctctattgatcctagcggatctatgggttgattttcctgattgtccatgattacttctgataaattgatacaaatttctcaaggccctctctttggcctgcccctacagcctcaaatttccattctccgtttctattgtagattcttccgaattctacagcggtttcgatggagaaatcttcatctaattcatattttaagatctcttcattcgtatctgtattaaaaattctgatgaaagaatttcttacctgtccaaagttttgctttcttgaatctgcttcatgaattgttaccactactgtaatttctttgaccgcattatcaatttttgtaagatcaatcctgatctgctcatcatcacctgctccttctcctgtaagattatctcctgtgtggattacagatttgtccggagactcaaggttattatagaaaatgaaatgattatctgaaattaattttttgtcctctccaagcaaaaataatgaagcatcaaggtcgaaagccgttcctgtagaagtattattgatatcccatcctaaacctacagtaaatttaggtgcgttgatattttctctttgtcctttttgtaagttaatagccataatataattcagtttgtattaaagtattgatgttgttttcgtattcttttattaaatgataattgttactgatggcaagctccagaagaagatccatctgttccttttttactttagacgtaagataatcaaaattacctgaatccaggcctaaaatatattttacaatccttgtattaaactgaaagctttccttattcatcacttctgcgacgtgatttacattttttactgcatagtaattgaaaaagttttcaatctttgggtcaaggtcaaaattcatcagttctgcataatacagaaacataaagtctgcttcaaccttgtattcatcaagaattctgttcactgtatattcatggctaccggttattttgatatcgtctataaaaatacaaagttttcctctcaaaaaatccttatcgatataatacgtatcattggcaatcagatttttgcggtcttcaaaattaagattcccataatctgtaatgtatgtatgattacggttaattttcgataagacgcttgacttctttccttgttgaaacagataaaagtccagattttttttaaaataaaagcataaaaaattggaagccgtaggaattgccatataagggcttggaagcactacaatctctctatcagtctttagaagctgttcgttttcggaaataaacccgtcaaataattctcttgcaaatttttcagcatacgacttatcgccatatttgaaataactgtattccgcaggtgagaacgtaaactcatccgccgaatgaatgtggtgtaagctgtatcttgtattcatgtttatagttagtgtttaagtaaatgtgcactgaagccgaagttcttcgctccctgataatctgctaccggattgtctccgatatgcaggatccggttcattggtaaatcctgatctttaatattcttcttcacttcctgaaaaataagcggattgggtttggaacagttcatttcatcggaatagatatggaaatcgatgtactgatccagattttcatgaatcagaaattttctcatggtagttcctttgataaatccggtattgctcagaatattaatagtttttccctgatttttgatatcttcaaaaaagtcatgaatattctcgaaaatcacaaccggtctgtactccagaaacaattcttcacttttattgtaaaactcattgagtttttctctattcaaagattttacatcaacattcagagctccgagaatcatcaggtaaatttcaaaagtatctatatttccacctgtaacttcattaatggtattgcaaagatcatcataatattttacggttttcgcaacttcctctatcggtttatctacgttaaaaaatgaggagaacagctcaactcttttggccttaaattcaggatgagatttgattaaagtgagccacaggtcaaaggaaaaatgacagtggttgtgaatgtcgatatctgttttcaatagttttaagttaaaagtttttatttagcttcttgaaaaagatttaaaatattctaatcatcaaaaagtgtttacgatactattcttcccaaagataaaatatttatcataaaagcattatgtctgttgtctgttttaagatatttttatgaaaattcaaagttttgtgtggatcttcagaagatgttttttatgaggtatttaaaaaaaatttcaaaaattctttgaaaatcaaaaaaaaattataatttcgcaatcgattaaaaatcaacaatgtcaacaaaaatgataaatagtataactttaagcaatcctgtcagagctgtgttctttggcagcactgaatatttatctaaatagttttatagatcttttatacccaaaaatatattgaagacctgtctattcggataggtcttttttgctgccctgatttcagactttaacaattcaacgaatttgtgttatttgttaagatctctgaaaattttccattgttacaaaatacaaaaatgtttagccggctttatgagaccggagggtattttgcgctcttttttctgagaatcttttataatcacagatctaaaaatcaacaatttaaaacaaacaaaatgaaatacaacacacgaaatatagggattatagcacatgtagatgcaggaaaaacaacgttatctgaacggcttctttattacacggggctcattcataaaatcggtaacgtagatgatggaaacaccaccatggataaagatattcaggaaagaaacagaggaattactatttcatcagcggcggtttctacccaatggaaaaaagacagtaaggtttataatattaacattattgatacaccgggccacattgattttgcagtggaagtagaacgttctttaagagttctggacagtgttgtagccgttttctgcgcttcttcaggagttcagccacagactgaaaatgtttggtttcaagctgaaaaacacggtacatccaaaatatgtttcatcaataaaatggacagaattggtgcagacttttttgccgttcttgaagagataaaaaccaagctgaatactgttcctctcgcccttcagattccgattggggctgaaatacattttgaaggagttattgatcttgtcaaaatgaaagcactatactggaccgatgaaaacggcgaaatcattgtggaaagggaaattcctgatcattatattgctgaagccgacgaatacagagtaaaactaatggaaactcttgcagaaaatgatgaacagttctttgaaacattcatggatactaaagaaacagtaactcccggaatgatctcagaagccattcaaagagtctgcagatccggttcagcggttcctgttttatgtggttctgcttttaagaataagggaatccagcctttgcttgatgctgtggtgacttatcttcctgctccggatcaacttgccgatctgcagggaaaagatcctcatacagaaggaagtgtaacattgaaaagaaatgaaatggcttctttttcagggcttgtcttcaaggttgtgattgataaacatatgggaagactggcaatgttgcgtgtatattccggagtgattaaatctggtgataccatattgaatgtaagaacaggcgaaagttacagggtttcgagaattttacagatgcagtcggataagacgttgtccatgggtgaagctaaggcaggagatattgttgctttgacaggaataaaggacgccaaaaccggagattctttatcatcccctgatcagccgatattactggaagcaatcacgattccgactcctgtgatccgagttgccattgagactaaaaccaatggagatgagaaatctttcggtttggtgctggccaagatccaggaagaggatccttctttggtggttgagagagatccgcaaacaggagaaaccttactgagtggattgggagagctacatcttgaagttactttggagaaaatccgtctgaaccatggaattgaaatcaatcagggaaaacctaaggtttcttaccgtgagatcttaacaacaaccaaagttcacagagaaaagctttccaaacaaaacggaggaagcggtcagttcgctgatattacttttgaaattggaccaggaaatggtaatgaaccaggattagagttcattactatgattaaaggcggagttattccgactgaattcattccttctgttgaaaaaggattcagagaagctatggaacaaggtccattgaaaggataccctttagaaaacatgaaaatcactcttctggatggttctttccacgctcaggactctgcagcctttgactttgaaattgctgcaagagaagggtttaaagcggcagcaaaaggatgcactcctaaactgatggagcctatcatgcaggtagaaatccagagtattgaggaatacacaggtgctgttactgcagatatcaacagaagaagaggaatcatcacatctattgatgaaaaatccggaagaaagatttttgcagcagaagttccattagccacaacttttggatacatttctgatctgcgcacactgacgagtggaagagcttccatcagcatgaaattatcacactatgctttagtgcctgatttcatcgcgaatacattaataacctaaacaagcaaggactgtagatttttcttacagtccttgtctggttatgggatgtctattgtgaatagccaatcgtcaatacgctgcgcttgtcaattcttttatgctataaaaaattcacgattcatttgcgaagcaaaattcacttattgactgtgaaattgtgaatgatcaatcgtcaatacgctgtgcttggcaattcttttatgctataaaaattcacgattcacttgcgaagcaaaattcacttattgactgtgaaattgtgaatggtcaatcgtcaatacactgcgcttgtcaattcttttatgctataaagaattcacgattcacttgcgaagcaaaattcacttattgactgtgaaattgtgaatgatcaatcgtcaatacgcaagcgttaaaaactttgagtgagtcagacaaacatacaatggagagtttgatcctggctcaggatgaacgaacacagaagttaagcccacgtgcaaaagtaaaactttattttttaatgaccaaatgtttttgaagaaaattttaaagttttttaagtaaccttaatccttctcaaaccctcaatccctctactcttgcgctccgatttattcggactgcaaagatacaaactcttttttatctcacaactctttttgcaaaaagttttaaagttttttccgtctgtctcttgtgaagtaaataatgttcctgcttaactaaaagcccttctgcgcttactgatctactctcgttttcagtggggcaaagatagtaacttcctacaacgcaaaacaagtttatttaacttaaattttacaatacccaaaccattgtgagtaactatactatttaatttattgatatatttatagttatacaaaaactaatacttatccacaataagtcttattaaattttaaatcgaattattatgctaatattaaggattacaaaatgtcacaatttttttagctgataatatatttaaaaatatgtaaaaattaagattaaccatttggtgcatccaacagcataaaatatgaaagcaatagattacaaaagaagttatagcggaattttatgttcaatcttatttcagcagatccggttccgggatgttgaataatattttatggtaagagagcaagttctaaatgaaggaattcgtgattcgggatatgggttcagtggtatggatttctgggattgggcgaaagtaataaagttacacatcatgagttataagaaccctctgttcaatggccttactcctattctaattggggtcataaagcatccttccccattgtactgaggttcaactggcctctttcttttcatttgtatgggcttctttcctactgtgtcattccgcaggaatccaggcttatttattagagccttaaaggttcaggatgaatgatgaatgatgaatgatgaaagcattgaatgcttaagtgattataatgaaccattattgcttgaatgaatggcttgtttagactcctacggagtgacaatggggtatgtgatgaatgatgaatgttaagtgataagtgatggttgatagttgataattgattgaaatatcgtttatcatttatcaattattacttattacttattacttattacttattacttattactcattgcttataagttgggtataaagcaaaaaaaatcctttatcatttgataaaggatttttaaaaataaaataaaaactggcggcggcctactctcccgcgttagcagtaccatcggcgctggtgggcttaacttctgtgactgaaagcggaagatataaagatcattgacatacaatataacaaccaagtaaggaaaaactaaagcgttaaaaactttgagtgagtcagacaaacatacaatggagagtttgatcctggctcaggatgaacgctagcgggaggcctaacacatgcaagccgagcggtagagatctttcgggatcttgagagcggcgtacgggtgcggaacacgtgtgcaacctgcctttatcagggggatagcctttcgaaaggaagattaataccccataatatattgagtggcatcacttaatattgaaaactccggtggatagagatgggcacgcgcaagattagatagttggtgaggtaacggctcaccaagtctgcgatctttagggggcctgagagggtgatcccccacactggtactgagacacggaccagactcctacgggaggcagcagtgaggaatattggacaatgggtgcgagcctgatccagccatcccgcgtgaaggacgacggccctatgggttgtaaacttcttttgtatagggataaacctactctcgtgagagtagctgaaggtactatacgaataagcaccggctaactccgtgccagcagccgcggtaatacggagggtgcaagcgttatccggatttattgggtttaaagggtccgtaggcggatctgtaagtcagtggtgaaatctcacagcttaactgtgaaactgccattgatactgcaggtcttgagtgttgttgaagtagctggaataagtagtgtagcggtgaaatgcatagatattacttagaacaccaattgcgaaggcaggttactaagcaacaactgacgctgatggacgaaagcgtggggagcgaacaggattagataccctggtagtccacgccgtaaacgatgctaactcgtttttgggctttcgggttcagagactaagcgaaagtgataagttagccacctggggagtacgaacgcaagtttgaaactcaaaggaattgacgggggcccgcacaagcggtggattatgtggtttaattcgatgatacgcgaggaaccttaccaaggcttaaatgggaaatgacaggcttagaaataggcttttcttcggacatttttcaaggtgctgcatggttgtcgtcagctcgtgccgtgaggtgttaggttaagtcctgcaacgagcgcaacccctgtcactagttgccatcattaagttggggactctagtgagactgcctacgcaagtagagaggaaggtggggatgacgtcaaatcatcacggcccttacgccttgggccacacacgtaatacaatggccggtacagagggcagctacactgcgaagtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattttagagcgtcgttagacgataaaaaaaattagtatcgcaagatacagaacttacttaaagttcaagctttagttttttgtttggttgatttatattaaaaatacaaaacccactagaaattagtaaagggattgagagaggcaaagaagataaaagcagagagagaaagacgaagaaatgagtctattatctatcagtctatcatcttttacgtctaaaagacagtctcgtagctcagctggttagagcgctacactgataatgtagaggtcggcagttcgagcctgcccgagactactaattaaagcggatagcaaatagcgactagcttctggccaatagccaatagcaggaagccataagctaaaagcactagagggggaattagctcagctggctagagcgcctgccttgcacgcaggaggtcaagggttcgactcccttattctccacagttttggaatactgatttaaaagttacgaatggagccaaaaacaacatttgttcatcagtatgaaaagaagacattaagatcattgacattaacggtaaagacatcacaaagagaaaaccgagcgcataaagcgcttgagtaaccaataggaaagaaatcgttaagggcgtatggcggatgcctaggctttcagaggcgacgaaggacgtggtaagctgcgaaaagctgcggggattggcacacacgaattgatccgcagatatccgaatggggcaacccggcatattgaagatatgtcacctcgtaagaggagcaaacccggagaactgaaacatctaagtacccggaggaaaagaaatcgaagagattccgtaagtagtggcgagcgaaagcggattagcccaaaagcttttatatgtttaatagaatgttctggaaagaacagccatagagggtgatagccccgtatatgaaaggcatatttgagtgataaatgagtagggcgggacacgtgaaatcctgtctgaatatggggggaccatcctccaaggctaaatactcctgaaagaccgatagtgaacaagtactgtgaaggaaaggtgaaaagcacttcgaatagaagggtgaaatagaacctgaaaccgtacgcctacaagcggtcggagcagcgtaatgctgtgacggcgtgccttttgcataatgagcctacgagttaattttactagcgaggttaaggtattaagtaccggagccgaagcgaaagcgagtctgaatagggcggttagttagtaggattagacgcgaaaccttgtgatctacccatgggcaggttgaagctctggtaacacagagtggaggaccgaaccggttgacgttgaaaagtcttcggatgacctgtgggtaggggtgaaaggccaatcaaactgggagatagctcgtactctccgaaatgcatttaggtgcagcgtcgatgttaagtttattagaggtagagctactgattggatgcgggggtttcaccgcctaccaattcctgacaaactccgaatgctaataaatgttcgtcggcagtgagggcatgggtgctaaggtccatgtccgagagggaaagaacccagaccaacagctaaggtccccaaatatatgttaagttgaaacaacgcggttggactgcattgacagctaggatgttggcttggaagcagccattcatttaaagagtgcgtaacagctcactagtcgagcggtccggcatggataataatcgggcataaacatattaccgaagctatggatttataattattatatctggtaggagagcattctatttgcgccgaagcagtactgtgaggtattgtggagcggatagaaaagaaaatgtaggcataagtaacgataaagcaggcgagaaacctgctcaccgaaagaccaaggcttcctcagccatgctaatcagctgagggttagtcgggacctaacgcgaacccgagaggggtagtggatggacacagggttaatattccctgacttgctcacaataaaaggggacggttggatgtatctgctggagactgacggaatagtcaaggcctagccttcgggcgaagctgctgtagagtaatctgatccaagaaaagccgaagtgaagcaacccgtaccaaaaccgacacaggtggtcgaggagagaatcctaaggtgctcgagtgagtcgtggctaaggaactaggcaaaatagtctcgtaacttcggaagaagagacgccatcagcaatggtggccgcagtgaagaggcccaggcgactgtttatcaaaaacacaggactctgctaaatcgaaagatgctgtatagggtctgacacctgcccggtgctggaaggttaaggaaggtgcttagcgtaagcgaaggcattgactgaagccccagtaaacggcggccgtaactataacggtcctaaggtagcgaaattccttgtcgggtaagttccgacctgcacgaatggtgtaacgatctgggcactgtctcagccacgagctcggtgaaattgtagtatcggtgaagatgccgattacccgcaatgggacgaaaagaccctgtgaacctttactataacttcgtattgactttgagtaagtaatgtgtaggataggtgggaggctttgaagcaggcacgctagtgtttgtggagccgacgttgaaataccaccctttacttacttggagcctaacttctttcagaaggacattgcgtggtgggtagtttgactggggtggtcgcctccaaaagagtaacggaggctttcaaaggtaccctcagcacgcttggtaaccgtgcgtagagtgtaatggcataagggtgcttgactgtgagacccacaagtcgatcaggtgcgaaagcaggacatagtgatccggtggttccgtatggaagggccatcgctcataggataaaaggtactccggggataacaggctagtctcccccaagagctcacatcgacggggaggttcggcacctcgatgtcggctcgtcacatcctggggctggagaaggtcccaagggttgggctgttcgcccattaaagtggcacgcgagctgggttcagaacgtcgtgagacagttcggtctctatctattgcgggcgttagatgtttgagagggcttgattctagtacgagaggaccgaattgaacaaacctctggtgtatcagttgtaccgccaggtgcaccgctgagtagctacgtttggaagagataagcactgaaagcatataagtgcgaaactcgcctcaagatgagacatcttttaagggtcgttgtagatgacgacgttgataggctacaggtgtaaagacagtaatgtcatagccgagtagtactaattacccgtagatttatagtctatggttactgtatcaatcatataaaatgacaagtactttatgcgcagtaaaggttttgtctttgtgaaagtttttatcgcttaaaaacgcagatggcggatagcagttagcgaatggcaataaagccaatagccagcagccaatagccagatgctatataccttctttagggtggttttagcggtggggctcacctgttcccattccgaacacagaagttaagcccaccagcgccgatggtactgctaacgcgggagagtaggccgccgccagtttttattttatttttaaaaatcctttatcaaatgataagctggctgcttatattacgggaagtactgatttaagcattgtctcacttcgtgactatttacgtggagttttacctgattatatggttcctggtcattatatccagctggaaagttttcctttgacatctaatggtaagctggatcgtaatagtttaccagatgcgtttggatcctctttaggatcggggagagaatatatagcggcgcgcacggctattgaatctgtcttggtggatgtctatgaaaatgttcttggtaagtctggagtaggaatccgggatgatttttttcttttgggaggcgattcaatcaagtgcatccagattgtatctcgtcttcgccagaggggatatagctgtgaagtaaaggatattttgcttaatccaatgatagaggatttggtaatttgtgttaaggctttaaataatataatagatcaaaggagtgttgtaggagatgttttattgggtcctatccagatggattttctaacgggaaattattctgctaaggatcatttttaccaatcagtattgttaaaaagccgtgattcactggaccttgcattattagaacgtacccttcattcactcttggttcatcatgatgctcttcgtatggattaccgttttgaagacggagagtggcatcagtttaatcgtgatatttctgctatatctttagaagttctggagttttgggttagtgatgatgaatctttttctcaggcgtgccgtcaagttcagtcttgtattcgtatagaaggcggtagccttgtgaaggccggtttgctgagagcatctgatggggattatctttatttatcgattcatcaccttgtagttgatggcgtttcctggcgcattttatttgaagaccttgcaagcttgtacattggttatcaaaaaggattagaatttgtagagcttccattaaagactgattcttatcagcattggagtgctaagctgcatgaatatggagaaagtgaagtactttccaaggagcgtatgtactgggattctgttttaagagcaccagtttctggtctccctgttgattatcctttagggagtaaaaggaatggtgatacccgtatttttagttttagtttggataaagaagctacgactcttttacagacggaatgtttccgtgcgtataagacgagtctcaatgatatactattatcttgtctgagttacagtttaggagcatattttggattggatggagtttgctttaagatggagggtcatggtcgtgaggttataggatcaggagttgatatcagccgtacagtgggttggtttaccagtgtttatcctttggtcatttctttttcagaaggagaaagtttgttagatcatctgattggtgttaaggagatcgttcaccgtgttccccataagggtattggttatggtatcttgaaacatataaaaggtttggattatgaattgaggggggatgttctgtttaattaccttggtgattttggttcgggattacatgaagaaggtggagatcatatatttgatttttcgcgccgtttatcagggaatgatcagagtcttgatgaagaccgcgacagtgttttggagatctcggggatgatcgtagggggtgagcttcagctgggaatatcatatagctgtggtcaatatgattcttctacgatagaaggtttgggttctttttatgaaacatctcttttggacttgatagatatattatcaaaagaacaagcacaatatcttacccctgttgatcttacctataaaggattaagtgtttctcaggttatggatttgaatgcttctggtgatttagaggatgtgtatgctttggcccctcttcagcagggattattctaccattggttgtcttctccagaagactccgtgtattttatccagatgagttaccgtttatccggtgatctggatgttgttttattaaaggagagttatgttcacttgatagctcgttactcagttctacgtacagttttcagtgatgagttgagtgatatagggcttcagatagtaagaaagaggggagttgcagattttagttatgttgaagttccttttggttctgatgcaggttcttttatccgtgaatataaatcatcagatattaggaggggttttgatttactatctcagagtcctatgcgtttatcgatattgaaggcaggagaatcagagtatgaatttatctggagtatgcaccatatccttatggatggttggtgtctgggtatattaataggagagcttcttcatatttataatgccttgaagaatgggttatccccgaggttaaagcctgttcatgcttatggcagttatttatcatggctagagagtgttgatcatgaagatagtcttaattactggcgagattatttatcaggttatggagggatgtctggtcttcctgtgggagttggggttctggagcctgatactgttattgaggagctagactttacgcttgatatttctacaagtgatcgtttacgagaagtatgtactactcttggagttacggagaatacatttttgcaatgtgtgtggggtgttttattagggaaatataacggaggcttggaaacggatgtagtttttggcgcagtagtttctggccgtcccggctctcttgaaggcattgaggatatggtagggttgtttatcaatacgatccctgttcgtgtcagaggatcggcggatacgttgttttcaaaagctgttctaaagcttcattttgagagtatttcttccacgggttatcactacagccagctagcggatattcagaatgagagtggtttgggtaaggatttgtttgatcatattttgatttatgagaattatcctgttcaggatatggtgggtcaggagatgaatgatgcttctgaactaaggatacttgatacacataatgtagaacagaccaattatgatttaacagttgttattgttccaggggttaatcacagtttcaaattcagctataatcctcgtgtatacagtaaagagatcatgtcccagcttaagggtcatctcttacatcttatttcagttttggtatccaaccctgaacagccattaagttctttagatatggtaacaaaagaagaacatcatcttttgaccgaagggtttaaccagacggatgctgcttatccccaggataagacggtgatcgatctttttgaatcacaggtgttattgactcctggtaatacagcgttaatttttctgggaggatgttttaggaaaatcaggaataggggttcttgataatttctttgagttaggaggtcacagtttgaaggccgcccgtttgtcagcattaattcataaggagtttaatgttaagattcaattgcaggatatatttaatgaatttacaattgaaaaacaaggattattgcttggagttagagattcagacaaatatatttctatatccaaagctccagaattagaacactatcctttatcttcttctcaacgccgattatggatattgagtcgttttgaaggagcaaataaggcttacaatatgcctgaggtttttagaatttcaggtgatcttgatatgaatgctttacagcaggcttattttaccttattatccagacacgaaattcttagaacagttttttatgaatcagctgatggtgaagcctatcaacgtattctttctattaatcaggctgatagcttccaacaccacattattgattttgaatcagacaatattcttcaatctattatttctcaagaagtaaaccacatttttgatttatcagaggggcctttgattcgtcttactattgttgaaaatagctcagattcgcaatatgttttctgtctggttatgcatcatattatcagcgatggatggtcgatggaggtattaagaaaggaacttttttctttttatagtaattttactaaaaagcaaaatagagaatttccttctcttcgtttacaatataaagattatgcattctgggagcagtcagggcttgaaaccagaagtttaatttccaaaacttattggcaggagcaattatcaggagacttacctgtccttaatttaccttctaaaggaattcgtccttctgtaaaaacctataatggagagtatttttatggtaacttttccaatgaagttctttctggtttaaaggaaatatctcttagtactggaagttcattttttatgattgttttatcagctgttaaagttttattataccgttacagcggtcagaaagatcttattataggaactcctgttgccggacgtgaacatgctgaacttcaggatcagattggtttttatgtcaatacactagcccttcgtagtcatattaagggagatgaacgttttatagatttcctgtcggaagtccgtaagatgaccctttctggatatacccaccaatcctatccatttgaccgcttgattgaagatttagatattgttcgtgatatgagtcgtaatcccgtatttgatgttatggtgaatcttcaagactctgaggaaaaaaatatatcagatgatttttcggaaaagatttttgttaactcttataatggaacgtcatacaatgtaagtaaatttgatttagactttagctttgtggagaatagttctggattatcagtaggtttgtgttataatactgatatttatgatagaagtttagcggagcaattgatgaaaagtttagagcttttattaatatctattaatgaatcatcagaaacgattattgatgaactgaatattttaccggaagaagaacatcatcttttgaccgaagggtttaaccagacggatgctgcttatccccaggataagacggtgatcgatctttttgaatcacaggtgttattgactcctggtaatacagcgttaatttttgaagggatatccctgagttatcgagagcttgatgagcgttccaaccaatttgcccattatcttcgcagcgagtataatatagggagggaagatttggtaggcgtacagctggaaagatcttctgattttgttattacgattttagggattttaaaagctggcggagcttatgttccgatagatccttcttatccatcggatcgtattgcttacatgaaagaagacagtgggtgtaaagtagttgtagatattgaagaacttttattgttcaaaatggaaatggatgattattctgttttgcctgttgagcataaaagccagcctgatgatttagcgtatgttatttacacttctggctctacagggcgtcctaaaggagttatgattgagaacaaaagcttaatgaattacctgttctggggaatggattattatcctcctggagatttcagtatttttacatcaacgtcatttgacttaacgtatacagggatgtttttacctctgattaccggatatagtgttactattgagggtaataatttaataggaatagaagaaggtcacgaccttaattttgacagtataaaaattacaccttctcattttgaagtattgggagaaaagcttagaaccaatacattaattttagggggggagaaactgattgttgatcagattaataatttttttgataataataaaaatgctcatatttataatgaatatggtcccactgaagctactataggctgtacaatctatcatttagattcatcccatgattgccattctatagttccaataggccgtccaatttctaatactcagatttatattttgtcagaaggaggatcattgtgtccggtgggagttgtaggagagctttacatttctggctcaggtttgtccagagggtatttgaatgaaatacgaaatacagcaggtatattataagctcctgaagatcccgaaaaattactcataagccataagcgacgttgggatgaggataatgggtaagaatctaaaataggtgcactgggaatagaataataagatgattctttcaaaaatttcaaaatattatttttattttcttttattttacccgagaacaatctcattttttcttcatcgtcataagatacttttaaatcatcacctattaatgttatatctattgtatttctttttaatgaaagtaaaaaagatttgatgtcattcattttcttacagactttttactatataaaatttccttctcaccatatagcctttctgctataattcctttattgttacaggtttcaactaataaatttgactgtacaataggatttgattcatccgtatattttatactacttataaactcacaccatggctcttgtcccatggcatatacataaacttctaatgggttaaaaacatcaaccaggtccatacctttcttaaaatcggaaccagataatcttcttgactgatcatgctccctactgatttcactaagcattaaagggccatataaccaagttaaaggtgctccatcacactccattcccaaaaatataacatctacctccccgatataattttttacatgttcatatgttcttttttctaaaacacgagaatcagctaaaaacattaatgtaaactcatctacttttatatggtaacatgtttttgacggaatatccaggtcactatgttcccccataaatggaatacctgttatttggcaatcattgaaattaactgactctaaatcacctatttcaattacattttcaaatcctatattgttaaacattaattttacattaggatcctgtatacttccatttcctgatcttggaacaattatatttttaattttatgtcttaaaggaaggagtgtctccaataaaatatgatcctgatgattatgagtaataagtacataatcaataacctccggcaaatcatagtcagaaaaatgttcaacgcttgaggtatatccataatagctaataagaggatccacaagtacacttacagtatctgtttcaattagaatacaagcatgtccaaaataacgcatacgaactttatctcccttatattccttataaggagttgctgcttcttgtgtaaaaaagctttgaaataataattcttctttttctgtgagatttcctattaaacttcttatttcctcatagcttttgggggttcttttcatcttactgatttcatcaataaaaggatgatcaaatggtaaatttaaatgtaatactccttcttcatttaatcttggtgtacttaaacaaaaaggacgagaatcattctctgtgacccatagtgctatactttgtgtattggttgtgtaaaagttacttttatataaaaggttttcaaaaaatctaaaagacggatttccgttaaggtcatatacaagttctatatatcctttcagtatctcgggaactttagggtaaatgtcttccaatgactgtccttttgcttctttctgcaaaatttcatttaatttttttatagccaatgatagttttataacctctctttgatcaatcattgtcttcccaagcaattctctaatgtcctgaactctgttggtcttataatccataaaggggcctcctaacatctttggattctttaccatattttcatgttcctcggaagattctatataggaattcattattttcatatgtctgtgcgtcacatttaaacctgctgtaaccggtgaaatgagatgagcccaagcataccatctttctattaaaggctctatcacaacattaggtttcaggtaatatttatttgtattcatgtttataagtctaaattataatttctgattttctattattatctttcaatatctctttatattcactaactactattgctaattcttctatattttttgtcgctaatatctcttgcaatgaaatttttatatcgaattctttttgaatcatcgatgacaatcgtgttgctttcaaactgtgaccgcctaattcaaagaaattatccaggattcctattcccgattttcctaaaacatcctcccagatagaaataattctagtttctgtctcattgcgagccgctacatataccttattaatacttagtaaagagccaaaagcatcaggtaaattcttacggtctaacttaccattagacgtcaaaggaaaactagccaactgaatataatgaccaggaatcatataatcaggtaaaacatcccgtaaataatcacgtaattaagatgagatctaagataatccacatctttactcttttcatgatttaacaccaaaataccaactccctgcaaaagaggataaaacaactcgaataaagaaatatcaaatgcatgggatgccaacaatggaaaatagcctgacaaagatcccccaaaaggaaatgaagagctaacatccaacagtaaatttgctaaactcccatgctccaccataactcctttgggctcacccgttgatccggaagtatagataatataagccaaatcacatggggaaggatggtcaccaattgctccggaagaataatcatcacgttccatattaaacaaaagatattcttctgcatttatattaactttgcagccactatcagaaagcatataagcaatacgctccgatggataagacgggtcaattggaacataagcacctcctgactttagaattcccaatagagcaataatcaatgagtcggacctttcaagctctacacctacaaggtctgcccttcctatattatactggctccgaaggtaatgggcaaactggttggaacgctcattaagctcctgataactaagctccatgccttcaaaaaccaaagctgtacggcctggtgttagtaatacctgggactcaaaaagatcaatcacggtcttaccttttggataaacagcatgcgtctggttgaaaccttgcgtaagaagatagtgatcttcagatcccaaaatatccaatttattaatagtcaactccggagtatgaccgatagaaaccaacaagagctccaaactattgagtaagcgctctacaaatgatatatcataaatatctgtgttatagcctaaacctatagagaggcctgaggcattctccgaaaaactaaaatcaagatcaaatttactaactgcataaccggaagcattatacggctccagaatcaaaccatccaaacctacggaattagatgcattatccccggaaacagattcctgaaaacttaccataacatcaaaaacaggatgacggcttaaatcacggacaatatcaagatcttcaaccaaacgatcaaaaggatatgattggtggttatacccaagtaaagtagtctcacgaacagaggaaagaaaatctataaaccgatcttcgccataaatagagctgcgaagagctaacgtattcacataaaatcctatctgagcctcaagatcagcatgttctctaccggctacaggggtccctattattaaatctttctgaccactgtaacgatataataataccttaacagcagataaaacagtcatgaaaagagtgctcccattagtaagagaaattgctttcaataatgaaagtgtatcaacagagacaaaacccgaaacatgagaactgttataggttttaaccgcaggacgagctccttttgagggtaaagcaagaacaggaagttctccggaaaactgagcccgccaataatctttggacaatgaacttctaatttcaagttctgaccgctcccagaaggcataatccttatattggagacctaatggtggtaagaccgcaggattgccagatttaaaatgattatataaggtaaacaactctttttgcaatatatccatagaccagccatcactaatgatatgatgcatcacaagacagaaaatatatccatcgccactgcgatcttcaataagcgtaagacgaatcaacggaccggatgttaattcaaatacacgaccagtctcttgagaaataacttcttcaataacctgcttttcagatacaaaatctaaaagaaaataagaaaaactatccggttgggcctcaggtaaaactacctgacagcccaatccatcaatagtctcccgaaaaacagtcctcagaatttcatgacgagacaataaggaaaaataagactgcttcaataagtttatatccaaatcacctgaaatacgaaatacagcaggtatattataagctcctgaagatcccgaaaaattactcataagccataagcgacgttgggatgaggataatgggtaagaatctaaaataggtgcactgggaatagaataataccttggctcttcggagtcatattgacgggagttctagttttgttgatttcctgttaaaggtgcgtgatatgaccttatcgggttatgctcatcagtcttatccttttgaccgtttggttgaagatctagatatcgttcgtgatatgagccgtaatcctgtttttgatgtgatgcttaattttcaggatcttgaaagcggtaatattgataattctggagatctttctcaagggatgtcgagccattcttatgaaggggtttcatatgctgtgagcaaatttgatttggattttagtttttcagataacggttccggctttacgattggcttgtgttataatacagatctttatgatcggatttttgctgatcgtttgatgaaaagtttagagcttttgtttatttcgatcagtgaatcatcagaaacgattattgatgagttgaatattttacctcaagaggagcattaccttttgacagaagggtttaaccggacggatgctgcttatccccaggataaaacagtgatcgatctttttgagtctcaggtgatattaagccctgataatacagcgttaatttttgaagggatatccctgagttatcgagagcttgatgaacgttccaaccagtttgcgcattatcttcgcagcgagtataatatagggagggaagacttggtaggcgtacagctggaaagatcttctgatctcctgattacgattttagggattttaaaatctggtggtgcttatgttccgatagattcatcttatccctcggatcgtatagcttatatgaaagaagacagtggatgtaaggtagttgttaattcagaggaacttttgttattccatatggagatgtctgattattctgttttgcctgttgggcatagaagtcagcctaatgatttagcgtatgttatttacacctctggttctacaggccgtcccaaaggggttatggtagagcatggcggtcttgttaaccgcttggcttggatgcagggagcctatagtttatcaccttccgatacgcttatccagaagacgaattattcttttgatgtatcggtttgggagcttttatggtggagtctgtatggttcgaaactttgtattctgccagtaggagcagagaaatcacctgagttgttgatttcgaacatttcttttagtgaagtcagtgtgatccattttgtaccttcaatgctggagagttttttagattatttatctgttcatcctgaagaattgtataagctgaagagcttgaaacaggtttttgtaagcggcgaggccttgacgacttaccagaaccgtgagtttttcaggttgcttccggatgtaaagctgatgaatttatatggtcccacagaagcaacgatcgatgtcagctattttgaatgctgtgcagatcttgagggaagtattcctataggctttcctatatctaatacacgtatgtatatcttgtcggatgggggtagtttatgtcctttaggagtagtaggagagatctgtatttctggggtgggagttgcacggggatatttaaacaatggctttagattctgtgttaacttccaaatattttttatacatttatatttataaaagcgaccttgagttagcttgcgtagggtgaaggtctttgatttttaccctactttcttcaaaatctgtctggtaaaaagttttatttttaaatagaatatacatcagttccaaaagttttctttgtacagcaaccagccccttcattttaattcctgttttttctgtaatcctttgaaacaaatcctgatggtttttattcatttttacggctgtcattgcaggaaaatgtaatgtttttcgaatatttttatttcctttcttactaattcttggcttaccttttattgatgttccggactgtttctcgcggatatcaagtcctgcataacttaccagttgttttttatttctgattagctcaaaaccattggtttcagctaaaacagcaattgccgttgattttccaatacccggaatactgctcaacagattaactcccctggtagcctcaggacttttctttacctgtgcaaccatatcctcattaatttctttctcctgttttttcaataacgaaatacgctcggtcagccgttttatggttcttgaattgggcagggcctgagtcttttcagcatgcagctgattcatacaccttaccctttcctgaataacctggtttttctcgcggcttagctgctgaagttctttatacacaatgtttgcgggttgccataattctagttttctgcttaaaccaaactgtgtaatagctatggagcagcttttatcggtaatagttttgatatccagggtcctgatgaaattactgatcttattagggagcataatgactgttttttcttcctttgcataaataaaatgagcaaatctttcatgatatactcctgtagcctccatgacaaaaataacgtccatattaagtgtctttttgctgtatacccatttgagaagtgattcaaagcctttttcgctgttgctaaaaactttataatctttgatttctgtacttagatcttccattaatctgccaaaacttgccaccagttcatctttggctacatctattcctacaacctgttttaatacgttcatatttttattttaaataaaagcaagccttccttcgttttgtctcctgattattatccaagatatcttttccgatcctttaaattctgtccaaactctaaaaggaataaagaagtgaggacatttctaaagcacaatatacttcctgagttatttagccaaaactgttctctcaccccttttgctttgtatgtaaatttattcttttgcaaacataggagcctgtctcgtcctgaaataagttgacaactaatcgacttatttatgaaagatcaagtattaaaaagagaaaagcgcacacaaaaagactacagtatagcctttaaattaagaatagtttctcaagtagaaaacggcgattacacttacaagcaggctcaaaaagagtatggtatccagggaagaagtactgttttggtttggttgcgaagatatggtaacttagagtggagtaaacctaaacttcatactatgtctaattccaaagaaacaccagctcaaaaaattaaacgtttagaaaaagaattagctgatgaaaagctaaaaaccaaggttcttaatacgatgattgatatctcagataaacaatatgggactcaaatcagaaaaaagttttcctcccaacaatcttccaactccatagacaaggaataagtatatcaagactgtgtagattgtttgggataagccgtcaagctatttatcaagctaagcaaaggattttaatccgggaaaaccaattactgaaagtaaaatttctggttcaggaaatacgaatgaagttacctaaattaggaacaagaaaactttatcatcttcttaaagaacagctcatacaggaagatgtcaaattgggaagagatgctttatttgcctacttaaaaagagaaaatatgctaatccgtagacaaaagaaatatattaaaacaacattttcaaagcattggcttagaaagcatcccaatctgttgaaggatttgaaaatagagaaagcggaacaggtgtttgtaagcgatataacttatcttaaaaccaaagaatctacatgttatttatctttggtaacagatgcctatagtagaaagatcatgggatattcattaagttcaaatatgaacactgaaaatgttgcgaaagctttaaaaatggcaataaaaaatagaggttcaagtggcccattaattcatcattcagatagaggtttgcaatattgctctggttattaccagaaaatacttaataagaatgaaatcaaaccgtcaatgactgatggttatgattgctatcaaaatgcactggcagaaagggtgaatggaatattgaaacaagaattccttttttataaaacaaagaatatgcaagatctaaactcattagtaaaagaaagtatttatctttataatactaaaagaccacatctaagccttaatatgcaaactccagataaagtgcataaaaaatccgaagaaataaaatatctctccggattaaatattgtttaatttatgtcaacctattttaggacgactcaattatatggttcctggtcattatatccagctggaaagttttcctttgacatctaatggtaagctggatcgtaatagtttaccagatgcgtttggatcctctttaggatcggggagagaatatatagcagcgcgtaatgaaacagaatcccttcttgtagagatttgggaagatattttaggagtagcacatattggggttctggacaatttctttgagttaggaggacatagtttgaaagctgctcgtttatcaacactgattcaccagaagcttgatgtaaagatctccttgcaggatgtatttacagagcctacaatagaaaaacaaagcttgttgataaataatattaaaattattagcagagaaacatcatctacaattacaaaaaatagaataaagatatagttattaataaatttattaataataaaatagccggtattacattgatttaacagaagatagataagagatgaaaaaattattagaaagattagaatccttaaatattaaaatagctcttgaagaaggagaattatacttagattcagatgaattaatatcagatagtttaatacaagaagtaaaggataacaaaagggaattaatagagtttataaaaagattttcttcctctgctattttgtataataatattcctttagctccttttttagaggggtatccattatcctcttctcagcgccgattatggatactgagtcgttttgagggagcagacggagcgtataatatacctgaagttttccgtgtttcagggggagttgatatagagtcattgaagcagtcttattttacgttgttatcgcggcatgagattttgaggactgttttccgagaaaatgaagagggagaagtatttcagcatattctttcagatgtttttgaggatagttttgagtatttgaagctggattttacgaaagaagagggtaaaatttccgaaatcattagtttcgaaacaaatcggatatttgatttatccgaaggtccattgattcgttttacagttcttgaaataataccaattctaaacaaatggttccagaatattgaagaggagggtatagtttccactcattcttttttttcctttatcaaatttatttatgtatttacttatttatttttgatttatttatttttttaattatactttaagttctagggtacatgtgcacaatgtgcaggttcgttacatacatatacatgtgccatgttggtgtgctgtacctgttaactcgtcatttacattaggtatatctcctaatgctatccctcccccctccccccatcccacaacaggccctggtgtgtgatgttccccaccctgtgtccaagtgttctcattgttcaattcacacctatgagtgagaacatgaggtgtttggtttttctgtcctggcaatagtttgctcagaatgatggtttccagcttcatccatgtccctacaaaggacatgaactcatccttttttatggctgcatagtattccatggtgtttgtgtgccacattttctgaatccagtctatcattgttggacatttgggttggttccaagtctttgctattgtgaattagtgcctcaataaacatacgtgtgcatgtgtctttacagcagcatgatttatagtcgtttgggtatatacccagtaatgggatggctgggtcaaatggtatttctagttctagatccctgaggaatcgccacactgacttccacaatggttgaactagtttacagtcccaccaacagtgtaaaagtgctcttatttctccacatcctctccagcacctgttgtttcctgactttttaatgattgccattctaactggtgtgagatggtatctcattgtggttttgatttgcatttctctgatggccagtgatgatattcaaataccctctggacaaacctgagccagaaatgtaaagctctcctacaactcccaccggacacaatgatcctccttctgacaaaatataaatctgagtattagaaattggacggcctattggaatgttagaatattccttatctactttgaatgaagtggccaccactgtattttcggtaggaccataattattgtaagtcttaaaaccttttttattatagtaatttaatttatctcctcctgttaaaacttttgataatgattgattatccatgtgatagaactgttcacatataaccgtaggtaaaaacgtaatgttaattttctgatcttcaatataattatttaatccaacaagatccgttcttagagtttcatttaataaatgaattgttcctccttttatcagataaggaaacagctcccagacagacgcatcaaaactaaaacttgagtataaagctgaacggcttttttctgtaatatcaaacgtttctatattccaatacaataaattgacaaggtttctatgttctaccataactcctttgggacgccctgtagaacccgaagtgtaaataacatacgctaaatcattcatttttgtatcatgaataggtgcagcacgtgaatataaggaatagctcatattaaataatgacaattcatccgaatcaacaacaaccttacatccactgtcttctttcatgtaagctatacgatccgagggataagatggatctatcggaacataagctccgccagcttttaaaatccctaaaatcgtaataacaaaatcagaagatctttccagctgtacgcctaccaaatcttccctccctatattatactcgctgcgaagattctgggaggatgttttaggaaaatcaggaataggggttcttgataatttctttgagttaggaggtcacagtttgaaggccgcccgtttgtcagcattaattcataaggagtttaatgttaagattcagttgcaggatatatttaatgaattgaacaatattgagttaatctcccaatatcttatcaaagaacaaagtaagaaaaagtggttagagttgaatttatccaatagcggagaggatgatgttgttgatgaagtatttttataaaacttatctaatttatggaagaattatttgaactcttatacaaagagtctatatatataaaattaatagatgataaattatctgttaaaagtaataaaggaaaaataagaaaagaaattattgataagatatcattacatcgggaagagattatttctttcctgatgtctaatatttcatattctcatattcccatagctcctttcttagagggatatcctttatcttcttcccagcgtagattatggatactgagtcgttttgaaggagcagacggagcgtataatatacctgaagttttccgtgtttcaggggaagttgatatagagtcattgaagcggtcttattttacgttgttatcgcggcatgagattttgaggactgttttccgagaaaatgaagagggagaagtattccagcatattctttcagatgtttttgaagatagttttgagtatttgaagctggattttacgaaagaagagggtaaaatttccgaaatcattagtttcgaaacaaatcggatatttgatttatccgaaggtccattgattcgttttacagttcttgaagatgtatcagggagtggctatattttctgtcttcttggatagttttgagtatttgaagctggattttacgaaagaagagggtaaaatttccgaaatcattagtttcgaaacaaatcggatatttgatttatccgaaggtccattgattcgttttacagttcttgaagatgtatcagggagtggctatattttctgtcttgtaatgcaccatattatcagtgacggctggtctatggatatattgaaaaaagaactatttacattataccgtggttttaaagaagctgatcctgttgtattgcctcctttagcattgcagtataaggattatgctttttgggagcagtcagagctagaaacaaagagttcattgtccaaggcttattggcaggaacagttatcaggagacttgcctgtgctcaatttaccttccaaaggggttcgtccttctgtgaaaacttaccatggggaaaatatttacggatttatatctgaaggaaccctttcagaattaaagagaatatcgttaaaaacaggctgtactcttttcatgactgtattatcagctgtaaaggtgttattgtatcgttacagcgggcagagtgatctgatcatcggtacgccagtggcgggtcgcgatcatgctgatcttcatgatcagattggcttttatgttaataccttggctcttcggagtcatattgacgggagttctagttttgttgatttcctgttaaaggtgcgtgatatgaccttatcgggttatgctcatcagtcttatccttttgaccgtttggttgaacttcggataaatcaaatatccgatttgtttcgaaactaatgatttcggaaattttaccctcttctttcgtaaaatccagcttcaaatactcaaaactatcttcaaaaacatctgaaagaatatgctgaaatacttctccctcttcattttctcggaaaacagtcctcaaaatctcatgccgcgataacaacgtaaaataagactgcttcaatgactctatatcaacttcccctgaaacacggaaaacttcaggtatattatacgctctgtctgctccctcaaaacgattcagtatccataatctacgttgggaagaggataatggatacccctctaaaaaaggagctaaaggaatatgagaatatgaaatattagatatcaggaaagagatgatttcctcccgatgcaatgatattttttcggataattctctattcagaatttccttagctgctagaatttttaattttccttcttctacatacgcagaagctccatttttctttagaaaatttaagattgaataaacttcctttttaatcatatatttttatttttaaaaaataaatacctctctatcatcagagccatcctccactatattatttttaattgaatgtgcttcaatcaacaagctttgtttttctattgtaggctctgtaaatacatcctgcaaggagatctttacatcaagcttctggtgaatcagtgttgataaacgagcagctttcaaactatgtcctcctaactcaacagaaggagagagtctttgtcctgtaggagtatcaggtgagatttgtatctccggctctggcttggcaagggggtatttaaacaaagaatccttaaccagtgagaagtttgttattaatccttattccggtgagaggatgtataagacaggcgatttggggcgttgggattcagagggaaacatagagtttttagggcgtaaggataatcaggtaaagattcgtggttatcgtatcgaattaggagagatcgagtctactcttcaggggcatgaaggagttacagggagtgtcgttttggctgttgagaatgaagaagggcagaaagagcttgctgcttatattaccggaacaggtgctttgactggctcagaattacgggattatttacgaggtactttacctgattatatggttcctggtcattatctgcagctggatagttttccattaaccagtaatggtaaacttgaccgtagtaatttgcctgatgtttttagtatttctttaggctcaggagttgaatatgtagcggcgcgtaatgaaaccgagaagaagctggtttctatctgggaggatgttttaggaaaatcaggaataggggttcttgataatttctttgagttaggaggtcacagtttgaaggccgcccgtttgtcagcattaattcataaggagtttaatgttaagattcaatctctcctactactcctaaaggacataaactacccccatccgacaagatatacatacgtgtattagatataggaaagcctatgggaatagatctgcgccagctgtcttcttcggaaagacgataaatactgctgcacacggaacattcagtaggaccatacgcattaaaataggataagctgccacataacgaaagtcctttttctatggatgacgattcacccgcagaaataagaacacgcaatccggataaatcttccaatgacagcatttctgaatagacaggtggaagagtgataacactcgtgcccgaagattttaatatctcaacaaacttattcttatccttaagaacatcatcttcgcaaatgaaaagactagacccgcttaacaaagacatcattacctctgaaaaagaagcatcaaaagcaatagaagcaaagaagaaaacaacatcactgcttactactccaaattcacggatctggctcaataccatattcaacactcctccatgctctaccataacccctttaggacgcccggtagagccagaagtgtaaataacatacaccaggtcattcgggtggattatatgcttaacgggcagaacaggatatctctgctgctgatctttaaataacaataattcctctgaatcaacaactaccttacacccactcagcttcaaatactcaaaactatcttcaaaaacatctgaaagaatatgctggaatacttctccctcttcattttctcggaaaacagtcctcaaaatctcatgccgcgataacaacgtaaaataagactgcttcaatgactctatatccatatcacccgagagtttaaatattgctggtatattatacgcatttgctgctccctcaaaacgactcagtatccataatcggcgctgagaagaagataaaggataagagtccaaatccggagctcgtgaaatagaaatatattcgtctgagttactaactcctagtaataatccctgtttctcaatggtagactcgctaaagatatcctgcagcgaaatcttaacattaaactcctgatgaattaaggcagataaacgcgcggcctttaaactgtgaccccctaaatcaaagaaattatctttaatgccgattcccgatttccccaaaacagcctcccagatagaaaccaacttctcctctgtttcattacgcgctgctatatattcaactcctgagtctaaggaaactccaaaagcatcaggtaaattcttacggtctaacttaccattagacgtcaaaggaaaactagccaactgaatataatgaccaggaatcatataatcaggtaaaacatcccgtaaataatcacgtaattctgagccagtcaactcccgcgttcctgtaattctaattttcatcaagctctcgataactcagggatatcccttcaaaaattaacgctgtattatcagggcttaatatcacctgagactcaaaaagatcgatcactgttttatcctggggataagcagcatccgtctggttaaacccttcggtcaaaagataatgttcttcttgcggtaaaatattcaactcatcaataatcatttctgatgattcattaatagatattaacaaaagctctaagcttttcattaaacgctccgctaaacttctatcataaatatcagtattataacataaacctattgataatcctgaactggtctccacaaaactaaaatctaaatcgaatttgctggaaacatgatttgattccatatatgaatctatagtaactccatgtaaaaaatcctcttgattttttttattttcagaaattaatttttgtagacttaatacaatatcaaaaacaggattacggctcatatcacgaacgatatctagattttcaaccaaacggtcaaaaggataagactgatgagcataacccgataaggtcatatcacgcacctttaacaggaaatcaacaaaactagaactcccgtcaatatgactccgaagagccaaggtattagcgtgatatgaccttatcgggttatgctcatcagtcttatccttttgaccgtttggttgaagatctagatatcgttcgtgatatgagccgtaatcctgtttttgatgtgatgcttaattttcaggattccggggatgcaggagagggattatctgttttttcagaaaattcttctttcagctcttataccggttctgactatacgattagcaaattcgatttggattttaacttttcagagaatgggtcaggtttaggtattggtttgtgttataatacagatctttatgaccggatttttgctgatcgtttgatgaaaagtttagagcttttgtttatttcgatcagtgaatcatcagaaacgattattgatgaactgaatattttacctcaagaggagcattaccttttgaccgaagggtttaaccggacggatgctgcttatccccaggataaaacagtgatcgatctttttgagtcccaggtgatattaagccctgataatacagcgttaatttttgaagggatatccctgagttatcgagagcttgatgaacgttccaaccagtttgcgcattatcttcgcagcgagtataatatagggagggattgttggcatcccatgcatttgatatttctttattcgagttgttttatcctcttttgcagggagttggtattttggtgttaaatcatgaaaagagtaaagatgtggattatcttagatctcatcttggagagatgaattctttacacactgttccagctttaatgagcgagcttttgtctcagattaaatcttcggattctgctgaaaattattcacatatagaatatattttcataggaggagataaggttcctacgcatgttttgcatgatatccgcagtgtttttaggaaagcaaaaatagttacactttatggccctacggaatgtacgatctttttattgacccgcagttatacaaactctgtagaagaatttaacggatcattattaggtcgtcctatctccaatactcaggtttatattctggcagaaggagagagtctttgtcctgtaggagtatcaggtgagatttgtatctccggctctggcttggcaagggggtatttaaacaaagaatccttaaccagtgagaagtttgttattaatccttattcattgttggcatcccatgcatttgatatttctttattcgagttgttttatcctcttttgcagggagttggtattttggtgttaaatcatgaaaagagtaaagatgtggattatcttagatctcatcttagagagatgaattctttacacactgttccagctttaatgagcgagcttttgtctcagattaaatcttcggattctgctgaaaattattcacatatagaatatattttcataggaggagataatgttcctacgcatgttttgcatgatatccgcagtgtttttaggaaagcaaaaatagttacactttatggtcctacggaatgtacgatctttttattgacccgcagttatacaaactctgtagaagaatttaacggatcattattaggtcgtcctatctccaatactcaggtttatattctgtcagaaggagagagtctttgtcctgtaggagtatcaggtgagatttgtatctccggctctggcttggcaagggggtatttaaacaaagaatccttaaccagtgagaagtttgttattaatccttattccggtgagaggatttattcttgcaactgccccaagtactttcattagtctggttatggtctcctgtatagcaagagaaatacatatctactgtttgataagaacaagattctacagtccccatactattagaaactactcctccgtatgttccttttgcaagttcaatagctgtggttttacctgctgtttttactccttttcctgcaagtaagtcaagtttttcctgtggcgtaaaagtgtaagttactaaaagttccttataagttccgtcaggtagcgaagataatactaaattttctaatggtgcattttcaggcgcattttctctaactaaattaaatgtgtaggtatggaaagtgggcccaacctcaatgtaagttacattgtctgtgtcaatcgaaactccattggcataatcaactgattttcctgatgcgttggttttgatttctgttagattgttttgtgctttttgtaattcagttttaagagctaatttgtgtttactttggtctaaacggattgttttggatgttggcctgaattggctgctgttgttgtaggtttccaaaagcatcaggtaaattcttacggtctaacttaccattagacgtcaaaggaaaactagccaactgaatataatgaccaggaatcatataatcaggtaaaacatcccgtaaataatcacgtaattctgagccagtcaactcccgcgttcctgtaatataagcaacaagctctttctgaccttctttattttcaacggccaatacaacacttcctgtcacttcttcatgcccctgaagagtagactcgatctcgcccaattcgatacggtagcctcgaatcttaacctggctatcctttctaccgatatattcaatattaccatccgaaagccaacggcccaaatctcccgtcttatacatacgctcgcccggaagataaggattagaaacaaacttctctaaagtcaaatcagcacggttcaaataccctctggacaaacctgagccagaaatgtaaagctctcctacaactcccaccggacacaatgatcctccttctgacaaaatataaatctgagtattagaaattggacggcctattggaagcacagctcgacatgggtggtctgcaacttgcgcttgaagtagcgcagggtttcaaaaaactcttccttaccgggcacccgcttggcgatattgaactggccgccaatctcgctggcggaatcgaacagcgtcacttgatgaccgcgctcagccgccacggtggccgccgccaggccggcaggaccggcaccgaccacagcgatcttcttgatctgtttcaccggcaggtagttgagttcggtctcgtagcacgcgcgcgggttgaccaggcaggtggtcaacttgccgccaaacgtatggtccaggcaggcctggttgcagccgatacaggtgttgatttcatccccacggccggcagcggccttgttgacgaactccgggtcggccaggaacggccgcgccatcgacaccatatcggcatcgccctcggcgaggatctgctcggcgatttccggggtgttgatgcggttggtggtgatcagcggaatcttcaccgagccgcgcagcttggcggtgactttactggggacagtcacagtgccgacggtgtcgcccgccttgatggtgatagtcgagccgttatccaacttcagagtgacgtcggtgccggccttgttgctcaaggtcgcggtgtacgtaatctgaccaccttcgttaactgcgcttggcgcggtcagcgtgacagtggtggtatcggcggtgcctggtgtgtcagtcacagtggtggtgactttatcggtacctggcaccaggtcttcgaagggctcgccgccggtcacgccttggatagcggccgttacggtttgatcgcccttgtaggcatcatctggcgctacaaccgaaacggtaccgctcgactgattcacgccgatggtgatggtctggccgttatccaaggtcacggtcaacgggttggtgatgttagtcaccgcgttacccgccttgtcgaccagcgacgctgtgtagacgatattgccgccttcgcccacggtggtggtggcggtcagtacgacgtcgaccttgtcgatggtgtcgttgatcgtgtgtgttatcaatgagtgtattgtaattagggtgtcttgggtacaaggatagtaaaatgtgtactagtaaatatgagattgccactgttgaagtttcgtgttggtgttcgtgatttgctgggctttttttttttttttttcaggcagatgacggaatagggtttgggttattgggtctcgtgggctgggagatttgtataagggacagttttaaaagttcatacagtaaagatattttaggaaacgaatacagtgctattcttaaaaatatttttgcaataggcgcgggtattgcaagcgccgtctcttatacacctttgaccctgccgaagacgatgccgttgtgtaggtattgtgggtcaccgcaacaatgaaaaaaaaaaatgaatatgcaacactgagaaacggctatactaattaacatatacacacaaacaactgtctggagacctaaacatttaatctgatagtcgaaattagccattaagattacgcaagttgagacagtggggtggcccagggcaatagctccgccgttggggttgacccgcgggtcgtcgtcggcgagccccaggtcccgcgtgcaggcgagtgcctgggcggcgaaggcctcgttgaactcgaagatgtcgatctcgtccatggtcacgccggtgcgctcgagcagcttgcgcaccgccggcaccgggccgtagcccatgatgcgcggctcgacgccggccgtggccatgccgatgatgcgggccatgggcttgaggccatgttgctcccccgcggcccggcttgccaccagcatggcggcggcgccgtcgttgacgccggaggcgttgccggcggtgatgctgccaccctcgcggaacggcgtcggcagcccggccagcttctccagggtggtctcgcgcgggtgctcgtcggtatcgaacaccagcggctcctgcttgcgccgggggatctcgatgggcgtgatctcgatggcgaagcgacccgccttctgcgcggcggcggccttctgccaggcacactgctgggccaggcgggcaacgccgcgacaaaagcgcgggtggttagcgttgcgccatatcacatcatagtgcatggccggtaacggcaccggtagcgagagacggtagagctccccccgctgccactcatccagcacggtagcgacaggcagcgcgccaatccccaacccttcggtggtcattcgtacaatggtcattaatgtgctgacgctatggatacggggattagcgattccctgctcggccaaataactcaccaactcggcatagggacgagcctgcttgccaaatgaaataaacggcaactgcttgccccaagtgtcggcactttcacccagctgcttgacgtggcgtggagagacaaacatgcccatttcataagggctcaaggactcgtactcgatctgcttttgcggtgaatagccattcatcgccaatacaatatccagttcgttgcccagtagccgctcattgagcactggcgagtccacgtcgtcgggcgcgtcagatgggtgaaagtgacagttgccgagcagccgaagtggcgcttagccacctggcgtagcagcaggggcggcgcgtggtttacctcgtgatattcgagcgggtggtagagatagagtggggctttcgggcgcattgaagtatcctccgcgccccgctatcactgattcaaagaagcatgaccggacaagacctgcaggccctgctcgagtcgatcctcgacgaagttcgtccactgatcggccagggtaaagtcgccgactacattcccgcgctcgccgatgctgtctcttctactcatctccgagcccacgagaccaaataaccgaactcgtatgccgtattctgctggaaaaaataaaacatcatatgctagctgacaggcaaagatacattgtctctgaaacacagctcagagtctactagacacgtatgtgaatctcgtagtccgtcatcttcctgacgaaacaagactatcgtggttcctggtcattatatccagctggaaagttttcctttgacatctaatggtaagctggatcgtaatagtttaccagatgcgtttggatcctctttaggatcggggagagaatatatagcggcgcgtaatgaaacagaagagaaattaatttctatctgggaaaatgttttagggaaatcgggaataggaattaaagataatttctttgaattagggggacatagcttgaaagcagctcggctttcaacattaattcatcagacatttgatattaaaatttcagtacaggaaatatttaatgaatcgacaatagaaagacagagagcattattagataaaaaaggctgccaagaatacatttctattcccagtgcacctattttagattcttacccattatcctcatcccaacgtcgcttatggcttatgagtaatttttcgggatcttcaggagcttataatatacctgctgtatttcgtatttcattttttctgtaatatcaaacgtttctatattccaatacaataaattgacaaggtttctatgttctaccataactcctttgggacgccctgtagaacccgaagtgtaaataacatacgctaaatcattgggttggcttctatgctcaacaggcaaaacaggatatctctgctgctgatctttaaataacaaaagttcctctgaatcaacaactaccttacatccactgtcttctttcatataagctatacgatccgatggataagatggatcaataggaacataagctccgccagcttttaaaatccctaaaatcgtaataataaaatcagaagatctttccagctgtacgcctaccaaatcttccctccctatattatactcgctgcgaagataatgcgcaaactggttggaacgttcatcaagctctcgataactcagggatatcccttcaaaaattaacgctgtattatcagggcttaatatcactgttgaatgacattcctggacttgagtgccgtacacccgacggagctttttacgtatttgtagcctgtcaacagctattgggtagtcatacgccgaaaggacagcgtcttgaaacagatatggattttgcaatgtatctgctggaggaggctggcgtagccgtagtgccgggctcggggttcctggcggatggttttatccgcatttcctacgccgcttcagaagacgagttaacaaaagcttgcgccgcgattaacgaggctgtgcagaagctttctttagcccatgcttgaattcaaagagagcaatccgatgagaaatacaaataagtgccttcgcgacatcatctccagtggcggcatggcgagagtcatggccgcccatgatccgctttctgccatgctagtggaggaagccggttttgatggtatctgggcaagtggtttcgagctctctgcagcaatggggttggcagttcctgcttagctaaaagcccttctgcgcttactgatctactctcgttttcagtggggcaaagatagtaacttcctacaacgcaaaacaagtttatttaacttaaattttaccgtttcgtaatatttactcttaaagcactggattgcagagagaaaaattttaaacatttgtttgaaatcttgcgttggagggccggagagtctgagagtttgagcgtgggagggtttaagggtggcagaaagagagaatggtgatacggggtgcggggttacagggtgtgaagtttaggagatggtaatatactatgatgatggtaatatactatataataaaagataagtttcggctcctatgtttgcaaaagaataaatttacatacaaagcaaaaggggtgagagaacagttttggctaaataactcaggaagtatattgtgctttagaaatgtcctcacttctttatcgtcactgatgccttgcgcgaaacagtgctcagcttccttcaaggtagaaaccgtgacaccgcgggcgccagcagccatctgtgccgtgatgacgggcaggcacttgctggttttgatgtgcgggcgcaaacgtacgccgagggtgtccatacgttgctgcatacgctggatattgcgctgcatttgcgcgacatcgactagcgcaaccggcgtgtcgagagaggcaatcggcgttgacatggcagaactcaagtggctgggtacaggctgcactctactcagctatcgttaacctgtggttcaatgagaaatcatcaatcattaagtaaaattgaatgatttccatcgaagacctgcgcctggcagttacgcttgcccgctctgagtcgctgagtgccgctgccagagccctgaatgtttcacctccggcgctttccatgcgcctgcgtaaactgccccaggcggtgctgttggtggagttcgccggtgaggagcggcagacccaactcgcctcgctcaaacgtctcaccgagctgatggccgacctgggcctgcccggcagcgtggtggagatgcccgagcccgtcgcacaggcggcgctgtggaacgtacgcaaggcctgcctcaacattatgatgagcatgaagggggacggtaagccggtctccttcatcgaggactgcgcggtgcccctcgaacatctggccgagtacaccgacaagttgaccgaggtgttccatcgccacggcaccgagggcacctggtacgcccacgccagcgtcggcacgctgcacgtgcggccgatcctcgacatgcggcggggcggggcgcacaagatgcgcgagatcgccgaggaggcttccgccctggtgcgccaatacaagggagcctactccggcgagcgggctatacagcatgccggcctggctgcggtactcctgggtgcgaatgtcttccgcccggaacagaaggaagcgatcgccgagatcggcctgtccctgattgcgccgggaaagcgcctcccaggcagtggggaatacggaagccaggcttctgccgaagcgcaacgggccttgcgcccccaccaacagccagttgccttgcgcatccaccaggagcggttgtgccgcatcgtcgatggccatggcctggagcaaactgcgggtcaggtattcccaatccaggctgaacaggagcacgcctttgcgttccccttcagtatcgaatacgggggttgcgatatcgaccacaggcactacattggcgccggctgtgtcgtcattgacgttttggccggggggcgagacataaaggtcgcggggcgagagcgtcacggccttaatacagcgttaatttttgaagggatatccctgagttatcgagagcttgatgaacgttccaaccagtttgcgcattatcttcgcagcgagtataatatagggagggaagatttggtaggcgtacagttggaaagatcgtctgattttgttattacgattttagggattttaaaatctggcggagcttatgttccgatagatccatcttatccctcggatcgtatagcttacatgaaagaagacagtgggtgtaaggtagttgttgattcagaggaattattgttatttaaagatcagcagcagagatatcctgttctgcccgttaagcatataatccacccgaatgacctggtgtatgttatttacactttcttagctaaatgaaatgcctttgtgaacgaaattactttcagatcggattaaaaaactttgcggtccaagcgttaaaagaattttcatgatagcatttgggcacattattataacgcaatagatcgaaatttcttttgagaccgcgcactctttaagttcgctaaggtgtttcactcagcaatgaaagtaaatatcttagctaaatgaaatgcctttgtgaacgaaattactttcagatcggattaaaaaactttgcggtccaagcgttaaaagaattttcatgatagcatttgggcacattattataacgcaatagatcgcaattttatctaatacacgtatgtatatcttgtcggatgggggtagtttatgtcctttaggagtagtaggagagatctgtatttctggggtgggagttgcacggggatatttaaacaatgaattattaacaaaagagaagtttgtttctaatccttatcttccgggcgagcgtatgtataaaacaggagatttgggccgttggctttctaatgggagtattgaatatataggaaggaaggacagtcaggtaaagatccggggttaccgtattgaattgggagagatcgagctagctctaagtgtaaataacatacaccaggtcattcgggtggattatatgcttaacgggcagaacaggatatctctgctgctgatctttaaataacaataattcctctgaatcaacaactaccttacacccactatcctctttcatgtaagcaatacgatccgatggataagaaggatctatcggaacataagctccgccagcttttaaaatccctaaaatcgtaataacaaaatcagaagatctttccagctgtacgcctaccatatatccacggttatctgtgcaaatctgtgctatctgcgggataaacaaaaattacccataagccgtactttctatggtttatcctcaatattggatattcaatagaggcgggctttagcccggtttgaaataaaccgttttcctttgctttatccgaaactataaataatagaagactatatccacggttatctgtgcaaatctgtgctatctgcgggataaacaaaaattacccataagccgtactttctatgatagcacagatttgcacagataaccgtggatatagtcttctattatttatagtttcggataaagcaaaggaaaacggtttattttaaaccgggctaaagcccggtcctattgaatatccaatattgaggataaaccatagaaagtacggcttatgggtaatttttgtttatcccgcagatagcacagatttgcacagataaccgtggatatagtcttctattatttatagttttttatcgtctttccgaagaagacagctggcgcagatctattcccataggctttcctatatctaatacacgtatgtatatcttgtcggatgggggtagtttatgtcctttaggagtagtaggagagatttgtatttctggggtgggagttgcacggggatatttaaacaatgaattattaacaaaggagaagtttgtttctaatccttatcttccgggcgagtgtatttctggggtgggagttgcacggggatatttaaacaatgaattattaacaaaggagaagtttgtttctaatccttatcttccgggcgagtgtatgtataaaacaggagatttgggccgttggctttctaatgggagtattgaatatataggaaggaaggacagtcaggtaaagatccggggttaccgtattgaattgggagagatcgagctagctctctcgcccggaagataaggattagaaacaaacttctcctttgttaataattcattgtttaaatatccccgtgcaactcccaccccagaaatacagatctctcctactactcctaaaggacataaactacccccatccgacaagatatacatacgtgtattagatataggaaagcctatgggaatacttccctcaagatctgcgccagctgtcttcttcggaaagacgataaagccaacggcccaaatctcctgtcttatacatacgctcgcccggaagataaggattagaaacaaacttctcctttgttaataattcattgtttaaatatccccgtgcaactcccaccccagaaatacaaatctctcctactactcctaaaggacataaactatagtttatgtcctttaggagtagtaggagagatctgtatttctggggtgggagttgcacggggatatttaaacaatgaattattaacaaaggagaagtttgtttctaatccttatcttccgggcgagtgtatgtataaaacaggagatttgggccgttggctagtttatgtcctttaggagtagtaggagagatttgtatttctggggtgggagttgcacggggatatttaaacaatgaattattaacaaaggagaagtttgtttctaatccttatcttccgggcgagtgtatgtataaaacaggagatttgggccgttggcgtatgtataaaacaggagatttgggccgttggctttctaatgggagtattgaatatataggaaggaaggacagtcaggtaaagatccggggttaccgtattgaattgggagagatcgagctagctcttcaggggtatcgggggggggggggggggggggggggggggggggggggggggggggggggggggggggggggggggggggggggggggggggggggggggggggggggggggggggggggggggggggggggggggggg

SEQ ID NO: 78 - DNA, 1513 bp, Chryseobacterium sp.
atggagagtttgatcctggctcaggatgaacgctagcgggaggcctaacacatgcaagccgagcggtagagatctttcgggatcttgagagcggcgtacgggtgcggaacacgtgtgcaacctgcctttatcagggggatagcctttcgaaaggaagattaataccccataatatattgagtggcatcacttaatattgaaaactccggtggatagagatgggcacgcgcaagattagatagttggtgaggtaacggctcaccaagtctgcgatctttagggggcctgagagggtgatcccccacactggtactgagacacggaccagactcctacgggaggcagcagtgaggaatattggacaatgggtgcgagcctgatccagccatcccgcgtgaaggacgacggccctatgggttgtaaacttcttttgtatagggataaacctactctcgtgagagtagctgaaggtactatacgaataagcaccggctaactccgtgccagcagccgcggtaatacggagggtgcaagcgttatccggatttattgggtttaaagggtccgtaggcggatctgtaagtcagtggtgaaatctcacagcttaactgtgaaactgccattgatactgcaggtcttgagtgttgttgaagtagctggaataagtagtgtagcggtgaaatgcatagatattacttagaacaccaattgcgaaggcaggttactaagcaacaactgacgctgatggacgaaagcgtggggagcgaacaggattagataccctggtagtccacgccgtaaacgatgctaactcgtttttgggctttcgggttcagagactaagcgaaagtgataagttagccacctggggagtacgaacgcaagtttgaaactcaaaggaattgacgggggcccgcacaagcggtggattatgtggtttaattcgatgatacgcgaggaaccttaccaaggcttaaatgggaaatgacaggcttagaaataggcttttcttcggacatttttcaaggtgctgcatggttgtcgtcagctcgtgccgtgaggtgttaggttaagtcctgcaacgagcgcaacccctgtcactagttgccatcattaagttggggactctagtgagactgcctacgcaagtagagaggaaggtggggatgacgtcaaatcatcacggcccttacgccttgggccacacacgtaatacaatggccggtacagagggcagctacactgcgaagtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcatt

SEQ ID NO: 79 - DNA, 2740 bp, Chryseobacterium sp.
tcgttaagggcgtatggcggatgcctaggctttcagaggcgacgaaggacgtggtaagctgcgaaaagctgcggggattggcacacacgaattgatccgcagatatccgaatggggcaacccggcatattgaagatatgtcacctcgtaagaggagcaaacccggagaactgaaacatctaagtacccggaggaaaagaaatcgaagagattccgtaagtagtggcgagcgaaagcggattagcccaaaagcttttatatgtttaatagaatgttctggaaagaacagccatagagggtgatagccccgtatatgaaaggcatatttgagtgataaatgagtagggcgggacacgtgaaatcctgtctgaatatggggggaccatcctccaaggctaaatactcctgaaagaccgatagtgaacaagtactgtgaaggaaaggtgaaaagcacttcgaatagaagggtgaaatagaacctgaaaccgtacgcctacaagcggtcggagcagcgtaatgctgtgacggcgtgccttttgcataatgagcctacgagttaattttactagcgaggttaaggtattaagtaccggagccgaagcgaaagcgagtctgaatagggcggttagttagtaggattagacgcgaaaccttgtgatctacccatgggcaggttgaagctctggtaacacagagtggaggaccgaaccggttgacgttgaaaagtcttcggatgacctgtgggtaggggtgaaaggccaatcaaactgggagatagctcgtactctccgaaatgcatttaggtgcagcgtcgatgttaagtttattagaggtagagctactgattggatgcgggggtttcaccgcctaccaattcctgacaaactccgaatgctaataaatgttcgtcggcagtgagggcatgggtgctaaggtccatgtccgagagggaaagaacccagaccaacagctaaggtccccaaatatatgttaagttgaaacaacgcggttggactgcattgacagctaggatgttggcttggaagcagccattcatttaaagagtgcgtaacagctcactagtcgagcggtccggcatggataataatcgggcataaacatattaccgaagctatggatttataattattatatctggtaggagagcattctatttgcgccgaagcagtactgtgaggtattgtggagcggatagaaaagaaaatgtaggcataagtaacgataaagcaggcgagaaacctgctcaccgaaagaccaaggcttcctcagccatgctaatcagctgagggttagtcgggacctaacgcgaacccgagaggggtagtggatggacacagggttaatattccctgacttgctcacaataaaaggggacggttggatgtatctgctggagactgacggaatagtcaaggcctagccttcgggcgaagctgctgtagagtaatctgatccaagaaaagccgaagtgaagcaacccgtaccaaaaccgacacaggtggtcgaggagagaatcctaaggtgctcgagtgagtcgtggctaaggaactaggcaaaatagtctcgtaacttcggaagaagagacgccatcagcaatggtggccgcagtgaagaggcccaggcgactgtttatcaaaaacacaggactctgctaaatcgaaagatgctgtatagggtctgacacctgcccggtgctggaaggttaaggaaggtgcttagcgtaagcgaaggcattgactgaagccccagtaaacggcggccgtaactataacggtcctaaggtagcgaaattccttgtcgggtaagttccgacctgcacgaatggtgtaacgatctgggcactgtctcagccacgagctcggtgaaattgtagtatcggtgaagatgccgattacccgcaatgggacgaaaagaccctgtgaacctttactataacttcgtattgactttgagtaagtaatgtgtaggataggtgggaggctttgaagcaggcacgctagtgtttgtggagccgacgttgaaataccaccctttacttacttggagcctaacttctttcagaaggacattgcgtggtgggtagtttgactggggtggtcgcctccaaaagagtaacggaggctttcaaaggtaccctcagcacgcttggtaaccgtgcgtagagtgtaatggcataagggtgcttgactgtgagacccacaagtcgatcaggtgcgaaagcaggacatagtgatccggtggttccgtatggaagggccatcgctcataggataaaaggtactccggggataacaggctagtctcccccaagagctcacatcgacggggaggttcggcacctcgatgtcggctcgtcacatcctggggctggagaaggtcccaagggttgggctgttcgcccattaaagtggcacgcgagctgggttcagaacgtcgtgagacagttcggtctctatctattgcgggcgttagatgtttgagagggcttgattctagtacgagaggaccgaattgaacaaacctctggtgtatcagttgtaccgccaggtgcaccgctgagtagctacgtttggaagagataagcactgaaagcatataagtgcgaaactcgcctcaagatgagacatcttttaagggtcgttgtagatgacgacgttgataggctacaggtgtaaagacagtaatgtcatagccgagtagtactaattacccgtagattt

SEQ ID NO: 80 - DNA, 98 bp, Chryseobacterium sp.
gtggttttagcggtggggctcacctgttcccattccgaacacagaagttaagcccaccagcgccgatggtactgctaacgcgggagagtaggccgccg

SEQ ID NO: 81 - DNA, 79 bp, Chryseobacterium sp.
tcacctgttcccattccgaacacagaagttaagcccaccagcgccgatggtactgctaacgcgggagagtaggccgccg

SEQ ID NO: 82 - DNA, 79 bp, Chryseobacterium sp.; identical to SEQ ID NO: 81

SEQ ID NO: 83 - DNA, 528 bp, Chryseobacterium sp.
atgaaaaacaaaactctgtttctatctatctcaatcctatttatgggatgtaaaaagcaagaatttgaagaatttgatttctcctatggtaatacttttgaaacagatttctcaataaagtttcacagtacaaacgattcagtattcatatacgaaaattgggcaccaagtagcgttggtatccctaaaagtaaaaccagttatatttcaactcttaataaaaatcaaagatgtaaactcgatagttttatttcaaatatagacttcaaaaatctagatacactgtattttgaaaattatcaggatggtgaatattacaatttctttattagaaaaggtaacatcaggaaaatcataaaaatacacagtaataatgctccaaaatcattaaacaattttgctcattggatttatgaaacaaaaaaaacattacaattaacagagacccaaagaagcttcgaatttaaaagtaaaaatatttatcctgagccaccacctgctcctaatcaggaaagctcaatcaattaa

SEQ ID NO: 84 - DNA, 810 bp, Chryseobacterium sp.
atgaatcaggagaaaacaaaaatgcattttacagataactacctgttagccccgacaaacccgatcactgtcaatttggtgggagcaggcggaacaggctcaaaggtactgactggattgatggaaatcaatgaaagcctattggcactaggacatactggtctgcaggtcaggctatgggatgatgatattgtcacatccgcaaatttggggagacagcgtttttttgactgtgaggtcggattgccgaagtccgtggctcttattaaccgtattaaccgttgcacgggggctaactggaaagccgagacggtcaaatttgaaaaggataagtttggaaaaatgcccaaacaatctaatgcgacaattacgattacctgtgtcgatacggtacaggcaagatttggagttgccgaaatactcacatcggttaacgggcagcgtaaccatgttcgggattcgcccaaatattggttggattatggcaatagtaaacatacagggcaggttatcctttccacagtgggtaacatcgtacaaccggaatctgaaaaatatattcctgtgaacaacctgccatttgtgacccaagaatatggcgaactgctgatgcagtcagaacgggacgacaatacgccaagctgttcccttgcagaagcacttgaacagcaagacctctttattaacgcttccttagcgcagatgggatgcaagttactgtggagtttattcaggttcggaatgactaagtacaggggattattccataatcttgaagatttcaggactagcccgatattgatagactga

SEQ ID NO: 85 - DNA, 369 bp, Chryseobacterium sp.
atggcaaattggtgtaataacacgcttgtcttcgtgggaactcccggagctatcgagcagataacagtcctatttaacacaatagcacaaatgggacagcagatagattttgaaaaactgcctgattttctaggcggtacggaagatcattttttctgctatataagctataaccatgacggtatggtggaatatgaaacgagatggacacccaacatacaagctgtggtgcggatagcaaagcattataatgttgattttacactgggctatcaggaaataagcaattgtctatatggcatggcaacctatgctaacggtattctcaaaactatctgtttagacccaatggattttggcagattctaa

SEQ ID NO: 86 - DNA, 282 bp, Chryseobacterium sp.
atgaaaaagataatgtttgacaatagccatctttatgctggttcaataggaaaaatattgtttcctgtctcttcccgcagcgcatatcttgaaatagatattgaatttactgatggaatcatagcaaaaggtgatatggaagttctgaatgacaaagaactgatcctgaatgtctacgaatatgttacagcttctggaaccaaaatgagtaaaaaatcctggttccttaaaaaactggaagaaaatatatggaaagtagacaaaaaatattcggaatattaa

SEQ ID NO: 87 - DNA, 1860 bp, Chryseobacterium sp.
atggcccaacctgaaaatgtagaggatctgagaatcgaattagaatcgctaaaatatcgtgtgaaagagctgacggattttatcgaaaacggaagtatgccccttcactgggtaaatggggacggtattattatctgggcaaaccaggccgaactcgatcttctgggatataccaaagaagaatatattggttttccgatccagaattttcatgccgatagtgatataatttcggagctattggttaaactttccaataatgaaacggtacaggattttccggccagtctactgtccaaaaatggggatgtcaaatatgtcagaatcagttcaaatgtactgatagaggacggaaaatttatccatacgcgatgtttcaccagagatgtaaccgagctggtcaaagaagaaaaacgcaagaacgaacttcaccatctacttgcggaaagtgcggaacgtttacggcttgcgatttcagcatctaacttgggtatatgggaattagatttaattaccggaaatatccaaatttcagatgaacttcggcagatgcttgaaatcccgatagaagttgatgcaggtggtctgcttaaagattatatttacccggaagataaagaaaaggtggaatcccatatttcagatgtgaaatatagggataacggtgagtttgatattatttttagatttttaaaatcgaatgctattcctgtctggatcagggtgcagggaattatacagaaacaagtaagcgaaggtttacacagggtcgtcggctgcgtacttgatattacagatctaaaaaattcagaagagtaccattcaaaacttgtggccatagtgaactcttcttttgatgccatcataagtaaaacattgaatggagttgtcagtacctggaacagttctgcagaaacaatattcggttacagtgccgatgaaatgatcggtcagccgatcataaagataatccctgaagagcgcttgggggaagaagattatatcttggaaaaactcagggctggggaatccataaatcattttgaaacgcagaggctgacaaaatctggtaaactattagatgtgtccctgacaatatcacccattaagaacgccaatggtgaaatcatgggaatatccaaaatagccagggatatttcggaaaaaaaacaggaagaaagaaggaaaaatgattttgtttcaatggtgagccatgagcttaaaacaccgcttacttccatattattaagttctcaggccatgcaaagaggttttaagaataataatttggaaataggaagaaacttgtcagtcgggatcgaaaatcaggcgaaacggatgacttcgatgattcaggattttctgaacctcgcaaagatcgaggagggtaaaatcaggatgcattttgaatattttcaaattttaggtttgttgcaggagatcgtatcggaggcaagatatatcagcgaaaagcatataataaagattcaatgtaattcctctcatgaagtgcttgccgaccgagataaaatcggtcaggtcttaacaaatcttttgaccaatgccataaaatattcccccgaaggcggaactattgtgttaggctgtgagaaaatcagtaatgcttctttaaggatttttgtcagtgatgaaggtgtcggaataagtaatgcagatcagaaagaactttttaaaagattctttagggtcgaaaggaaggaacttgcgaatatttccggctttggtatcggcctttatattgtcgcagagatattgcattatcacaattcaattataagtgtggaaagtgaagaaggtaaaggttctacctttcagtttgtgttggaaaacaaagattaa

SEQ ID NO: 88 - DNA, 819 bp, Chryseobacterium sp.
atgccttataaatattcagatgaacagcgaatagaatggttaagaagcctaaatccaaaatttgatgatcaaaattggcacgatgacgtcgtagtccatttcagccatatcaaaaactttgatttttttatatctgccggaacgtttagggaaaaaatagatcccagtaaaatttgtgggattgattactcctatggctacaattgtgtaatgtataaaccaaaagactggcgatattattggctacagttttttactgatttgcgcaggttggatcgtgttattgacaattttccaaccaaagaaacggtgattgaacatattcataatgcaaaagaagcgaaaactgtcgttcagtacggcaaccattactttacaataggcggacaacatcgattatgccttgcaaaatttttagaagttcccgaaattgaggtagacgtaataaaatatgtttttgaccgagtccatttcgctcacgagatgcgttttcaaagaactattcctgctctgcaggaattaggatttctatcacttgattatcattctgatctccattacgatttttttatcatcgaatttgctggcgagtatgtctccgtaaaaaaaagatatgcacattatatattgaaaagatatacgaccttaaaaaagatgccattgaaaggatttctaaattatgtaaaagctatggacgcaaattattatgacaagaagaggattgatgaagatgtcaagctttatatcttggatgcctacttgttaaagcaccttaaaacacgtaaaaagttaattgatgtttacgtaaataaccaataa

SEQ ID NO: 89 - DNA, 564 bp, Chryseobacterium sp.
atgagtttttacattaatcaattcagcaaatttaatggattgtttgccgcaacaatcacaatcatactcgcttattacggtattgaaaggcttaaagcagcagaaagagcaaatattgacaaggttagacttgaccgatattctgattggaaaaccatcactgatgctagaattgatgtcgttaaagacgaaaatccattattcaggagagagtttatcaacattaggtatcagctttttgaagatttatatcccgcttttgcgattgaaaataaaaagcaattacgagctctttttaacaaatattttgcgaatttaatcccagcatttgaatcaaataataaaaaacaacaaggttgtggaggaatataccaatctgcagcatatacttattttggtcaaaattttctttttgttttccttggaagtgtaattggagtgaagtatgataatgcgacggaagatcttttggaaatgtatcttgcaagtcttccgagcgacagaattatagattctctcgcatatcaaagcgctttagagcgctacattaaatacaataattaa

SEQ ID NO: 90 - DNA, 1737 bp, Chryseobacterium sp.
atgcgaatgactaagaaaaagcatatcattgattttcctaaagggcgagggagatattggtatttattctggattggtaaaataaaatatgataaacagagaaaggttgatttgtatttttataataaactgatgcctgatgaatcctggtacaacaatattgattataataattgggtggtaaaacaagttccagtatcattcttatcggaatatggaataggatcattatacgatgttgaagaagaaaaattacttcctacatctcaagataatagttataattttactatacctgattcttattatatgactcaaaataaatttccactgattgggaatgaatattttattaagaattctagccaaataattgataatagttttaaatatctaaaagtatttggtaaaaataaatttaaaaaaagtagatgtattcttatttctccttatactattttgcagtatctatttttttataatgacaagttaataaataaggctttttcaggagagttattatctggattcaatacggataatataaaaacctattctggactgggtgatgatctaggaaaaaagataggggagcttcactacgacgcatctaaattaacaaagcaagaagctattatattagcccccttttttttcattaaagacggaaaaggaactaaatttttatggagtatttattctcatgtacaggaatcatttttcaacaatttaaaagaaaaagtttcggtatatctaaatctctcatgggaatttaaaaaatataaccttggtgtaattggtaaagaaatgtatgcattagattctgaaggtaaaaaggttgattatttgttagcttaccggattacaaattttacatttctagatgagcagccatatactgtagatgaaatacgattatttcctttcaacgctaaaaactctactaaggacagagagaatcatgatccaatagatgttacacgaccttctctttcagaaacggaagggttgtcattaaacttgacaaaagatacagcaaataataatcctgcaggagaggttaccaatgataaaatacgaaatcctttttatattcctgtaaacatcataaaaagagaaaaacaaaaagaggcctataatgtagatttgcaaaaaggagataatgaaaataaggatgtaattagagagattgaaaatttattagaattttctgatacagtaaaggaaaatgttaaaaattcaattattactattggtaactttgaatactttaaagaggtaattaggattcttagggaaaattacttaaatgagtcacctaattttgatgtaaaagaattttcaaaaaatgaaattcctttaccatttcaatttgttgagattagtcatctaaataaatatatatactttgttgaatttgggaatggaattattggtgtgtttaataaggagttatttctcaggatatctgtagaaaacttatttttattaggttctgaatttaatgattatgaaaatgagataaaagaaacatcgaagatattatggtcatatattagaaatcattattcaagagattatattgccaagggaatagtgattcaacttggagctaaacatgaccgtccaaggaaagatgaaggaagtattacaagtagggaagaattgattacaaaagctgcttcaagaacggctaaaaaactttacgagactaggatagttagtaatattctctaa

SEQ ID NO: 91 - DNA, 543 bp, Chryseobacterium sp.
atgagtacctttgcaagaattaaatcagttgccacctataaaaaagtcgtttattactcggttattttaaccgattcaaaggaagaagagattctagaagttgaaactgaatcattatttgaagactttttaaatagaaatcaaactgataatagaaaaaaattaacacacattctcgcttggatgaaagaaataggagagaatagaggtgctctgattgatgattttagacatgaaaaaaaggctagtgcattaccaccaaaaggaaaagatagaaagcctgtattcatgagtaaggggaagaatgatataaacgatctacgactatattgttttcctgtgaatgagcgcgtagtttttttattcaatggcggaataaaaactaccaaaaaagctcaggaatgcccaaatgttagtactcattttgacattgctaataaattggtttcctgtttagatgatctatttttaagtaaagaaatatcatggaacaaagagtttacagatattgaatttgcggaagatcttatttttgaaatatga

SEQ ID NO: 92 - DNA, 450 bp, Chryseobacterium sp.
atgaaattaaaggaaaagaaagtcttcgatcctcaaaaagcagaattatatgaaataaatattgaaagtaatgtacaaattacacatgcttttgaattggggaaatgtgaaatgcaagttggctttaatacttctgttgaatacagtgacgaagccaatgatctgagaatattattagatataattttagagagaaacgatgacaatgatgattttgctgaatttaactttgaattttattataaaattcaagatctaaaagattaccatgaagttaaaaaagaaattcatatactgtcagctcaagtcgcagttcctcttgtaggagttagcatatcaactgctaggggaattatttttgaaaggttacataatacatattggaaaaatgttcttattccaattgtttctcctaaagtcgttctagaaaatagtttaaaaaaacattaa

SEQ ID NO: 93 - DNA, 2238 bp, Chryseobacterium sp.
atgattaattcaattacactgaaagctattgctacttatgatcctttagatggagctataattgataatttaaagagagtaaattttttatatggaactaatggttgcggaaaaacaaccttatcaaattttttacaagagccagacaacaccaaatttattaattgtaaaatttcttggagagataatcaaaaaattaaaactctagtatataataaaactttccgagaacacaattttggaaaaggtaaaataaatggaatatttactttaggacaggcaactactgatgaaataaaagtaatagaagaaaaaacagaacaattaaaaaagctaaaagaagacggtacaaaaatatatgaaactctaaatagtcaaactggaaaaaaaataaaaattgaaaaagaattcactgattattgttggaaaaaaatatacaagaagtatgaaagaaacttcaaaggagcttttgttggctcaatgaagtcgggagaattatttaaggaaagagtattaaaagagttttcaaataacaaagccaagttggaaaatatagaattgttaacggagaaagcaaataccatatttggagacactccacaaacaatcctaccaataaagaattctaactatactaatattttatctatagaaaacaactctatatggactaaaataattgtaggaaaagcaaatgttgatattgctgcactaattcagaagttgaacattaatgattgggtaaatgaaggaagaaattatatacaaaaagatgaacagtgtcctttttgtcaacaaccaacaattacagaaacgtttaaaattcaattagaaagttttttcgatgacacttatctaaatgatttaaagaaaataaaagagttgaaacaagaatataatatcaataatcaaaatattattaatgaattaaatactattgaaatagatcataaaaatttaaaaacctcaaaactagatataaataaattttctgcatatctcaaaacattaataagccagaatacaacaaataacgagcttttaaataataaaatcaaagaaccaagtcgaaaaatagaacttatttcactaaaagagcaattagatttaataaaagaattaattgataatgcaaataccgaaatccaaaagcataataaaattgtagaaaattataattctgaaaaagataatttaattcaagaaatatggaaatatttgattgaagaatctatagatgatttgataaaatataattcagacattaatggaatagataaaggtatactggctctacaaacaaaactagattccaaactaggtgaatacaacacattaaaaaatgaaattattgatctaagtaaaaatgttactagcattaaacccacagttgatgaaataaatagacttttaaaggcttatggatttttaaattttaaaattgtaccagcaactgaagatggcttttatcaaatacaaagagaaaatggtgaaatagcagaaaccacattaagcgagggtgaaataacctttcttacttttctatattacctacaacttgccaaaggtggacataatgaaaatacaatcaatgatgagcgtattttggtaatcgatgatccaatatcaagcctagacagcaacattttatttgtagttagcagcttaattaaagaaatattaaaagaagtaaggaatggtattggaaatataaaacaagttattattttaacacataatatttactttcataaggaggcatcatttgaaggaattaatagaggcaaaggagagaaaaatcaatattacatcttaagaaaaattaattctatcactaaagtttattcgtactcagatataaacccaattacttcatcatatgaacttttatggaatgaaataaaggattatcaaaaaaattcaggtattaccgttcaaaatgcaatgagaagggttatagaaaattactttagtattttagggaataaaagagatgaaactctattgtcaaaattttttaatccccaagaaaaggaaatttttagatcgttgttaagttggattaatgaaggatcacatactttaccagatgatttatacgttgagctacctgatcaatcgatagaaacatatttgaaagtatttaaagaaatatttattcatacacataatatagggcattataatatgatgatgggggttgaagagcaacaagcaatattggtagataaggattag

SEQ ID NO: 94 - DNA, 1101 bp, Chryseobacterium sp.
atggcaaaaattatttctctatttaatcacaaaggtggagtaagtaaaaccactactgtttttcatttaggttggaaactagcatcacaagggaagaaagttttaatgatcgatgctgatccacaatgtaatcttacaggtctaactttagggttagatgattataattccttattaaaattctatgaaaataaaagcaatacagacatttttaatagtcttgcgcctatttttgaattctcagacgtaagtatcgcagcaaaagagaatccgcatgcaataacaccaacaagtaatcctaatttatttattttagcaggcaatattagattttcagaattagatatacagattgcaacagcattaactagtagtggcacaattccaattctacgcaaatttgtaggtgcttttaatagttttgttagaaaaattgcagaagaaaatggtattgatattgtaattgtagatatgagtccaagtgtctcatcaacaaatcattgcattttcatgagttcagactactttattattcctgtttctcctgatttttattgttatcaagcaattgactctctaagtaatgttctcccaaaatgggcaacagatatagaaaaattcaaaggtgaaagtgaagatgatttaccgattggaaaccctaaaatgttaggttttattacacaaaactatagaatttatacggttggtagaacggcttctgatacagaagatgtagttgcaccaaagcaaatgtccaaagtttatcaagactggcttgacagaataaatcatattttaaatactaagcttgttcctgaattacgagaaaaagatatgattgttgacgaaactctatttcaagaatcagtaacttatggtgatgcgtaccacttatcaggaatccaaaatttcagtgggttaatacctgtttcacaagcaactgctaaacctatttttgagttaactaaaactgatggaaattggacaggagccagatggaaatggaaaaaaaatggtaaagaatatgggattaaaaataatatagaggaagcaaatatggtttataataatctcgcagaagctgtaatcaaaatgatatga

SEQ ID NO: 95 - DNA, 855 bp, Chryseobacterium sp.
atgaaatattctcaactgactgtatttaactataaaatagcttactatgcgatgaggatagtcggattatactggctgctatctcaatattatagattttccgagttgcagggtagaccgaaggaaatttatgaacctttctttttagtggaaaaaattatatttcccgaatttcctgatattttattatttggagtgcttttaataagttgtagtttgtttattattatttctatttttaaaccgtcttacattctcaatattctcatatttttactgatggcagtcatcaatcttcctttgtctgcaaattttgggcttcatcatgataatcatttggttattttaggatttttcttaagtatatttttgcttccaacatatcttaaggaaaatgattataaattaattcagtatttttatttaggtcttttaatgacttatacttatgcaggtgccagcaagtttttaggaacggctaaaaatattattaagggtactgataaaatgctatggattaataaaaattctgcaaaattaaattcctatgataattattgggtagctgacttagatatacccgtctggatgaaagaggtgtatgcctatgaaaatctttgggttttcctcacaatgacaggaataagcttacagcttctttgttttcttggagcttttaacagaaaattgcttacattttttatgctgttcattgtagtattccacctgtacaatatcgtgttcgttcttgcagatttcagaaatgctatcttttttgttttagcagcgctgtttccctatcatctgttgattccgctttttaggcgaaacaggaatcaaaagatgaaccactaa

SEQ ID NO: 96 - DNA, 1008 bp, Chryseobacterium sp.
atgtatgactttggagccaggatgtatatgccagatttaggaagatggggcgtgatagatcctatggcagaagctatgagaaggtattctccctacaattatgccttcaataatcctataagctttatagatcctgatggtatgaaacctcgtcaatttgccatgcctacggatgcgagacctgatgcgccttcaggctggattaatcctaactggttaggaagaggagatgctacttttggatctatagaaactggatatggaggtagttacggatttggctctttatatccacaatcaaatggaacagacgataatgatttgcttaatgatattatatctatatgggaaaagaaattaggaaaaaaaatagaaagaaataaaaatggagatttttattggtggaaagattataaagatccagatccaaaggtaaagggcgttggggagcttaatattcttaaagtatttaataatagtttaatgggaatggtaaacaatgtagaaggaatgagtaaaaacctaatgcattatcagacagaagatttttttaaggatacggaaaagcatttaaatggacaattaggaaatgctaatatcgtaatagatgaatataataaattatccaatgtaaataaaataaatgcctcgacatttctttcggcagttagtggtattagagcaggaaagattttaagatcaaccgagggatttatgaaatcggtaggtaaaatttctaaaagattaggctatgttggtactgctttaactgctggggtaactttatatgagtttggaactgatacttgggatgcccattctatcataaatctaggtttattaggagccactgctgtagcaacatttgtaacggctcctgccatagttgcagctgcaccagctattttggctggaattgcaatatatggtgtagcagattatatgttcggtattggtgaccaattagatgaaagtattggtagaaagtctacaatatggtacccataa

SEQ ID NO: 97 - DNA, 990 bp, Chryseobacterium sp.
atgtatgattttggagcaaggatgtatatgccagatttaggaagatggggcgtgatagatccattggctgaaacgatgagaagatattctccttataattatgcctttaacaacccgataagctttatagatcctgatggaatggctcccttgaatcaatttaggatgatgtcagattctcgtcctgatgcaacttcaggttggacaaaccccaattggttgggaagaggatcatacggtaatatagattatggagaaactttagcccctggcggcggtggcggtgtttatgaaactgattatgaaactgtatatgaaggaagttatgcaagagatgctttttcagatatggtgtcgggcaatcctcctcggtctaagaataaaaagccaaattttcttcaaaaaattggaaacttctttaataaattattgggtaataataaaggcgtcggtattacaacatttgctgctggagcacaggtcagtagaattgttcagattggagagttaattcagttaaatgcacaagctttttatagtgctagtggtactttagcaactcgtagtatttgggcattaccattaatattgaatggggatagctctcatgcacgtggttatgatatacctattacaggtacaacagatgtaccggcagatgagtcggaacagagaataacattataccgaggggtttgtgtagggcactatgattataaaaatgctctcaaaggtatggcagtaccattaggagggcataatgatcctgactcgcataattggggagatacggaaagtgtttttacatcgtggacaactaatataaatattgcccttaaatttgcaaataaaaatgggtcaggaggtgtacttttatcaaaagattttctagttcgtgaaactataccgagcccagatacatataatgagcaagaaatattaatacaaggaattgttactggagcatttcctttcattcaaaaaagataa

SEQ ID NO: 98 - DNA, 459 bp, Chryseobacterium sp.
atgaatagttataaatattttttacatgtagttttttcatttattttaataagctcttgtactaaaaataatgatttaagctaccatctttatgataaaaatggttttattaaggttgatggaaaatttaaaagtgatcaatttatagatacaatttatatctataaggagacagatagtgatatatataatgatcattttaatacttttataaaaatagatagctcaaaaaataactttttttatggtacagaaatcatagaagaaaagaatactcataaacttttttctaagggaatgtatagatttaaaaaatctaataatgcaaaagagtgttatgaaagtaaattaagaactggatatttcattatttttaatcgtgatgggagtttaaattcaagaaaattatatcagataaaaggggattcttcttatattattaaaagacaaagcatataa

SEQ ID NO: 99 - DNA, 495 bp, Chryseobacterium sp.
atgagaaagattaattttattatagtatttactttaatattatttaattgtaaagacactaagtttcaaacgaaaatatattatcctaatggaaaattaaattatacatcagaaattaagaaagacactaataaacttatattttttgataaaaatgaaaaagcgactatgcatttaaacttttataaagatcattttacaggtgctatttgctataataaaaaccctaatcttccatttaaagattctatcaatatagatagtttgaatggtccgtatttctatggtacagaatatattgtttttaaaaatggtgctaagcgtatgggaacatatagatataaaagaaatttagattttgaaaaagtactatctagcatacagccgtttggtatccataatacctttgatatgaatggaaatattattggtaaagatgagtatatgattataaatgatactatatataatactaaaattgttgaaaatgaatag

SEQ ID NO: 100 - DNA, 573 bp, Chryseobacterium sp.
ttggggttagttggtagcagtaaaaaaggaagcatagaagttggtcctgcggtagctatagatccttatgttccaattgtttccccctatgaatctattggcgtattctcttcttatatagcaagtcaaataagaactacaacggaaacattctttagtttttcaggaggatcaaatgatccggataaagaaactttgaataagcttagacctggtgatagaatagattttaataatatgtttgagtatattataaatggttatgggagagcatttaaagttgtaaatttaaaaccagatcattatcaaacagcgattgatattatgtctctgagttcacttccaaatgggaatggattttatcctccagcaggtttagctaatccagatacattaggaatatgggatactcaagctacgggaattttacgcatgaatgatggtacgccatatggattaaaatataagaatataagaggacagggtctaagtagaagaactttagattccttaaacagagcaatcaaagattcaaataattattggaataaacaaattatgcaaaataaataa

SEQ ID NO: 101 - DNA, 939 bp, Chryseobacterium sp.
atgattgaaggaaaaaatctcaatttagaagaatttctagaatatcttctatctaaaaaatacaatgacctttaccccaacaatttctttcctacagaagaaatggcaaatgaatttatatcgaaaatcaatacttatgatgataaaaagataaaggctattctcagaaaatttttaattcagaacagtacttttggaaaggattattatactgcacagtggatctctagagaatttaaaaataaaaaaaatattgaaaaaattctttcatatgagtattatagaaagataattgctcgaactaaatcagataaggtttatgtctgggaaggattaacttggattttagatttattaccagattctcctaaactagcaatcaatataatagatacatatttttatgtcaattgtcaatttttacccgataattatctgaatgcattaagtgattgttctatgataataagagcaaaatatattgattataaacataaagaagatatattcaatgaactctctccaactgatttcgaaaagttagtgggaaaattatataaggaaattggatatgaaatccaattaacatcaaaaagttatgataatggaattgatataattgctaagaggcaaaagaaatcacaaaaacaagaactacttattcaatgtaaaagatatacaaaatctaaaatcggagtttctgaaatacggaacttactcggagtagtagcaaatgaaaaatcaacaaaaggagttttagtaacctcctcaacttttacaaatgaggctaaaaaattagctgagaaaaatccaagtattgaattaattgataacttagacttagtaaagcttctaaattcaagttttggaccatattggacttctcggattaaaaaaataataagtgataaatttgaattaaaatatgcttttgaataa

SEQ ID NO: 102 - DNA, 846 bp, Chryseobacterium sp.
atgataaaagatacatcaacaaatcccaactatgattatccgcaagactatattggcaggatagatgaaaatatgctaaaagtaattgtgaatttggaaaggccaataggttctacaggtacagggtttcttgtaaataaagataataatgtttttttagttactaataaacatatgatcggtgaatactcacttgtagatccttttatattggatgattcaatatctgtctacttctacccagaagaacctaacacaagtattaagaaaaccataagtttaaaagattcgactggaagtcttactagagaagttagattgcatccatcagaagacgtagatatagcagttatagatatcacttcaatatttgatacagataatgacatatcacgaaattatgttagtacaggatttttaattccgataaaagatattagtaaagaggcttttttaggatttggttcacaagtttttaccatcggctatccaggaggttttaaattagccacttctaattacccaatcgcaaaatcaggttttatagcttcatctttatcagggaatctagaaatcataacaaattgggtaaataaaagcttggtcacagtctctaaaaccctaagtgaaaaattttatttagttgatggattgatcattggaggaaatagtggaggtccaataatttgtccaaaggatttttattataaagtaagtgaaagtcacgaattacaatctgtaaattataaggtatcgaacctcataataggaatagtttcatttggttggccaaacacaggccttactgttatttatccttgcgactatattttagaattaatataa

SEQ ID NO: 103 - DNA, 765 bp, Chryseobacterium sp.
atgcaaaattcaaatcaaaaatggtatcaaataccagaggtaattataactttaatttccacagtttgtataatgttaacgaccatttttactccgatttttacaaacgaaaaagatattagagaagtattcataaatacaccaaatcttgataaaataaattttttagattattttggaattaaaaaaaacaaaatattcacctacgaaattatagaaaaaagtattgatgacggagctgaatatgatagtttatatgttgtagatgttagagtaataaatatacaaactaaagataatatatctttagttgaatttgacaacgatattctctttcctcgaaaacaaaaacaaaaattttatttattattcatatctaatatggtttacggtattccacaagaacaacaaataagagtaacagaaatgtttagcaagggtaattataaattgagagatagtgattttaatgtatttccagactataatttgccattttttcataaacaaatattttcttcaacaattcctcattccttacgaggagataaactatatataaatcatgtacaatttgaaggaacaacaaattattttgatggcaaaaaaatgactgaaagaatgatttatcgtatctacaatcagacattaagtgatcaagtatattccgaattcataccatatataggatttacaaaacattcctatcatcataatggccctagaatcgagtataatatcgagctcaaaaataccgaaaactaa

SEQ ID NO: 104 - DNA, 549 bp, Chryseobacterium sp.
atgaatccgatcttaattgaattttattttgataaaactctaccaattttccctgtatatagatggaactatgaaaaatatcaaaaaatatatagcattgaatcttttgatataaattttgaaaatgaagttttcaatgtatttaaaagacctttacaatatttttataaagaatcaattccaggagatttctttgcatcaaatgttttagaagttaacgaaagtgaactagcattccatgccgagtttgataatgtattatttttttatttatatagctctatcagaacatatctagaaagtttttatgaaatcattgaagctaattttagtgaatatagaaatgatattggaaattatagagtacctatttacttttataatgatcgttatacgtatataaagcaaaatcattcaatatttcaagtttttaaatttttgatagaaactagaacaaatactattgaaagaattgatgatgatatgtttataaatatttttcaaataaagaattttgaagaacaatttaaaaaatacaactttatataa

SEQ ID NO: 105 - DNA, 1377 bp, Chryseobacterium sp.
atgggatgttttttgaatatggtttccggtaaggaatatttactctattactatgttttacaacaaaaaattaaaattcaactaaatattagagttttttctttaatttcacataaaacaataacacgaagatcgtatataaataataacatgagtttagaagaaaataatataaatgaaagatataaatcagctattgattctttaacaaataattcatcaagaatttcagaaatgactaaacaaatttctttattctctacaccaatctctagccaacttcaaagttctttaaaagaaaatctagataaaaaccttcttatttttggtagtatcacaaaattacttccacaaatccttacatacgaaaatcatcaatcactggctaatttatctagaacggcaattgcatctattacccaattaaactccataccttttttatcagaatacgaaaaaaatattcaacaaaatccaatatctaatactgcaagacttctttcagcaagtctaacggctaatgattttttaaaaaactatgattctagtagattatctagtataattggaacagatattacatctagactattaattcataacgatataataaaagctacagagttgtcaatttatgctgaaaaatcaattgtcaatttaagtgtacaaaatattggaagtaaattaaatgcaaatcttattcagcgatcaaaattatttacaaattttatagagttatctcaaagttataactcattatatgaatcttttgaaagaaaccctttatattatagtcaattagatcctgtaataaaaaatgtaattccatcagaatattatacttgtgcagatacacttgaaattctatcgttagagcaagaaagtgaaactagagaggaaattttaataaaagacgaaattaagtatgagaatgaaattttattaagtactcatctcccaaaattaaattctgatttatatgatttatggaaaggtgcaattcaggcatatacttctgataatgtagagaaaccaagacattttatcacgtctattcgtgaactatacactcatgtttttcaaattatatcacctaataaagatatagaagcgtggaataagtctcctgaattatatcataacgggaaacctacaagaaaagcaagattattatatttatgtagaaagttcaataatgaagaaatgaaagattttgtagataaagacatcacatcaaccctagaattaattaacttatttcaaaaaggaactcattctattaaatcaaaattaggagataaagaacttgcaattattaaaagtaaagctgaaaacactttaaaatttttgctagagatacatttttcaaatttttaa

SEQ ID NO: 106 - DNA, 984 bp, Chryseobacterium sp.
atgaagttatcaaataaagatttacaaaactttattgagaagatcaaactgcagcctgaaaatatgggtaaatacagagatcaaatcaataatttgaaagaaaaattagaaaaaaaaattgctgaagatgatagtcacggattaaaagttcaaaagtacattattgctggttcgtggaaaaagcatacaattttaaaacctactggagaaaaccctatagatatagatttggtactctttatttctggagataaagaaattcataatgatctacccaaattatatgattatattgtttcttatttaaaaagtatatatccacaaaaggatattcaaagagatgttgatgctaaaggaaatacaaaatcaataacaatttcctttagtggaacaggtttacaagttgacattgttcctgttgttccactacaagatatagccgaatatgtttggcagccaagtcgacgcggtggaaaaaaatatataacaagtatcagtaaacaattaagcttttcactagaaaaaaggcaaaaaaatccatcttacacctccattgttagaacaataaaatggtggaaaaattataaagaattgcagcctacagacaacgaaccaggtttatcatcattttcaattgaattaattgttgcttatttagatgagaactatggtatagaagaaagtattgaagaaggtgtaattcgattctttcaattcgtaagtaatccatcatttcccataattgaatttaaagattcaattaaatcaattcctggcaattatgactcacctatttacattgctgataatacaaacaaagagaacaatattgtgaaacgtcttgataaaaacaaatgggatgaaattattgaagaagctgaagatgcctttgataccttaaatattgccgaatcaaaaaataataaaggagacactattcaagaatggaaacgtgttttcggaccaacttttaatttagattaa

SEQ ID NO: 107 - DNA, 516 bp, Chryseobacterium sp.
atgcctatgtacggaacaactacaaaaaccagcacttatacagttttagatataagaaaaacctttgaaggctgtgaagctgatattagaacaattgcacgaagaactggaaaatggacaatggaatatgttgataaactattctatgacatacttttattggctgaaaatgaatatttatattcagttgatgttgtattactaaacagcgagacagaaagagtaattcgagcttcaaaatttattgtgaattctcttggaacatctacagaaagtgaaagagcaggtaagaataatgattggactgacattccaaatacaagattatcagtcattttggcatatactcaaaaatggaaaaatttaaatgcttcagaaaaagaaaatttttcaaaaggttttaaattatcatggacggcatcctctattgataattcattccccagtcttcaaagttcaaatgctcaattatatgctagcaaaggatatgaattaaaaaaaactaattacaaatag

SEQ ID NO: 108 - DNA, 885 bp, Chryseobacterium sp.
atgaataatatttttgacaatatagttgaattacctaacaagggtatacaagaaagagcaaagaacttagttggttttgattcaaaattcgatagaattttttctaacttaaaattattacttgatcaagaaggattaagtgaatggagtaaaaagtttcacaaagtagagctaccgattatttctcagcttcaagagaagtatccgctaattatactgtctggagacgcaggtaccggaaaaacaatttccgctgaagcaattgcagatagaatgttacgagaacttaaaaaagacggtttttttctcaaactaagtacaagagtaagaggagaaggtttacatggtcaaatgggtaacttggtaaatgatgcgttcagtgaattaaaaaatcaagcgggaaaaagaagaattgcatttttattgattgatgaggctgatgctatagcctcaactaggtcaactatgcaaatgcatcaagaagaaaaggcagctgttaatacattaattcaaaaaattgacgaattaagagaattaaatggtagagctattttattcatgtcaacaaatagacttcattttctggatgaagcaattattcgaagagctgcaataatattagaatttgagagacctacttttgatgagagaaagcaattgtttgaaaaatcaattggagaaattggattaaacgataaagaattagaaactttagcagatttaactggtgaaaaacataataatggtttagctttttctttttcagacattcgattgagagtcttacctgaagcagtatctaaatgttttccttcaaaagcattggactttgaatcggtaaaagaaacaatcattcaattaaatccaagtccaaaaataatatga

SEQ ID NO: 109 - DNA, 813 bp, Chryseobacterium sp.
atgaaagataatctcataaaatataccatacctattttacttattattattggattatttgacaatgatttttggcattctccatttacaagagcaggtataatttctttaataacattgatttcaggttggttaatagataattataaacaactaatattaattattaatactcaaattttgcaccgcaaaaaagattttcgtttatcaattgcgtatctgtacagaattaaagttgacaatgagtatttactagtaaaaagtagaaccagaaattattatcagccagtaggtggatgttataaaacattacctagtagtagtgctatttttgaaaaattagaagtaaaacctgacagaaagtttgaaacagaaaaaggaatagctaaaaatgatttgagagtttatgttaggggaaaaaatgtaatctcttttcttaaatggttcgattcaaaaaaggatagggaaatttctccatggagagagttttgtgaagaattaatctcagaagacattttaccctggagacaatttcgcttcattgattatgaatttaaaaaaaagattcaatctccaattatcaaattagatagcgggggtaaagggatatttatttttgaaatttttgatttggttattaataatgaacaattaccaattctagaaaaactaaaattagaaaaagaatcaaacaaatttatttgggtaactgacgatttgatacagacacttggacatagtttaaatagtaaggagtatatgtttgaaatctcaccccatactaaatatgctcaaaacttaaaatgggaataa

SEQ ID NO: 110 - DNA, 330 bp, Chryseobacterium sp.
atgacacaggaagaaaaagcagaattgcaaactgcaatcgagcaaaaaataacaaaaacgaaaaaagacattgcggactacaaggaaatgaccatacctgtagcccccgatgttgctattggaagaattagtagaatggatgccattaacaataaaagtgtgttggaagccagtttacgtgaagccgaaagcaaattgataagattaaaaaacgctttacaaaaaatcaatgatgagagccttggtatctgtattaaatgccatcaacccattccttataaacgtatgctcattatccctgacagcgtaaaatgtgtgggttgttcttaa

SEQ ID NO: 111 - DNA, 177 bp, Chryseobacterium sp.
atgaaaaaaagaatatttaaatttggagctgtaagagctattgtattagtgttaagttttttaatacttatcatgacgggttttgcaacttttgatgtatatattctttttaaaagtgagggagacgtttttgtcggaggatattctgcaatagctttattaggttttatttattaa

SEQ ID NO: 112 - DNA, 156 bp, Chryseobacterium sp.
atggaaacaaaagaatcttttactgattttcaagaagcagtaagaaaaattttagaaatcttaaatgaaagaagtctatatgaaaacaaaaagattttagaaaaagttaatgaaatacttgagagctcatcaatcctcaaaagatctgttaattaa

SEQ ID NO: 113 - DNA, 204 bp, Chryseobacterium sp.
atgaaaggatttatagaagtttatgcccttgatactgaaaggtattatataaatgttactcaaataaaatatttctatgtgccagtatttcaagaaaatggagaaagaaacatcactattgttctgggtgatggaagacagattcaatcaagaatgtcaataacagattttcaagatttaattaacagatcttttgaggattga

SEQ ID NO: 114 - DNA, 204 bp, Chryseobacterium sp.
atggttctatatttgtatttaattgtaaatatgaaatataaggataaaaaagtccttgaatggactataatagatggaataaaataccctaaaaaagtagtgtatttggttgataaattacctaatagagataaaggtaatggtaaaatgatagatactgtttttcaaaataaagcaaatgtacgattggacagaaaaaggtaa

SEQ ID NO: 115 - DNA, 480 bp, Chryseobacterium sp.
atgtacgattggacagaaaaaggtaactatgtatttgaatttttcacagataaccatgatgtttattatctttacctaaaaccaaaagaagatcattttgctgatttttgctcggaatgtaaagatatttatgaggtagatttaaaatgtgtttctggaaaacctacacctgacgaaagagtcaaagaaactgtcattgctattttaaaacaagttttaactgaacgatgccagagcttagtgtttttttgtgataacgagggaggaaaagcggaatgtagggaaatactttttaacagatggtatgaagcagaagatgaggctgacgagaaagtacaaagatttgtaaggagccattgtgaagattttgaaggaagtgattgtttcaacatgtattttatagcagataaggattgttataattttaaggacaatgttaatgatttcttttcatgtgaccatatagaacaagaggactaa

SEQ ID NO: 116 - DNA, 1413 bp, Chryseobacterium sp.
atgaaaaaattcctttttgtaatgttgtttgctgtgagtttacaagctcaaatgcacgtgaaaaaagaccaaacatatgaaacgaatccgtttattcacactacaatgaataacactaacagaaacccgttgcaatcaatattgcaaaacggaagtattctctggcttgacagtgatattactaaatatcgaccagatggaaaaaaagatatgacatttggtgttaatggatctttaagtgtagtagcaaatgatttgacatatgctagtttgataaaagttgtaaataatagtctatatgtttattcattgaatccatattggactactccggttgaaagagtaggtaagtttgattttaatggagtgaaaagcacaagctttgggacaaatggtattttatctttttctaataatcgcttggcaaattttaattatatgattgaaaatgtagatcaatctttatttgtcatagctataagtggtggaaataaaaaaattcttaagatagatgctaatggagtaatagatcctaattttattagctcagatttagatgcaaaacctgtttttgggttaacacaattatctaataacaatgtattaattacatacaatgattcttctgtttccaagaattatctaaaaagatatacttatcaaggacagacagataatacatttggtgatcaggggattacttaccttgattctaataataaccaaattgtggtaaataacttagacgaaatatttgtatttaacaaaataggaacacaacagattataaaaaagtatgcatctaacgggcttattgatactacgtttgggactaacggggtatttgatattgcatcattcaatacaggaaaaacaataaatataaataatatagatttagattccaatagtagtgttcttttgttcggaggagcaataggagtaggagagactaattcgttcatagcacgaataaattctaatggaagtttggataccaactttcatggcaattcatcttatttcatggctcctgattcgtttgcggataatcttttaggtaaagtcatcaatgataatgagtatatatgttttaacaaagtagcaggaagtagcatggtttcatacaaaagccttaaatacacaagaaatggtactcctgcgttaggccttcaggatatgaaatacaataatagtattaagatctatcctaatcctgcatccgattttattactattgaagttggaaagaatgataagattaacaaaatcaatatttatacaatgacaggtgaatttgttctttctagtaaaaaatctgaagttgatattaaagatatagcaacaggaagttatatgatagaagcaactgtaaatgataaaatatataaaagtaagtttattaagaaataa

SEQ ID NO: 117 - DNA, 1344 bp, Chryseobacterium sp.
ttgcgaaaactaaatattatgaaattgagaatcctttttttatccttgctatttcctttcatggcgcttagtcaatattatgtagggcgcttaaataattacaattcacgggagtattattctgctgagaatttaaaaactgcaataaatggtgatggcagtatgtatattttttatggtagtaaaataagtaagattctgccgagtggtttaatagattccagttttggaattgggggaattgttgatgttggtgtttacagttcctatggtactaacatttttgctaatgatcaaggaatatatttgttattagttaataagattgcaaaatatagcttaacgggtactcctgatatgtcatttggtgtgaatgggattgttacatattctcaaagtatttccaaaatatttttaaattctgattcttctttatatttttcaagtaataaggaaataaagaaaatacttcctaatgggcaaatcgataattcatttgcaattagcgttcctgcaaatgatttctattttataaataatgatttttatgtgttccgccttgaatacccttcttttttatatgtaacaaaacatgatttaaatggaggacaggaccttacttatggtaatttgggaacctttaccggtctaaatcattatattatagatactacttccggtaatatctatgcaaataattcaacaggaattacaagatatacatctgcaggagtagaggatagtacttttggtactggaggaacagttttaggaaattttccaggtagtattaagagcgtgaaaatagattcaaataataatattcttttttttggaggaggtcaggcatatggatataaccagactgtaatttataggttgaaaaataacggagatcttgataatacatttaacaacggaaattataagtatgtttcggatcatggtattatattaaatgcaagtttgatagatgataatacttatgtgtgtgtagataatagaaggtacagtttgaacagttttgttgatagaacaaaaaaatatgtaagaacgcaggatcaatcaataataactgtagatcagaatctcaatttaaatgaagtaagaaataataaaacagacaatatcaaggtttatccaaatcctacaacagaagttctttatgttaaagtagaaaataatgaaaaggttaatagaataaatgtctatactatgacgggagatttcatattgtctacaaataaaaccgaaattaatgttaaacatcttactacaggtaattacgtaattgaagtggttacaaaacataaaaattacaaaactaaatttgttaaaaagtag

SEQ ID NO: 118 - DNA, 2460 bp, Chryseobacterium sp.
atgtcgaataaatcacatttaaaatttttaaatgaacaacaaaaaccagaaataaaagaattcaattacaattatggttttgatcccaaaaaagaggaaaaaaaagatattactcctaagaattattttagattggctatgtcatttagagctgatttaaaaagataccaagaagatataaacacaaaatatagcaatagagattataaattagaagttcctcatgatatagattatatcgtatttacttttcaggatcaatttattatagataaatattttgatgattattataataattttggcttagaagctacagctttctatgattttgcaaaaaaaggtttatttgcaattattgatagagataaattcgaaaaatttattgaacagattacgttatttattaaaaaggaattgaatggaagccacaatgtagaatataataaccacgttaaatatatttcaaactttcaactattaagattttcggatattctaaagtttcaactagatcaaacaggagacatggtacaattatccttaatagatctaccattagatgaaatagtaaagcacgaaataatcaattctttaattcattatcttgaagataatgaattaaactataaatacgacaatgttaataacagaatagaattacaccatcccacagctgaagatattaaaacaattattcaaaattatgatatcattgaaagtgctacttgctcagccttcaccactgttcgccctggagaattcaacacagtccaacgccaattcagttttaatattgataataaagatgaagacctaccaattataggaattatagatactggaattagtttcgattcagcactgtcagatataattatcaaggatacaacattttctcttgcaggaaatccgttaattgatcaagcagggagaaatagattgggacatggaactgcagttgcaggtttagccgctttaggaaaatataatcatagaaataactttgaaggcaatattattgctgatgcaaaattgttatcaataaaaattagtgaaacaggaagtggatatatctcagaagtagatttattaaaaatgctatatgatgtaaaagaaaaatatccagaaattagattgtttactctaacaacatgctatggtaaatttttggaaaataatgaaacattttcagactatacatatagcttagataaattttcatatgaaactaatagtttaatctttatttgcaccggcaataacaataattgtatttatgataacaccaattacgatttatcttattttcatagagaagacaccaacctatcaactccttctgatagtctaaataatattactattggagcagctgcagataatctaaaagatggagcgtttcttggtattgctacaggaagggaatttcctacattatatacgagaaagggacacattgatttatcagcaatttataaccctaagaaaaccaataaaaactattttaaaccagatgttatagaaagcggtggcgatgtaggatatttcagacaaaatgctttggattggatggatgaaccagctctcaccttattatcagctcgtccagatataggcataatgcaagaggtaggtacaagtttcgctacaccattagtagctaaccttgctgcaagaattataaaaaattaccccaacctatccaatgaaagcataaaagctttgataataaatggtgcttcaataaaattaatacctttcccttctgatgctaaaaatatccataaaagggttataggaaatggtctaatcaacgattccaaaagcctttattctgatgaaaatactgcaaccttaattttagaggataaaataagaagcggtaaaataagagtatatcctatcaatttcccgaaatatttaattgaagaaaattttggtgtagtaaaaaagagatttaaaattacagctaccttatgttttaaattcttaccactcagaaataatcaactatcctataatccaatacacatggctttttcaatattcaaaaaccactctgctgatgatattataaaagccgatgataaagatgctggttttacatctaaacttcgttcaacattatcttggtctgaaaacggaagatacgtttccaaacctttaccatactctaacactcaaaaaatagaattacgtgtaaatgttgatgatttaattaaagaggatagcacattcaaattagcaattcatgcaaaattatccaagcaaattgttggtgggctaccagatagctatcctacagagtttccattttcaattgcattaactattgaggaaaccgttaaagatccgaaaggaaaattatatgatgaaatacaattatttaatgaactagaggcaattcaacatgttgaattagacctaacttctgaaatcaatgaattagatatttaa

SEQ ID NO: 119 - DNA, 1266 bp, Chryseobacterium sp.
atgaaattcaatataaataaaatcgcgtttgtaacagtgataactgttttaatatttgccttttccgcttgcaataataataaagatggaaatgggcaaaaccaagcgaaagaaattaataaagaagcccacgaagaagcaccaaccattaccacacttaccgaagaacaaataaaagcggtaggcatacaattaggcgtagtagagcaaaaagaattaacggcaaccatccgagcaaatggtttgctgaaagttcataataacaacaaagccaacgcaacttctttgtatggtggtgtaataaaaacactgaacgtacaaattggagattatgtaagaaaaggacaaatgatagccactattgccaatccgcagtttatacaattgcaggaagaatatttgagtactgccagcagaattacttttgcagaacaagaattatcaaggcaaaaagaacttttcgaaggcaatgcaggagcgaaaaaaaatctacaaagtgccacagccgaactcaatagtttacgtaccagaagagcttccttacaacaacagatacaattaatgggcatcaatccaggttctgtttcaaatggtaatctaaaatcggcattggttgtaaccagtcctttgaatggtacggttagcaacgtttttgccaagataggaagttatgcagatgtatcttcgcctgtgatagaaattgtagataacagttcattacatttggatttacaggtttttgaaaaggatttaccacaggtaaaagtggggcaaaccattcactttactataacaaacaacccatcaaccgaatatgatgctactgttattagtattggttcatcatttgaaaatgatagtaaaaccatagccgtacactgccgtgtaaatggcaataaaaagggtttaattgacggaatgaacatcactggtattgtcagtcttagcaatgtaacaactccagctgtacccaatgatgctattgtaaatgccgacggaaaatattatatttttgtgcaaaccgataaaaaagcagaagaacatcacgaagaaggcgaagaagaaggaagtcaaaaagagggcgaagaaaaaaaacataaaaacagtaagaattttgaaaaagtagaagtactgaaaggcgtgtctgatatgggttataccgcagtaacttttgtaaacgaaattcctgcaaatgcaaaaattgtaacaaaaggagcattctttgtaaatgcaaaattgagcaatactggtggtcacgaagactaa

SEQ ID NO: 120 - DNA, 336 bp, Chryseobacterium sp.
atgatttcaatgaaaataattaaatatatctcattaatcttaatattattaagtataagttgttgtgtaaataagaagcaaaaagatgaagagcagatcaaatcaacggttcaaaatttctggataacagttcaaaacaatgatgaaacaaactatttaaaattagttgatggcagtgaagaatatagatttgcaatgctaaatcgactacattatttgaatagaaattacagtaaaataaaaagaactatagaatctaagggggttcaaataaaagacacaaatgaattaggggaatctcaaaaatgtgtagaatatttatttatatatttataa

SEQ ID NO: 121 - DNA, 453 bp, Chryseobacterium sp.
atgaaaacaattaaatatatctcgttaatcttaatattattaagcataagttgctgtgtcaatcagaaaaaaaaagatgaagagcaaatcaaaaatacaataaaagaatattggaccgctatcaagaataatgatctagaaggatataaaaacctttttgatggaagtgaaaattttgctggagctatgcaagctgatctatattttctgcataaaaattataataaaataaacccaaatgatattctattaaaaaatatcaagatcaaagatactgttgtgatgtttgctgaaaataaacaaaagtatgttcagtatacaatcaaaaaagaaaatgatactaatctgattaagaaaccattaattataactttaatgttttttaagcctgtgggatacaataaaatatttaatcttgcgccattaaaaaatcatattggttgggttaaataa

SEQ ID NO: 122 - DNA, 186 bp, Chryseobacterium sp.
atgactccacaaacaagaaatgatgtgataaattatgtttttgatggaactttgcctaatcctggagcagggatgatgccaaattctttgattattcaaaatggaacccagattctaaggaataacaatttacctatacaacctctggatgaacaattaagcgctaacaaaaaagttttaccataa

SEQ ID NO: 123 - DNA, 633 bp, Chryseobacterium sp.
atggcgaggttcttcaatgtggatccacttagtgaaaaatacgcttatcagtcgcattataatttctcagagaacagagttgtagatggtagagaattagagggtcttgaatgggttggagtagttacgagagttatgcctttgtttgagaactcttctgtacgcccaaatccagttatcgaaacagttaataaaactactgaaacaacaggcaaagtaacaaacgaacatcatttgattccaaaacaatataagaatcacgaaattgtaaaacaggcaaaggaagaaggttataaatttgagggcaaagaaaataagctaactgttgagaagtttaacaaagctaccggggaaggtagacacgcaaaccatcctaagctcaatgaacaaataaagcaattacttgatgaaatccctaaatctgaggcattaaatggggttagaaatttgagagataaagcaaaagatgcaattaataacaatcctgatacaaaattgaatgatttaaaattgaaacaagctcctcctgttaaaaaggacaatataaacgttaataatcctcccgttcctgttataaagccagtatctaaacccaaagatccatgtgcaggaagaccaggaggctgtgcctaa

SEQ ID NO: 124 - DNA, 702 bp, Chryseobacterium sp.
atgcaagttaaagatcactatgaaaagcttggtaaaaaagctcttgaaattcaaaatgaatcactagctgatgaagatttactattactttcaactaatcatgcttttttacatgattttgcagaatggttagatattcttaaagatcgacctgaaataaatattctacaaaatgcgattaaggaatatcaaattggaattttcagcaattcccttggactttaccaacaagcttttatggggcttcgtttctttttagaacgaactttagttgctatacttttttctgccaatgaaatagagcttaatctttggaaaattggagaaagagatacttattggaacgagctattagataaagataaaggtatattttcacataaattttgtaaagcattttttccagaactaaaagatgaattgaatcactttaacgttattacatctaaagtttacagagaatgctccgaatatgttcatggaaacaaaacagtaattgataaaatacccaatagctttgaatattctaaagaactttttcatgaatggaattcaaaagctgatattattaggcgagtaattttatttactctttgtttaagatatttaaaacatttaaaacctgaagatgtcaaaaaaatagaaaatacaataaccgacgaatttaaaggaatcactcaaattatagaattaataaattaa

SEQ ID NO: 125 - DNA, 1611 bp, Chryseobacterium sp.
atgtcagatttactttttagaacagaagatatacctaatgacgaaatactaagtttatttgtagagacaagtcaggatagggatgtcattgaaaaactaaaatcaatttcaccaatcatattggttggaagtcgtggtgttgggaagtcatttttaatgaaagtgtctgaagaagaattaaataaaagttttaaaaatggtaaagttttgcctgtttatctaacatttaataaaagttctttaatacattctcaagacaaacaacaatttactaattggatgttatcattaatatgttctaagataattaggcaacttagaaaaaaagggctattagctaatttaccacattctattaatgttttaagtggtggcacatactctgaagacttattaaaaattgaagaagttgctaaaagttatgaagaatcatggaaaaacccgactgaggaaattgcaattacctcaataccaaccgttgatgattttaaagatgctgttcaagagatttgtgaagatttggggattaaaagaataaacctgctaatagacgaagctgcccacatatttagacctgagcagcaaagacaattttttactttgtttagagatttacgctctccttttatttcatgtaatgctgccgtttatcctggtgttacatcatatggtgatattttccaatattctcaagatgcaacttttattaacataaatagagatattctttcaaattcttatattgaaagaatgcgggaaatagttgaaaagcaggctaactctgatagcaaattattaaacgaaatttcccgcaaccgaaacaattttgaaattctcgcttatgcaggatcgggtaatccacggtttttattaaagacaatatcaagaacatctaatgtaagctcatcacaacttaatgaaactattagagaattctataaaatagaactattagcagagcatactaacttaagcgaaaaataccctggacaaaagggattgattgattggggtcgaaactttattgaaaatattgttcttttagaacttaataaaaagaataataattatttactcagtgataaacaaacctcttgttttatttggattcataaagatattccgcaaactgtaaaagaagctttaagattgttagaatatactggaattattcaagaacatggaaaaggaataaaatcatccacatcagaagttggaactaggtatctaataaatttgggttgtttgtttggccaagaagcaacaccatctagcacttcattatcaatagcacgtaatttaacacctaaaaaaatgaccgagtttggaatgaataatattaactttaaacctttagttgatgaaattcctaattttacggaaaatgacactactgaaatacttgaaaaagaacttagtaaatctattgatgttttagacttaacaagttggattaaagagacattgcgaacaattaatattaatactattaatgatattttaaatactactgaaacaaacttgaaaagagcacactatgttggcgacaaaagagcaaggcttgtaaagagtgctgcgactgcttcagtttatgaatatttaaatggataa

SEQ ID NO: 126 - DNA, 3423 bp, Chryseobacterium sp.
atgaaaaaaatatatatactaattttatttttattttggataaaaaatttttcccaaaataagccaattccatatacgccaaatgtacaatcacctgaagcttcgagtatagggaaatttgtagactatccagtgaatgtttctacaggaattccaaaaattgaagttcctctttatgaagttacaagtggggatttaagattaccaataaatctttcatatcatgctagtggcataaaggtaaatcaagaagaatccaatgttggcctgggctggactttaaatgcaggaggagccattatcagaaatgttaaagatgttcctgacgattacagtaatttaggttttttatttacaggaaatagcatccctctttttaatgatattgataactcttcggggccagttggcattactggaaataatgatcttttgaaaagttattatggatatcttaactacatgtcaaatcataaagatacttcttctgacatgtatacaattagtacaaatgtaggaatttcaggtgagttctacattgataataacttaaaatttgttagtgctgaatttgatccaataaatattgatgctaatttacaacttaataaaatagctatcaaaaataataaaggtgtgctttatcgatttggacaaagcttcacaaatgaggatgcatttgataaaattaatagttatagcgtttcaatagatgaaagtggtatggataatacactatactacttgccctatacttctgcatggtatttaacagaaataatttctgctgatcgttcagatacaattcaaattaaatataaaaaaaatggtaatttttcaacaatgtctttagttgaaaaacgtgcatatacaggtacggtgataggtgtccctgaagagcataaaaatacatttaataaaatggtctcaagttatagaattgataaaattattactaaagatggactagtgcaatttgattacgcatttgatagacaagattgggcaggtacagccaatgatccgagtaatcctcccagattaattggcttaaccataaaaacaaaaaatgaaaagattataaagaaaatagttctggataataatgattattttaatcgttttggatctagtttattgtatacgcagcacttagatcaaccaattcctgctcatcatttaaagagtttgaaattaaatggagttcaatttatggataaaaacaatactttaattgataaatatggatttgaatataatcaaactcaacttccgagtaaaaattcaggctcaattgatttttggggatattataatgggaaaaataataatacacttttaccaactacaaatctaacagtaggattcactccagactctttttcatatcaaaagagagacactgatattaacttcatgaaggctggcacacttactaaagttatctatccaacagggggctttactaattatgaatatgagcctaattatttcttgtcttcgaagcaagagcaagggcaacaacttttgaataaatcttacagtgtctacgctcttaaaagtaatgcaaagtgttcagaggatgtcaattcactagtgacacaacctcagattactaaggaatttaccataacagatactacaacaggacccattagttttaacgtttatttttccgattattatggaggtccaacacctcctaaagttattgttaaggtcgatggatggcagaagattttaactcatggtcctacaggatcaaatacatcacattcggagtctttctcatttccagttaactacggatcagtagtaagaatagaagcatatataaattcagctactgaaccatcaatgggatcaccttgtaaaagtcctttcattaatgtagaagctaagtaccaatattatggacaggtacttcccgaaacaattgttcccaagcaagcaggtggcttacgagttaaagctatttctagttatgataacaatagttcattagttttgaggaaaagctatgaatatggatcaaaaaaaataggagcaaataacattggaattggaaaaattttagctaacccatatgaacttgaaaactattattcgaattatcaattaaaacctgttcctggttcgaatggatgtgttacagaccatgtcgaaacaacctggttatttgctaatccgttagttgaaatgggtaccaataatggaaaccctgtttattatgatcaagtaaatgagtatattgaatcaataaatggtaacataaaaaatttaggaaaaacagaatacttttattcttctcaaggaattgatgttttaacatctgccgattactttagaagatataatactttgatttttccattttggaagaaaagtaatttaacgaaaaaagttgaatataaattagaaaacaaccaatataatccagtttattctgaggaatatatttacaatgatcttatagtaagcaaaattcgtacattaaatatttttgagaaagattctgagtattcgactgcaatatgcgatgccgggcatataataggttatcatggaaacaatccaaacaggtttgtttatttcaatgattatatctctgttggaagaagagtattagatactaaaataataaaacaatatttatataatagtaactctccacagcctataacaacgatagccaaatatgaatatagcaatccacaacattatcaactgacaaaggaaatacaaacttattcagataacaaaataaatgaaaccaatatttcttatagttatgaaaaaaacaaccaaaagctgatcaatgctaatatggtggctattcctttggaaaaaacaatagtaaaaaaacaaaatgcgggcgatccgggaaaaattatttcaaaaacagaaacaagatatgataattcttcaatgctgcttcctacttctgtattgtcatatgatcttttgaatccagatagctctacagcagaagttacttacgatcaatacgactccaaaggcaacctccagcaatacaccaccaaagatggcatttccactgtaatcatctggggatacaatcaaacccagcctattgctaaaatagaaaatgcaaaattagcagatatcgggcaatcttttatcacggctattgtcaatgcgtccaatacggatgcagtagcaggagctaacaacaatgaaacagacttattaaatgcctttaatacattcagaggacagctatcgggttataagattactacatacagttatgaccccctgattggagttagaagtatcactcctccgtcaggcatcagggaggtctatgtttatgatgctgccaacaggctcaaagaaatcagagaaaacaaccagaccggcaatttattaaaagaatttaaatacaactacaaacaataa

SEQ ID NO: 127 - DNA, 2844 bp, Chryseobacterium sp.
atgaagaagaattatttttatgcagtggttctggccttatggtgcggaactgctatgggacagcttaataactttcagggagtcaattttggggataaccgaaatccagttccttctttatcatctcttgcttccttcacggataatcccccatcaattgcggtgggaataccagaaatttcagtaccattattaagtctcccgggatatggaggctcgggaataagtctgcaattaagttatgatgctacaggaggccctcaagacgaccctataggtgaggtgggagcaggatggtttttgtctaaaggaggggttatttcaagacagatcaatgggataatggtagatgaactattccagagtcaaaataatcctaattatgaaaaaaatgtattcgatgacgaatactattacaacgttcctggtttatcgggaaagtttaagatagagagagatattcagcagaatacctttaagattattgatcttagcccattgaatcatgttaagatagcttacacaaaacaaaataatacggcaactttgatagttgattcatttaccattacagatgatcagggaaatatttactcgtttaatgattactctacagcagttgtatatgatagttattataatgaaaaagggctttggggtacagaatataaatcggctttttacttaacccggattacagatgctaacggagtggaattatctggattttcgtataaaaaagaaacaaaaactgataaaaatggggcattgctttataaaacatgtcagttggagaaaataaatacagctttcggaaatatagaaatggtgtacgattacgatgaaacactccaaaaaacgttaaacgatccattcagtattaaaaaaattgttttgaataacaaatacagtaagaactcagaatatgtatttgagtattcctatccgcttcctttaggtaccattgacagtaaaaagaagaggagacaacttgaaagagtaaaaaagatggatggacaaacacttgtcgaagaaacatcttttcaatataaccccttagattatacttactttcagggatcatcttgcggtggaggtgatttggtacatcccgccggtatacttaacaaaataactcatccggctaaaggagtgactgaatatgtttatgagacaggtgaagtctatcgtgacaggaattctacagcctatctggcgtctttggatggtgattttaatggtattttggatccatgtgctcaatatattaaagagtatccctacctagatatggataccaaccaatctttgacctataattttaccatatcaggagatgctgcaaagaaaaaagcattctggcttaccggagggattgattattatattgataaccctgaaattattgatccaagaaccggactacctattcctccgaagcctctgccaaaagatcaatggataacatataccttaaaaagagggacagaaatcatagctacgaatcaggactttataaaaactaaattttataattatccgggtcaatatactcttatccttaatgttccttctgttggtggtaaaggaggtgtttttgtttcagaactagtaactgtacccggaccttacaaaagcaggacctctgctggtagccataggctcagatccatgaaacgatatgcaggtgtgggaaatactgtacctgtccagtcggtttcttataattacgatcatttttcgatacctaatgcttcaagtggggagtttcaaataaataatgtaatgtacagaaatgttaaggttactgaagattcaggaaaaggttacacgaagtactattttaaacttcaaaaagactatccatcatattcctatacaaaggacggaaaaacgctttatttttggccttataataacatcgttaattcagggttggttgaaaaaaaagaaatctatagtgatagtaatcagctgctgactaaggatgaatataattatactttcaccgatatagatgataatgtctatgtgataggaaatgataaaggattttccaagccggcatttaccagccagaccaaaacgagttctgtagcatatccttccggtaccgcatcttctttcctgcaaagttcaggggaaaataatgtgagagcagataatttcaaaccttcgagttctaagagtacagctcctgacggaaccgtaaccgaaacgttctacaaatatgctcaggataaaaatcaaacccgattactggaagccaatatgacgggtgttttacttgaatcagaagtaaaagaaaacggaaaaacaatcgggaaatccgaaacacaattcgataacgggtcccatttatatccaagcgctgttattggctataacaggcaaacccaggctccggtgacaacttcgacccttgatgtgtacgacagtaaaggaaacctggtacaggccaccggaaaaaacggaattccaagtaccaccatctggggctataaccagactgttcctattgtcgtgattgcaggggcttcttatgctcagatcgcttctttatccagtgttaccgctgccatcaccgcatcagatgctgataataataacccggcgaacgaatcggcattgcttcaggcactggaaactttaagacaagatcctgctctgaaggactacagcattacgacttccacctatgatcctctgataggagtaaccaacactatatcggccaacggaatcagaacgaccaatgtgtatgatacggcaggaagattagttaaagtaaaggactctgaaggaaagatcctgcaggaaaatcaatataactacaaacactag

SEQ ID NO: 128 - DNA, 870 bp, Chryseobacterium sp.
atgaaaagattaaacttaatacttatccacatccatacccataatagtaaaaatatgacatacgaagaagatgataatatgttttcattgagtgagctatatcatgaaaattcaaaaatgcgtaatatagacagggaattttatgcttgggttaaccacgtaaatacttcccctcaaatcagaaaaatgatctcaaatcctaactataattacaatggttatgattctataaatttaaatgattatttctcttttagggatgaaggggatatattatgtgatataataaaaaatagaagaagcaacagaaagtttattgataaatcaatagatttgtacagcctatcaaaaattttgaattttgccaacggtgttacattacaaaccaatgaatccgatggttctacgtggaaattgaggtcaacaccctcacctggaggactttatcctattgagatatattgtataattaaaaatatagataatctcgaacctggaatatatctatattcaccaattattaataaccttattcaaatcgaaaagaataataaagatgtactattcgaaagattatgtaaggcaatgtctcccatgaaacaaacattaaaaaatagtcccgtaacttttctcctctgcgccaacatgccaagaattaattttaagtataaagagagagcttatcgatttgctttgcttgaagttggacatattgctcaaaatattcttattggtacaggtgcggaaaatttaggatctatttgcataggtggttacatagacaatgaactcaatacattaataaatgctgatggcgtaaataagattgtacattatgctgtttcgattggtcatatacaaaaggattaa

SEQ ID NO: 129 - DNA, 1314 bp, Chryseobacterium sp.
atgattaagaaaaataaactcttcgatctacacgacgccaacagcggtttgataaattatgtaagtgaaatagagaatgaattaaaccatcctgaaatttttgtagcagcagccacatcatgtgatctcaaaaaatatggacttccagtgtcttataaaattaacggttctggtgcaggcttgactctggactctgcaaggatatctgcaataggcgaaactttagaacgttattgtctcagtatcattaagtctgagaatttaattttgaattcaagcagggagttaagaaagaagtcaatattacacgtgaaacctgaaaaatggtcattattcagcaaagagcaagatattgaaccattcacaatatttgatgataatgctaaaattgtttggacacttgcggatagcctaacggaaaaagtaaccaaatacgttccagcatcattagtttatcttccatattattatcattttaaggatttaggagaacaaatgataagtccatcggtctcgactggagcagcttgtgcaactacgaaagaagaagccttactaaaaggaattgcagaacttattgagagagattcttttatgattatgtggagaggaaaaataccatgtaaaaaggttgaaatagatgaattttcttcaatatttgagatttttaataagaagtttattcgtcctggactagaatttaatctttatctaactcaatttgattttgagatgccctccttttttggtgttttggtagatcatcgaaaaggatttaaatctcgtgttgtaggtggagcggcacatccaaatccagaagtcgcagcactaaaaacacttcttgagcttgtacaaggtttggtatggaaggattacaaaggaaatgttgattttccaattatggataaatttcaaaatatagactcatttgagtcacgtatggagctttatgcatataatgatatgacagaagcctttacatttctacctgtaaaggaaaaaattaaacttagtgaaattccaatagcatataactatgatgcttgtaacctccgtgaaacacttggactactaatcaaagattttgataaaaagaattatgaaatccttgccgttgatatgaattcattagaagccgaatactgcgatgtacacatagtaaaagttcttatacctgctctagaagcaatggacggagaacataagtatcaatatctgggaggagatagatggaaaaatattccttttgatacaggttatattaatgagaatgaaaagattaaacttaatacttatccacatccatacccataa

SEQ ID NO: 130 - DNA, 978 bp, Chryseobacterium sp.
atgggaatatattattttaagccagttattaataataaaattagcgaggatttgactgatgaatcaaatttattgatccaagattttagattttacgcaaacggaaaaaatctattagatgatataatcgtattattactcaccaaaggacatcatatatctaatataacacgtttaattaatagattgcacgaaacaggtagtataaaggaatctaatgaaagtgaattaaattcatttcagagtcaagaacttgaaacaattatgccacaattgaaagcactaagtacttacagttatgacaaaaaaactttttatacacctttttccaactccgcagtaaaacatcagaatcgtataaaaaaaagtaatacacttcttttaggatgtgaagaatggatagaggaattgacttcaagactcaaaatgattggaattgagtcgatatatcgatatataacaaatttcgaaaatgataaagaatgggaaaatttaaatgatctagcaaaaaatctagaaccagacattattatttatataccaaagtttttttccaaggaagatgctttaagaattaatgaaatatgtataaccaatggaattaattttcttccttacgaattgaattttcctgatgttagaataggacctttctacattcataatgaaacatcttgctataactgttatttgttaaggaaagcaggttcaagaaatccatttgcacaatccgaaatcaatcaaaatcaatctgattttaaaaatttcatgttatttccaggatttgatttcattagtctggaaataatcaaattttattcaggttttcttgatgttatttctaaaaatagagtatggaattataaccttcatgaatgtaaaacacatactgagattgcttttaaattaccacgttgtcccctatgtggaacaaatcatataaaacctaaaacaaaactctgggaatactatgattaa

SEQ ID NO: 131 - DNA, 738 bp, Chryseobacterium sp.
atggcaaattacaaaactatcagtaatgctgaagctagaagaattactgaaacacagagtgaaaaaaatcctatttttaataagctgaaggaatatctggctgaaaaaaaattgggttttaattatgatagaaatatcggttttgttggggttaatcctaaccatcctgatgcttcttatactatgattgtaactcctacgtttacggaatttgattttaatacttctccatcacacgtagcagcaagtattattagctattatattggtaatagtgtaaatcatactgctgcaatagcaacaattaatcatgaccctcttgatattgctgatatagcattgcttgaagtgggtaaagaaggtagagtagttgagacaaatgttgatagaaaagcattagagagtgaagatgctgatcaaatcgcaaaacaaatgagtatcagtcattttgaaggagcaaatattaaaccgatggctgcaagtgttccatctgatgatcaacgtgctatggtcgcttatatattggacaatctcttaaatgataagtttgcatccccactttatccagaaggaggtgttcaaactctattaaaagaaacttcattaactcagaagtttaatagagcagttgaattacgggctagtctttttgaagttggattggaaatcaccgtgtgtacctcaacaagttcaaacgcttgtactagtacttcctcatcttttaccattgatatctaa

SEQ ID NO: 132 - DNA, 696 bp, Chryseobacterium sp.
atgataaattctatctcggaaagcaatgtccatgttaaaaatctacatatacagactgcagttattgcaaattcaacatttcatcgtttaggtatagttttaagtttaaaagaaactgaagtgtataaagaaactttagactttatgaattttactaactttgagaattacataagaaaaactgattacaaacccgacgttgtcattattgatatttacaagctgggcatgtgcatctataaaattataaaaactctaaaaaaatcttatgcagaaatacgaattcttattatgtcatcatgcacaaatacgctgggcataacaaaaatgttagagtacggagccgatggttatattacagaagattcttcaaaagaagacttaataatagctttggacgagttactagaaacaggcacatttttacctaacaatataaagaatgcggtactcctacattatcgcaatgcaattaagaaaaatatatttttaactgagcgtgatcttgagtttttatcttatagtacacatgaacttacacataaagaaatagcagaaagaatgtacgtaagtcctagaactatagacaaaattgttaaagatcttttctataagactggtcataatagtagaactggtcttgctttgttcgcagcctctataggcttgtttcaagaaaatgacatgaatatttaa

SEQ ID NO: 133 - DNA, 750 bp, Chryseobacterium sp.
atgaaaaatatactattaaaaattttattatgtatttcagctaattgtgctgctcagaacagcgatttttcaaatattgaaaacttcgtacctggtcaccgttctatttatctaaatgcagaaagttcaacagaaattaatcccggaagttcgggcgaaaatattacttgggattttagaaatcttgtatttaaagtaaaagatacagctgctcaacaaatcataaaaattgatgaaacctctcataaattagattacccaaaagcaacaatagcagaaaagaatagtgatgggtcttgggtattcattgaaagaacagaaaatgaaagtttagtatggggagttattacagcacaaggactagaaatgaaatatgtaactccatataaatttctaaaaaaacctatcaaatttggagaatcttttacaggcattgcaaaacgtgaatatgaagtccgcaacaccaaaatcactggtacaaacaattattctacattagtcgatggaactggacaccttgtgttgaaagataaaaaatatgagaatgttatccgcttaaaatttattcaagagttcaatgatggggttggtgacaatgcgacaaaagttcgaattgagagttatgtgtggtttgataatttacacaaagcagctgttttgaaaattgataatttaagtgttacaaataaatggtataataataaaagttacaatatttcttttcttttagatgaaaaaaacctaaattag

SEQ ID NO: 134 - DNA, 591 bp, Chryseobacterium sp.
atggaaaatgaacaattagatcctaagaaaagcttagatattattcagaatgctatatcgcaaacgagatttgaaaaaacagacgcctatttttatttaattaattggggaataatactgtttatatacttttttctgcattatttaggtggaaaatttgaattctttaaaatgctattaggattttcaacactcttatttcttataggtgctatgatctccatatggcatagtaaaagaatgaataaaaaagaaattgttaaacccgtcaatgatagtctatttatgtatacatggggaggaataggattgtgtataggcttatggatgataaattataaaatatttgaccaaagtctgtatttgggtttacttatgttattattcggtttagcctcatttatcaccggaggtgttacaaaatttcgtttatctgtgatatgtggtgttcttactatgattatttcagcagtaattcccttattaaatttttctaatcagtttctagcaacatgtatcggcataatgttatcctgtattattcctggttttgcaatgttttataaaataaagaaaaagaaatatgtttaa

SEQ ID NO: 135 - DNA, 792 bp, Chryseobacterium sp.
atgattaccaaagaagaatataaaaggctccttgatcatttttcccttgttggtaacccgaaagatatccactctcttattctcagagccatagaacaggaacagcaggatgaggccagtaatcctgtaggccttgagaaaacacttagccgtaccgacatccatatttataaaattactcgaagaaataatacccgcaaaacgttggtcaaaaggatatttccatatatatcagccgcagtacttcttatggtaggtatattttcctatgtcttttttatcagaaatccgaaagagttacaaaaaactacttccagcattgcaaaagatgacataataccggcaagacatacagctgtcctttcactgtcttctggtaaatcctacaacttatcagatcgtaaaaatggaattataaccgatgaaaaagcgatacattattcgggaggtgaaaaaattgccgatactaagaataacgaaactgtgcaggttactgttcccaggggaggacagtatagtctttatttacctgacggtgcaaaagtgattcttaattctgaatcgtccatttcttttcccgtaagcttcagctgttcaacacgagagattaatatgaagggagaggcttattttgaggtagctcataactccaggcgcccttttattgttaaaaccgtagagcagagtataaaagtttggggactaaatttaatctctattcctatagtcctgaagatgtcgtcacaacattatcgggatatactaacaagcttgactttaaatttgatttaa

SEQ ID NO: 136 - DNA, 183 bp, Chryseobacterium sp.
atgaaatcccatgatgctatcgatgaaaaggaactgctgcttaggcttcgggagggcgatggaattgcatttgaactcctctacgacaagtataaagagacattggcaagaaaactttttagaattttaaaatcctgggacaatacccaggaaattttacaggaagttttcgtcagtgtttag

SEQ ID NO: 137 - DNA, 1203 bp, Chryseobacterium sp.
atggggaaattttttactcagtcatcctatattcccgaagacgatcaggccagaatcactaaactggcaacatatggtgtgatggaaacacataataaccccgcatttgatacaattgcaggtattgcagcagatatttttggttcatcaggagccttcgtcaattttgttgattccgaaacagttttctttaaagctaatctaagctcatttcccagtaatcatgtagaaagacagcacagtctatgttcccttaccgttctatctgatgatattacgattatatatgatacccatctttatgatgatcttagagagaatccatatgtttgttgtgatggaggtatacgattctatgcaggagcacccatagtgaccgaggatggatatagaatcggtactgtctgtgttatagacagtgtaccaagaaaggaagtcaccgatttacagtgctctatccttaaaaaactggtgtctttggcgctggataaattagagtctatgaaagcaaaacgtatgttagctaaagtggctgatgaccgctttcaccatgttgctcatgatttatttaatccactaacagttattactctttcggctcaacagatccagaggcaaacgccgaaaaccgaatcgagatataaatttgcttcaaccatttttgagaaagcaaaatcgatagaatataatatcagcaacatgcttaaagatgatctttcagaggggaaatatatgcatctctcgatcgtttcctttgaaacgggtgacatcatcaattgtttaagcaaaaatttcagccatattctaaaaaataaagaacaacatctggacgttttcagcactggcaatttgaacattacgggagacaaacagcgtatcatcgatattttgggcaattttctcagcaatgcatctaaatattcatcagcaggttcaaaaatcacccttaaatgtgaggaacagccacatacggtggtttttagtgtgacagatcagggccaggggatttgcccctctgaaattggcttactttttaaaaaattctcctgtctatcatcaagacctaccgcaaatgaaaggtctcatggtcttggtctttattctgcaaaaatacttgccgatctgcatcatggaaaggtatgggccaaaagtgccggaaaggatttaggaagttctttcttcctagagctccctaaagattaa

SEQ ID NO: 138 - DNA, 1113 bp, Chryseobacterium sp.
atgaggccattaacaatattgttactgagtgggattatgctatcgtgcagcgaccgatttcaatccaaaatcataggagaagtcacaggaattcctgctgataaagtataccttatcgatgcatatgactcgaaaaaacgagtggattccacagattataaaaatggaaaatttgagttcataattgaagataacaaggaaccttttttagcgagtatcgcatatatgaccaaagaaaatgaaatgatgaaattggcatataggaataataagctcagcataaatgggaaaagaaacggggtggcagcatttatgaccgacgatggaaccattacgatcaagggcgactggacaggcgtgacatcaattttcgataccaagcatcttgaaatcaatgcaggaccacaaaatgattatttccagaagtatatacacagcaatatcggtgcgataaaaaacagcagcgcagaaatacacagaatcatgtttggtcgcattaaggaaagggttttggagaatccatcctctttttttctattgggtgaaatagaaaaaaataaaagtttctaccatagatccgaattgaaagaacttataagtcactttgatcagagggtacagtcttcttcccaggcaaagattttgcagaagtatgcgagctacatgaaggaaggagacgaaacaactgatccattaagcctaaaaggacccaacagcgtagtaaaagcaaatattaatcgaaataaaaaattgaatatgcttgttttttgggccagctggtgtattccctgccgctcggaaattcctcagataagaaaaataaagaaagaatttaaatctcctgatttttatattgccagtatctctattgacagaaaaaaagaagactggctgaacgccttaaaagttgaaaaaatggattgggatcagtttatcatcaatagagatgatgatcttaaattaaatgcacagtatgattattctgccataccacttgttgtttttactgatcagaacctaaaaatattgaaacgttccaccggagcgtcaagcgacgctgtggaggaattcggcagttttattaaatcattattggtaaaaagtacccaataa

SEQ ID NO: 139 - DNA, 279 bp, Chryseobacterium sp.
atgaaaaagatcgattacggaatcaataatgtgctgagatcattatcccgaaagcaattgaaatgtattacagggggcgatattcctggaaccaagccggaatgttacgacactcaaccatgtatactggtctataccgatcaatataacatttctacaacttttcagggaagatgtgatacaggaccgaatggatgttactgtagatttgataaaccagtgcccttacctctaacctcaaacggaggggtaagccgatgtactaaacctcccatgtaa

SEQ ID NO: 140 - DNA, 174 bp, Chryseobacterium sp.
atggcaacaaatccaccaaatggtgacggacatagaaatggcgccgttagaagcagaagccaaacatataatccaaagactgaaacttgggtaaaaagagattcagaaacagggagatttatggacgtcaaaaaggatggaacaccattcaaaggtgttcgtaaagaaaattaa

SEQ ID NO: 141 - DNA, 327 bp, Chryseobacterium sp.
atggcaaaatacattattcgaaaagcgttaaacggacaatattggtgggtattaaaagcaccaaatggagaaactctattaacaagtgaaacctatacaacaaagcaaaactgccatagtggaatagtcagtagtaaagcgagtcttgcagattctaactttcgaagattattatccattaggaatgagccctatttcacgcaaaactcaaataattaccaagtattgggaacaagtgaaatgtattcatcgacgtatgcgcgggatagtggtatagtaagtgtaaaaagatatgcacagaatgcaataatagaggatttaacttaa

SEQ ID NO: 142 - DNA, 219 bp, Chryseobacterium sp.
atgaaaaaaaaacatttacttttgcaaaacgaaacttattcagtattggaatgccaaagggttaccaaccccgataagctacacactgcttttcacattccggttaaattatcggtcttaaaagctccaacttttaagactttttattttcttttttttggtaattattatccatttaatcttagtctaacttcctctctaatttttacgttgctatga

SEQ ID NO: 143 - DNA, 459 bp, Chryseobacterium sp.
atgaaagcttattttttcttgattcctttgattttattatcatgcaatcaaagttataaaagcccaaacggatataatgttattgaactttatgaatataacggacagccatggaatgctgacgcaagcaataataagttatatagggattacagatctgacggtattctgtattttaaaatggcaaaattaaattatagtttaaaaagatcgattattgccaattcgacgattgattctattttttttagaactagttatcaaaaatatcggccgagaccacaatgtcctattggttttaatcgaattttattactaaagagtcattcaactataaaatatgtaattaaatttaatgattattgtgaagagtgctttgtgataaactatcagacaaataatattaattacttaaaaataggatatgatgacttcgctgaaattttaaagtcaaaatag

SEQ ID NO: 144 - DNA, 1314 bp, Chryseobacterium sp.
atgagctatcgctatatccttattttaagtaataaaatgattaacaaaataaacaattgtaaaaacagagctattgtaagctcatttaataatattgaagaagtagtaaatttcattaaatctccacctcaagaacatattcaatatgtagaaaatgctagaaacctggaaagaaaatctaaagaatacaactacattaagatcaacaaattacctgcaataacaattaattttaatttctcaaataattatatatcaggaaaaaatgttttgaatcctacaggatatctttatctcgatgttgatggaatgaccgaacaagattttgagattaatacaacctatatatgtgcatactggagaagtttatctaacacaggaatgacattagttgtgaaagtagatggattaactctaaataactttaaggaagctaccaaaaagatagctagattattagatataccttatgatgagaaagcagtatcaattgataggttgaccgttcttccttatgacagacatgcatacttcaatagtagcacagaaattattccagtatttcaattgttatcatccgatttgacagtttctgatgaaaatgaagttacaaaaaatacccactacaatagtattaacaataataatattaaaaaactgtctaaatacgattgtaatgggtataaaattagatttgacaatttggatgaactcatagaatctaaaaatatagaatatgacgaaaatggtttttatgattttggaaaggatagtaaattgagatatgctaaagtttttgttccttttacagctatagagtcagataaaagatactatatattagaaaaaataactcttcaattagtagctttaaataaaaaagtatctaaaaaaaatatttacagttgtattaataaaattaacaacaatagaatgactcctcctgttgaaaataattttgtagaagatcttttaaataagatatataaaaacataaaagagattgaacctaattttaatgaagaaagaagatttatttatgataaaacaaaggatcttactacaaaggaaaaaagaatcctaaatatgaaacaactcggaaaggataagtctaataaatctgtagctgaattattcaaagtaatgaaggaatggaattatagtatacatggcaaaattaccatcaaaagtctgtcaaaaatagcttcaaaaaacagaaagactgtccagaaatattataaagagttaaaggctaaattaatcccaattatggatccaaagattaaaaaacaagaaaacatcttagaaatataa

SEQ ID NO: 145 - DNA, 3855 bp, Chryseobacterium sp.
atgagtatacaattatctggaccaaaaggttatgaatatcaataccgagttacagtattaaatgcattatttctgagaaataattctacaaagatgtatgtagaaaaaataggaagtgaagatgctttaatagaaattgaaaatgaagattctactaagcagtttattgaaatacaagttaaaagagaggagggaattttaggaatacctcaattaataaagtggctgtgtcattttgaggaacgtacaagtaataataatctattacagaagcttatagataatgaaaatactaaagttatatttgtaactcgttcaagatgtagtgattctattgtatctttaaaaaaagactataacaaaataaatgattccgctgctgttcttacttctaaagaattatcaagtttttttttgaaggaacttaaaaaaataaaaataggagatactgaccttaataaaaaaagagagcaattttgttataaccaagcattgaagcttaaccataaaatggttaaagatttattggaaaaatgtataattgtagaagaattcactgatgaaaaggtagacacggcagttttacaatatttaaatagcaaatgtcaaattgcgcaatcaaaaactgaagaaatttatctgaaattgatacaggttgtattaggtggaagagatgaaggatttgatattagtaaaaggattaaagaacttttagaattaaataagataggaaatccatttgttgatccattatataaaacccgaaatgaagagaaaagtttattactaaaacttgaaaaagatcatgtcttattattgacaggtacttcattgtgtggtaagactgagttggcaaaaaaaatatctgagagttttgtcttgaagggctataattattttattcacgatgaaatttataatatcaaaaaatttctacaaaccaatattttagataacaaaatagtaattctatcagacccttttggtcatgttgaactcaaagataaatttacggaaatattaaaaagtattaaggagttattagatattaaagaaaagcatcatttattaataataacaagtcgtatagaacttttgtttgatgtgtataataccaaaacgatagaagaatgttcaattggaaaaatgcagtggtttgatttgactcttcatgatatagaaactttgcttcctttttgggagtttatatcaaaggagaattcattgacaaaaaatatttttgaaacagttgaaaaaggcataatagaatcacaaaatgaaagccagcttcaaattggacagcttagatatttagcaagtgaggatatagaaaaattagagggtaaaaattttagtgaactagtacatattgctaaaagtaattctagagagattgccaatcaactggaaacatcaaatttatcttcagcacaattgttatcaatactatctgtatcatcctcttcagtttatggagttgatttcaaagatttagcatatatctattcttcagatactgaattgccttcaagcttaggagaagatgtatatattcactccctagacgaaaacgaatctgattttccttcttattctgagaattttactccaagtatacaacttaaaaaagatttaggttatctagaaaaaagaaatttaatttcaataaaaaaacaaatagttatcacaacccactcaaattttttaagtgcaggactaaatctttttctcgataaaagcactatttatcttgaagagaaattagacctatacaaaaaaagtattttctgccttaatgaacaaacagcctttattgcttcaagaaatttattctttatctataatcagattaatcctgaatttagatcgcaagtaatagaattaggatttaaagctttaaattctatttttccagcagttgaagataattcccttttatttttaacaaaaataattggagatttaaatatagaacaacaagaaaaaataatctttaaaatacaaaaaggaggaactgattattatgatattgaatggtataacaatcaaataccatttaaaacgaatggtggagcaggcatgaaaaacttgtccttaagcttggataaaagcaaagtgtctgaagtcgaaaataaattgaaacaaaaagaatttccgtcaagctatgaaatttgggggtatattaaaacacaaaaaggaaagaatactattgataaagaaatttttgtaatacttctgcaagtaaaagaggcttttataaggtctgaaattatatacgaaatttttagaaaccaaaatattttagatgaaaaatttatagagttcctttttaaagatgagcatcctacagttatatttaatttaataagtgctgtaatacaaaattggtttaatttttcagaagaattgaaagttatatgtaatagcctaatcgttaaatctttaaatcgaactgatgtggctattagagcttatgaagttatagcaacattttcaattgattacgggagtgaatcaattattaaatggaaaaaatttaatcaaaaacaaattgtagaattatggaatttgtggggtgttatttatccgcaaattataaataatattcccttaaaaatttatttaaatggggctaggtttagctcaaccatgtctacagctactaaatatatagatatcaaaataggtatggaggttttgaatgcttggtataaaagaatagattttcaaatttcaaaaaataaaattattgacgaatatgaaatgtctataatggaagatttgttagcattaactaaaaataattcagaaattagaaagaatcttttttcaaatttaattaattattatgatactagtttcttattatctaatttaaaatgggtattaaataattgggaatatatagttcaattagaaaaagaacaaatttttacaatattagacggtaatagaatggatctacgttggattaaggctgttatattaactacagaaaatccaccaaaagagttaactgaaaaaattttagggaatattgatttatttaatgaagacgtaacagtttttctatcaaatgtaaacgatagtctgttatgtgactgtttaaatgttttctgcggatttccacaacctttatggtggttagccttacatcataaaaatcgtaatttctggtttgaaattatgtataaaattctcctaaatgaaaataatgtaggtttcaaaatttgtttagaaaattttataggtaatggagttattggatttactcaagaatggaaagaatgggaaactttatgggatattatttgtaataattcttctgaaaaagaatatctatttgaaagacttttatacaatacagcaaatgctacttgcaacttggcatcggctaaaaagatgtggacaaaattaattgaaacctttgactctcacaatcaatcaaatataattgattgtttaattttggagaaccttgagatcttacagcaaactgggcatggaaacgaagatgtatttaaaatttttgaagaacaatttttgtttaaaagaattattccgaaaatctccccagataatgtcattcgtcaaattattgatttaattcaaagagatcagtataacgatatggcattcaacttttttgaaaaaattaccgaagagcataatacgagatttttgggaacactcacatatgcaaagaatgttttagatcttcagaaagaagaaaatcaaaaagtcatagaaactataaaaaaaatgaataacaagatatatgattcaggaagaatacaaatgaaacaaatgaatatttttaattataaattagataattggataggaattaattga

SEQ ID NO: 146 - DNA, 1914 bp, Chryseobacterium sp.
atgaaaaaacatgattttgtacaaggttctttatttgaagaagattttttattgagaacactaggcaatttaggatctcaacctgacattgctttaactgaactagttgcaaatgcgtgggatgcaggagcaactgaagtcgatattttcttgccagatgagtatgggcagccactaatcataaaagataatggtactggattaactgctgatgaattcaaagctcgttggatgaaacttgggtacaacagattgaaaaatcaaggaaaaaaagttgaatttgcaaagggtatagatctaaaaaggattgcatatggtcgaaacggtgttggaagacatggattactatgttttaatgatgaatataaaataatcactaataaagatggcaaggaatcgacatttactattactacaaaagatgatacagagccatttataataaaaaaggaacaatttgcaaaatcaagctatcctgggacaaaattggaagtaattgtaaaaaaaaatattcccaaatcttctgaaataaatgatattatttccgctagatttttacatgatcctaattttaaaatttctataaataaaaaaataattaatttagaaaatcattcgggcgtagttaaaacaattccaattgaaatagagaaatgtagtttcattataagtttgatagatactaaaaaatcaagaaaaaacacgctttatcaaggtgtggcaatttggcaatcaggtagattaattggtgaaccgtcatgggcgttgggaacaaatattattttagatgggagaacgcaggaagcaaaaaagtattctgtcattattcaaacaaatgatctcgaaagttatattagagaagattggtctggcttcaaaaaaagtagagacttagattttatttttgaaaaactgtcggaagaaataggaattatttttaacgaaattgcaatagaaaatgttgaagaaacaaagaaaattgttaagcaaaactataataaagattatgcatctcttacaccattggcaaaatatgaatttaatgaagcattagatcatattactaaaacaaacccaactgctaagcaagaatcaattaatcttgcaatggaaacattgattaatttagagaatacaaggaatggttctgaattgcttcaaaagatctctacacttacaagcgaagatataaatggtttgaataagcttctggataattggtcaataaaagatgctttaattgttttagatgaaattgataaaagaatttctgttatagaatccataagaaaattatcatccgacaagacagttgatgagcttcatgttttacatccactaattgctagtgcgagatggatatttggtcctgaatacgactctccagaatattcctacaataatcaattacatactacagtacagaaagtttttggaaagaaaatcgataaggataatttcaacaataacaaaaaaagaccagatatcgttgtaatgggagattccaccttttcaataaattgtattaatgattatgatactgaaacaagtatttcaaatatcaaaaaagttttaattatagaattaaaaagaggaggctataaactcggcagagaagaaaaaaatcaagcggtaggttacgtagaagattttatgaactgtggaactctacttggaaatccttacataaatgcatttttagttggcgaatcattttcagaaaagatacaacctaatcataccgtttcaaactctaataatgttgaaatgggtaaagttcaaatttgtttattttctcaaattgtagactcttctgaaaaaagattatttaaccttagagataaactttctgaacgatactcagagtttacagaacaagatatattaagtactcagaaaaaaattgtaatctaa

SEQ ID NO: 147 - DNA, 294 bp, Chryseobacterium sp.
atgaattacacattagaagaattaaagaagcaattaatatcgcttaattacgaaaaagaaaatgaaattgagatgctggataaagtaagtttagataactatcttgataaacaattagatgaaattaattatttgattgctataaatattgataatatgagtgatcccaaaattaaaaatatttttgaccttgtaaaatctaaagaaactacaatcgtatcaggtgaacttttagatttaatttttaaaaataatcttctctatagaattaaatacgaattaagtaaaatttaa

SEQ ID NO: 148 - DNA, 345 bp, Chryseobacterium sp.
atgaagcacccttattctagtatagatgaaattaataaatttcttagcgaacaaaacttagaagagcatgaaatttttaacgctgatatatcaataaatacatatttaaatagtatagatattaaaacgaaggtcataatatcttttgcagatacatttaattgggttgtagtaacttttattgaaagtacacttaatacagatttgtatccaactgtgtttaaggcaaaatttgatgaaatggtatatgaaaatgacaaataccttcttataaaaggttgtcactcaaataatagaaaaattggaaattataaaataattataactccaaatcgaaaaaattaa

SEQ ID NO: 149 - DNA, 2157 bp, Chryseobacterium sp.
atgaatataaaaaaactttttattaaaaactttagaatactttctgattttcaaattgacttagaagatgaaatttcgttggttataggaaaaaataactcaggtaaaacttctattcttacagttctggataaatttttaaatcaaagtgataagaataatttttcaattgaagactttaatttgtcctttaaacaacaattgcaaattcttattgaagatactacagagctttctgaagaagagtatctgaaatgctacaatggtatttcattaagaatattagtattgtataataatactgatagtttcatcaatattcaaaaattaatgttagaccttgatcccgaaaataaccatattgtattaggatttgattattatttaagttataaaaattatttaggaatcaggaaagatttagcacaatatagacatcgtgaaaatgttaaaaaagctgaggcagaagcctgtgagccacctaaaaaatataatgtaaaaggattttcggaatttttcaaattacattatcaaaaatattttgaaactaggaaaaaatcaattttctatgacaagacttcacaaaaaataattgaggataactatatattaattgaagacttgaaaatatctgatttcattagttttaaatacatttcagctagaagagatgttactaacaaagaaacagataagacattatcattacaaacttcaaagatatacgaaagaaaagaaaatgatgaaaatgaagctaagaaaatagatgattttcatgatactataattaatactgatgaagaattatcaaaaatttacaaagttttttttgaagacataattgaaaaaataaaaagtctaggtggaatacgtgaaaatgaatcagtattaagcgtactttccacattacagtctagagaacttttaaaaggtaatacaactgtttactataaacatgaactgtcggatttaccagaacactataatggtttgggatacctaaatcttataagcatgatctttgaaattgaaataaaaaaatatgagtttcaaaggtctttattagaagctcccgcagatattaatttattgtttatagaagaacctgaagcacatactcacccacaaatgcaatatgtttttataaaaaatattagaacaatcgtgggagataaaatatcaaaaacaattaaaaatgttgataatacagaatttgagatttgccgtagtttacagacaataatttctacacattcttctcatattgttgcagatagtgattttgatgaaattaaatatttaaaaaagacagatactataacttctaaaaatttaaaggatttaaaaaatctatatgatgaaacgggaaagcaatatcaatttcttaaacaatatcttactataagtagggcagaaattttttttgctgacaaggctattttaatagagggagatacggagcgtatacttctaccaacaataatgaagaaaatagatattcagttatctcactctgataaagaagagaaaaaaatcccattactatctcaaaatatttcaattatcgaggttggagcttattctgaaatatttgaactttgtatagattttataggcgttaaaacacttattgttactgacttagatagcactcgtaaagttaaaaaactaaataaaaatgataaagaaatcacaaaaggtgaagcctgtcgtgtcgcaattggagataattatgcaaatccagcacttaaatttttcttaaataacaaaactcttgaagaattaaaatctctcacattaaaagataaatgtttgattaaaacagatgataaatggattccaaatgaaaatggaactgtatgtattacttatcaaactgattatgatggatataccgcaagaagctttgaagattcttttttagctataccacaaaataagaatttagttattagtaaaatagatagctttaaaggaattaaaaatcctagacattttaataatgaaaataaagattcttatgatttagcaaatgaatgtattaataagaaaccccattttgccttagacatcttatatcatagtaatgatgattattctaattgggaaattcctgaatatataaaagaaggtttgttatggttgaaagagaattaa

SEQ ID NO: 150 - DNA, 1950 bp, Chryseobacterium sp.
atggttgaaagagaattaaaaagtgaaatagatcagatttttgatcatatagaaaaaggggataattttttattaagtggtggagctggaagtggaaaaacatatacattagtacagtgtataattggaataattgataagtttccaaatcataagattgcctgtattacatatacaaattctgctgttaaagaaattgaagagcgtatagatcataaaaatttacaggttttaaccattcatgatttcttatgggattgtataaaaaattttcaaaacgaattaaaacatgcaatagttaccctagctaataatcccttgcagaaaaaaataaatatagagagccctagtgtagaaatgttttccgaaggtattagatatatggaaaatctaaatttatctaaaggaataatttcacataatgaattattagtaattgctgaatatttatttgaaaactatgaaaaattatgtgatataatcaaagacaaatttaattttatattgattgatgaatatcaggatactagcgaattagtgataaggatttttctagatcatttcagaaagggttcaaaaaagaatataataggttttttcggagatgcaatgcaatctatttatgaagatggtatcggagatttaaataagtataaagaaaatgcgggtggtttggttcaagaagttaagaaactagaaaacagaagaagtccacttaatgttattaatttagctaataaagtaagaagtgatggtctagagcaattaccgcaattggaaaaaacaaaccctattcccccgaatatgaatgaagatggtacaattaaggaaggagaaattagatttttatattctgcggaaaataatttggataaagttagaaaatatttagaatgggattttaatgagagggataaagacggaaatttaaagtgtaaagagttaaatcttactcataatcttatagcaaaagaatctcaatttggatccttaatggatatttataacaatgaccaaatattagaatataaatatcttgttgatgttttcttaaaaaataatttacaaattcaaattgatgaaaatgatacttttggagatgcaataaaaaaatctggacaagttcctaatggtggtaaaatgtctgacttcattaatgcaaatattgatctatttaacgaagctaaatcatataagtttaatttgtttagaaaaatttacttaaatagtgatattcttacggacgataaaaaacaaaatgaaaaagacttaatcaagaaaggaacaaaaagagataacttattaaaacatttatttaaaatccaaaattgtataaggctatacaatgaaaagagatataatgaatttttgaaaattacagattataagattaattcaattgaagacaagaaaatattacaagatcatatagaagctctttcaaaaactgatgaaaaaacgattggtgatgtaattgaaaaagcagatgaatataaattggtttatgctgacgataaactctatgagtttatacaaaataagcgatatgtttataatagaatttctaaggttaaatattctgaatttattaatttatataattatttagaagggtttactccgttctcaacccaacataaaacaaaaggaagagaatttgaaaaagtccttgttatattagatagaggaggttggaataattataattttgaatatgtttttgatgatggtacagtgtataaatctttagttgaaggaaaatcaaaaacaaaatcaaaattgtcaagttatcctaaaataaaagaaagaacggaaaaaatattttatgtatgctgtactcgttctaaagaaaaactagctgttttctatcataatccgcaaccatctgttataaacactgcaatagcttggtttggtgaagaaaataccataaatattgatgacttctaa

SEQ ID NO: 151 - DNA, 330 bp, Chryseobacterium sp.
atggcaattcataaagtaaaacaatacaggtattattttacaaaaccccacagtccagtttcggagaatgaatatgtgcaattaaaaagaacccttccaccaattcccgaaaatccttctacagcaattttaaaaaagtactggtggtgtattctacttattccagcttttcccatattatttatattggctctcacaggattggtggacgaaataattagttatagtgactatataaaggacaagaatagatttgttcaaaggtattttcatttaattcatacttctaaaaattatacagagtttgttgagggttataaaaaaatataa

SEQ ID NO: 152 - DNA, 999 bp, Chryseobacterium sp.
atggcaagaaaaaagcaacgagtgctacagcatataatggaagacgaatcctatcaaattattaaagctcttattccaaaggagaatgttattagagaatttaacagacctgattatggaattgatttagtaattgagctttttgataaaatagaagaaaatgcatatgagacacttggtgaatttatttttgtacaggtaaaatcaataaaaagagcagaaattaaacgagaaaaaatttttcctgttggtaacgtggcaaaaggaaaatggaatgaagataaatcagaatatattgagcttgatgtcataaaatatagtatggataccaattctatctatacaattcaaactttaggagggagcgtatctgtattactatttttagttgatatttttaatcaggatacttactttgtatgccttaatgattatattgataaaattattcttcctcgaaatcccaattatggtgaacaagaatattacacaataaaaatacccatattaaataatttgaaggataaacttgttagcaataatgcatttaagttttatggtaaacgagcaaaactcctttcagcattttctaaattttcttaccaaaaaaatgagatttctcatttattaaaaattaaagattttccagtaataacaatgagagatgaattagaaaaaaataaagaaatttcagatattgaactttaccaacaagctctattttttatagatcagattgataaattagatatttggaatcataatgaatgggaaatcttacctataatgaaaaataatttggatgaattaaggatgtttttggaaaaggatatattcgatgcgaaagaggctagagaaaaaatacttgttatgtggcatcaattatcgaatttaggaagaatatatgaagatttatctagagaatggtatttacccaaatttataagtttattatcatcatatcccgaagaacctaatattaaaaaaagcaaaaaataa

SEQ ID NO: 153 - DNA, 1869 bp, Chryseobacterium sp.
atgacacatctagatggtattatcaaattctatttgcgaaatgaaactaataattcattgttaataacgggagattggggagttggtaaaacgtattattacaaaaatattttagaaaaagaaattgagacttttcccacttattttgataataaaaaaaaatataaatctatagttgtatcattgtttggcatttcatcaattgacgaaatacaatcacaaatacttctctcgttatatcctattttaggaaataaaaaagtcaagataagtgctgcaattgctaaaatattcattaaaggaatattgaaatttaaaaatatagatcaatattatgacattgtttcagaggtaggtattgataaaaaagaccttattaattttaatggtttagttatttgttttgacgacttggaaagaatggatccagacttcaatattgaaattttaattggatttataaattctctaacggagggcaacaatgctaaaattataattattgctaatagcagtaaattagaaaaagcaacgtttaataaattgaaagaaaaagttattggaaatacaattcaatttaatcctgatatccagagtgtttataataacattattgaaataaaattcagtggcgacaaactatatagagattttttgaagatagaaaaacaattctttttggaggtatttgaagcaaattctaataatctcagaaccctcaattttatcctactttatttcaaacaaattttttatataatagaattactttctagtcaacataaatttttgggacagcataaaaatagtatattaaaaaaggctctcagatttatcattagtatttcgattgagaatagaaatggtgatttatccaatgataataaacaagatgttagtgattcaaaaaatagtttaactgcaattgctataaggaaattacgtctaaaaagatctatacaaaatagtaataacaaagcgcaagaagataaacaaacatatacagaaatttttcttgaaaaatattataaagacacagaatatcatttttttgaatctatttacaattttattattggagagaaaatttttgaaggagatgatttcttggaggatttaaaaacaatatataatattgaagatgaaaaaatccccgaacattatttaattttcaataagttaagcccctctaatatttttgatttaagcgataaagaatacagactgttgacgaagcaattactaacctatacagatcagggaatgtataaacttggcgattattcaactatcttttattatttagtgagattcaataatcccctaaaatttaaatctttagaaaacttagaaaagagaattataagaggtatgcagaaaggtactgatcattatatatttcatgttaatcttgacatgtatctcaaagtagacaaaaattcagaattctttaagaactttgaatcaattaaaaatgcttgccttgaaataaatgaaaaattgagattaaaaaatattcttcttgaaactgagattcttgaaaatctatatcatactaattttgaacttttcgacaataaacttactaataaagatagtgcttggtcatcatcttctatccttaaccattttaatgttcaaaagttttatagtttctttattaatgccagtaatttgacaaaatgggaaattattaaactcattcaatacagacattcagcaaattcctttggaaattttgttgaagaaattttatttttaaaccaattacaaataaagattgaaaaaaaaataaaaaatatttctaaaaatgggttagattatttcgtttatactgaatttaataatttacttttaagcttaacgtaa

SEQ ID NO: 154 - DNA, 1014 bp, Chryseobacterium sp.
atggatcttctgggaaatgtacgtttaaattatatgaacagcggatccggactagagatcattgaggaaagtaattattatccgtttgggttgaagcatgaagggtataatacttcggttggaaatgctgcgtatcagtataagtacaacggtaaggagcttcaggagaccggaatgtatgattatggtgcgagaatgtatatgcctgacttaggaagatggggagtggtggatccactagcggaaacttccagacgttggagtccttatacttacgcttttaataatcctttgaggtttattgacccagatggaatgcaggcagaagataagattaagatctttaacaatggtaacatagaaagaacaaaagacaataatgcctatgatactattaccaacgaagatgagtctaagtctatccagattgcccgtacaaatgtgacaaaagataatccaacaggtgattcacagatagggaatatgaaatcattagcttttgatttgccagaaagtgatgggatggaaggtagcgcaagttcaacatacagctatttgcaaatacagaactatgatgtagcaactcagttctttgaatttgcagcagaaaacacaaaagtggaattttctcaagatacatttaattttagtgatggatacagtacaagcattataagtactaaccattctgttaatcaaagtgtaaatgcaggtgctatgttgggagcatatagttttggaggacatattatacaagatggaacccattttgaaaatgtacactcccatccgcccggtgcaaacgtgggtccatcgggttggaatgataggtttataaataatgttccaataatgacttatggtttaaagcaaggagatgcaaactttagaagtaataaccctcaaattacaaatacgtatcaatatggtacttggaaatggccaacgccagggaaagggtattttaaatatgactcaaaaaatgcaacatttattggaggtaaaaagaattaa

SEQ ID NO: 155 - DNA, 1116 bp, Chryseobacterium sp.
atgaagtacaaattattaatggttgttttgtttagtactcttttttcttgccaaacaattgattttacctactcgttaccagatagtcgtgtgatcaatgagtatacgcagccatatccttttcaaaaagtaaatttgagtaattgggacaaattagagaggattcttcctctcaattataaaaatataaataaagattacacaaaggagatacaaaccttttttaactcacataaaaatgtaattcttcctgactatcctatatttataagtaacgctctggttataacatccaatacaaatgtttttttttcaaagaactctaagattatttataccggagaagtaaaaggcagacactatgatatcataaaaatcgaaaatgtagaaaatgtaaacttatataaccccaatataattggtaacagaaatgctaaattactacataagggagaatggaatgctggaatatcaatacaaaattcaaggaaaattaggatttacaatcctatggtaaaaaacacatggggtgatgggatttttataggttcagaaacagcaagttttagtgaagatgtgataatagagggtggctggatagataatgtaaggagaaatggtatatcaataacttctgctaaagatgtttttattaagaatattcttatttctaatgtaaatggtacaaacccgcagtgtgggattgatgtagaaccgagcttaccagaagattttataaaaaatgttaatttaaataaagtatatacatttaataatgctttgtctggtatagcaataaatatgaatgccttaaatcagaagtcaaaggataaagttaaaaatgtttcaataaatattaataatcataccgataataggtcttcatatgctctgctaacatctttaaatacagagaatagtatttttgatcctagtggcgttattaatatatctaatacgacatggatcaataataaaaatgatagttattggaaatcggaaactaagcaagcaataaaacttaattttaagaatattaagattgatagtcaattaaaaagcaaatccttttttaatacagtaaataattctgagaatcttttatataaaaattag

SEQ ID NO: 156 - DNA, 171 bp, Chryseobacterium sp.
atgttgaaaccctacacaattcgggaatttattttaagtattctcccctgggcattaatttttatgattaataaatttatttgtgcatcagccgtgggggaaagcaacactataatgaatatatctttaaaactattattaagaccaattttaaattatagatttatataa

SEQ ID NO: 157 - DNA, 1623 bp, Chryseobacterium sp.
atgcaagatataatgaattttcccaatgtatttggagacggtgttcatgacgacacttcaggaattcaggctgctttaaatactgcaaaagacatatattttggaagcagtgataaaacatttcttgtatcggactctttaaaattaaacgatcaccatcaattagtagcacaaggagcaacaattattcaaaaagctttgcaaaaatcaatctttgatttttcggttgctgatgctggtttggcaaagaaaaatatttctattacaggatttacttttataggctgccaaaatgaaagatataataaattattaaagtctaattccgaagctaaagctattaaatgcgattatgctagaaatacagtaataagagataataattttaaaaattttatgtattctcctttaatggcgaatgatgtagataactttttatttgcaagtaatgtttgctttggatttgacagttgggataactggttacctccgaatacctcaattaatgatattgagccaagagacaatactgcaattacaatagggggcaacaatattaaaattctggataacacaattagcaatactagtcaaggtatttttgtgattttaggaagtactaaggttataataagatctaattttatttctagaacactttacgaacacggaatatacgcagattcaggtgtttcagatttattgatatcagataatattattagtgatataatgcatacgggaattaaggttcagaattatgatagaactgaatctgaaatcaatgtcacatatgtaaattcaaaaaatattacaatcagtaataattctgtttccaatgcaaaagctgatgggatattggtattaaactcttaccctgaaaatccgcccagaatctacgcccagaatgtatcaataacaggaaataatgtttcaggtgttaatgccaatggtataaacgtacgatgtgctaaatatggtacagtagggaataatattatcaaccaaaatttggtagggatttatattgataacgtgaaatttacaactatcaataataatgtaattactgatagccaagaaaacggaatatatgaccaagggactggagaagaaattctatatgtcaataattatataaatgactccggaaagaaaggaaataccacagacgacaaaaagtcaaatatgtttttaataaatggatcaaacagatatgtagttggcaacgttgcaaagaaatcatcaacacataatttggctattgaaagtggagaattggaaacctgggaaataagaaataattcttttcttaattctgaatataatagcataagaattattgccaatgtaaactctcaaaacttcagatactttggtgaaaatattttaaaaaacaaagcaggaaatactgagattgccctgccaaataattcacagttatttaatagcccgcaacttggaaatcaggatatgtattttagtaagatagctcctccaagttcaccagggaattataagaaaggaacaataattattaattctaatcctattcctggcggctttattggatgggtaagtactgggacaacctggaaactatttggaaaaatcgaaaattaa

SEQ ID NO: 158 - DNA, 666 bp, Chryseobacterium sp.
atgaaaaaattatttcttttttttgcagcattaacagtacttacaagctgcttacctaaagttgctctaactcctacatactgggacaagtcttcaaaagtaggaattttagtgaatgcaactccaccggcaaaatacaaagagggttcacaagggcttttagatatggcagttacctctggagataaatatcaggaagcattgaatctcattggtgaaaaaatccacccaaaagaagaattgattgcaatgtactctgagattctaaaatcaaaagggaaagaagttgtcattattgatgaaaaatttgattccaaaacggcaaaaaagtttaatggtacaaaagcagaaggaaaaaaatattcacgatacgattttagtgatttaaaagctaagtataatattgatgaattattatttgcagatgtaaatcatggctttatgatctcctattacggaatgattgaaacaggaaagatggctcatacctttttgaatacaagtttaattgatctgtctgatcaaagcctggtcatgtctagcctgaatatgaaaaatgttacattgaaaaaatggaaagataacaactacgaatcttcaatacaaggggtaagatccactttagatcaagctaaggcagaggaaagagacattaacctgaaataa

SEQ ID NO: 159 - DNA, 798 bp, Chryseobacterium sp.
atgaaaaaagcaatctgcctttttatcgttggagaaaagtacctgaagctattcaataaatgcaaagctcaatttgaaaattatgctaagaaatgcgatgcagaactcttaattattgataagcccttagatgagacctttgtacgacctcttctatctcaaaaattactgattccttccaaaacagaggagtatgatatggtgctttttttagatctggatattgtcatatctgaaaatgctccgtctatttttgattttctgcctgaagataaatacttcggtgctgttttggatcccagaggtactgaggaatttaataagacatggggacatattcccagaatactggaagagaccactgaaatctattttacagaccgtcactttgatgctagcccgttgctacaaggaagtataaatggaggagtatttgttttccgtcctaaaaaagtaagtgaaatttttagcagctattatttttcagaccataatcaaggagcactcaacagtttcgaagaaacaccttttgcatattattcccaaattaataattggtttgaggcattgcctgctaaatttaatactcaggttttatataaaataaaaggtacatctattggtcatcagattgaaaatgatgaaaagaaagttcctaagtttttaaggaaatattattataaaaaaaatgatgcctttttttatcctacccggaaatataaaaactttgtaagaaatatcattaaagataactattttactcatttttctggtaattaccctataatatacatttaa

SEQ ID NO: 160 - DNA, 654 bp, Chryseobacterium sp.
atgcacatactttcacgtttatttagttcttttattactgtatcttacgcaattacagtaaataatgaagttaaagaattaaaaaaattactggatatccttttaccactgattgataaaaatgatgaagtgattgttcttcaggatataaccaatgaaactgtagaggttacaaaacttttggagaaatatagtaatattacaaaggtgcaggccaggcttgacggtgatttcgccgggtttaaaaacaatcttttcaaatatgctaaatgtcagtatctttttcaaattgatgctgatgaatatccaacaaaagatcttatcaaatcacttaaaccgtatctgcgtaaagaaagacgtggagattgtttttttgttccaagaatcaatactgtagagggtattacagctgattatattaaaaaaatgaactggactataaatgataagggatatatcaatttcccggattatcagcccagaattattaaaaataataaaaaaatattctggaagaatagagtgcatgaaaccttccacggctttaaacgaattaaagaaatgcctaagaattataacctttgtctaatccatgaaaaagattttgaacggcagaaaaggcaaaatgaattttatgaaacgcttgcagattaa

SEQ ID NO: 161 - DNA, 1311 bp, Chryseobacterium sp.
atgacagaaggtaatttcggagtaaatatctccggttttttcaaagcagaaatcggttttggtgaagcagtcagaggaaacataaaagctcttgaagcagcatctatcccccatgttcccatcaattttaatcttgatttaaaaaacagattaaacgacagttcagtagagaaacaactttctgaagatcctatttacaatataaatatcatacatctcaatccagacacaataccttccttctacgaggaaaaaggcgcggatttttttaaaaaaagatacaatattggcttctgggcatgggaactgtcagagtttcccgatagttataatgactatttcagtctttttgatgaaatttgggtgccatcttccttttgtcaaaaaatagttgcagcaaaatcgcctattccggttattaatataccgcacattattgatataaaagataaagatattgataaggaaaaagaattcagttttagtaaagataaatttacattcctttttatgtttgattataacagtcatttggaaagaaaaaatacaattgctgttattgatgcttttgaaaaagcctttccaaacgatgagaatgtgcaactggtaataaagacctcaattcctacctatttccctcaagataaagaaactattctgaaaaggattcagaatcgggaaaatattatcattgttgaagaaatgctaagaagagaaaatcttctggctttaataaatcaatgtgattgttatatatcactgcatagatccgaaggttttggattgacgatcgctgaagcaatggctctaggaaaaccagtgattgcaacaggttattcaggtaatttagagtttatgaatgttaataattcatatgctgtaaaatataaaatggtagaattaacaaaaagtgttggtcagttacaacaaggttcttcctgggctgagccggatgtcattcatgccgcacagctaatgaattttgtattcagcaataatgaagaggcacaaaaaattggagcaaaagcccgtgaagatatgtacctcttcaatgcaaaagctataggtgccaaaatgaaaaagaggctggattatatccaacacaatattttgtccttagaaaagaacaatacagaaaacgaaatcatgctgatgaagctaaaacatcagacattagaggaacaaaatagggtcttacaagataaggtaaatggccttcgtaagctaacttttgtaaaattaaaagtaaaaataaaaaatatgaagaataaacttaccgggaaaaacagaaagtatttttgggaagattaa

SEQ ID NO: 162 - DNA, 1050 bp, Chryseobacterium sp.
atgaaaactaaaatatattttgtctgtccaaataatacctttgccagtggaggagtaaaacaaatctacagacaggtggagatcctgaataagaatgggtttgatgcttatatacttcataagaaaattggcaaaaaagacagctggtttaatattgatgttccaattgtatacagcccctatctttttaaaaagttaaaatattcttataaaaacaaaaagcttaatttttttaaaaaaactgctttgtttttccttcagcaaagaagtaaaaaaattgaaaaagaggccatattggtgttcccggagatttatggccccaaaatacatcacatagaaccggatgttgcaaaagtcattttcaatcaaaattgctactatacatttaattacttttcaatttatgagaattataaaataaccccatacaatcatcccaatacgctggcaactatagtcgcatctgaagatgcacttacttatatgagacttgctttcccacaatctgatattttaaaaatgagattaggagtaaatcatcatgtatttaactattcagaaaataaagaaaagcaaatttgttttatgccaagaaagctgagtgatgatgtaacacaggttatttctattttaaaacaaagaggctctctcaatggatggaatcttgttccaatcgataataaaactgaacaggaagttgctgacatcatgaaaaaaagtacattctttttatgtttcaatcacaaggaaggtttcgggcttcctcctgtggaagcaatggcgtgtggctgttatgtgataggatatagaggacagggtggaaaagaatattttaagcgtgaaatttcgtctcaggttgaggatggaaatattattgagtttgttacaaaaatagaagacgcaataaaagtttacgaagaaaatcctgatgaaattctacagaaaggaaaaaatgcttccagctttattttgggaaactataatttgcaaaacgaagagcaggatactatagctctctggaaaaaaattatgctttccgctaaaaaataa

SEQ ID NO: 163 - DNA, 969 bp, Chryseobacterium sp.
atgaaaaaaaaactgttatttattgctccaggttactatgggtttaatgaagttgtttttgagggtcttaaaaaatatagtggctttgatgtcactcatattaattcaacattgccatatcagtacaaaaatatttttgaaaagatttacaattttctgctgaaaacttttcttggtaaaaatttaaaaaatataaaaagagatgagcatattcagaaaacaattagcagtctggattatgatgtacttttggtcaacagaccagatgttctgtctctaaacgatcttgatcttgcgataaaaaaatccaagcattccattgttctattttgggatagtattcagaaaatacctactcagaaagagtatatcaataaatttaacgtatgctgcagtttcgattctgatgactgtaaagaatataatcttcattatatcaccaatttttattttattgaaaataacgattccgcaacaacttacgatatcagctatttagcaacatacgacaagagaattcaggaaactatttcactttttgaatattttaataaaaacagtatttctgcaaagggtaggattttcacttataagccaacctctattacagaaaagatacccaaagaaatagaaattatacatgatattatacctttctcagagtcttatcgatattatttagatagtaaaatcatactggatcttgcacatcctcatcaaaaaggactttccttcagaccctacgaggcgataggtctgcataaaaagcttattacaaccaataaggagattgctcattatgatttttataatcccgcaaatattttcattatagaggatattcagaatatcaatattcctgaatcatttattagcaatgcatatgaagaaccttcagaattgataaaggaaaaatattacattaaaaattgggtaaaaactatactttctattaacaatgaaaactaa

SEQ ID NO: 164 - DNA, 132 bp, Chryseobacterium sp.
atgataaatgatctttttgacgaggctaatcgtgaatcaattatcaattatcaattatcaattatcaattatcaattatcaaatttaaacactaaacttaaacatataaaagcacatgcaaaaatcaaataa

SEQ ID NO: 165 - DNA, 534 bp, Chryseobacterium sp.
atgaatacagaatcaaacaacccactacaacctggaataatgtcaaatagtctcatccagactctgatcgacaattaccgtcaaaaccatctagcagctattaatactgctttaggaatgcaagatgctcattctatctggtttgaccttccaaaattaaaaaatttcattgcaaagattgaagaagaagtagccaaagtgaacccagctgcatctgcagaagatttaggaatcagattttattattctgcctatccgaagcaagaaaactggtctatcatgcaatcacatcctgtcccaacagaatatgctgaaaaacatacattagtactaatcccaacattgaaaagagccaatgaaacaggagagcttattgattatgatttcaatccttttcaaaataccgaaggaaaatctttagctttaaatgcacgcaatggaaaaggattgggagatgatgatgacgacactggtcttggagaaaatttgggaacattgatcccacctggaaattctatttcggaaacttactaa

SEQ ID NO: 166 - DNA, 1365 bp, Chryseobacterium sp.
atgaataacaaaaaagctaagcttgacaaattgacgtcaattgtagggacagaacgcttattaccatacattggaaagaaatatgaagaacaatcttttagtccattggctgttatttttcctaaaactacatttgaagtttcagagattatgaaattttgctatactactaatcttaaagtaactgttagaggaggaggaagtaatgtaaatggtggagcaatgtcatgtggaggtgatattattttatcattggaaaaactgaacagcatattagagattaataaaattgaaagaatcgtaactgtagaagctggagttgtaacagaagtattacaaaaagaggtgaagaagtatggattatgctttcctcaaaatatcagtagtgcaggaatgagttttatcggaggaaatattgctatacgaagtggaagtcccaaatcatttaaatatggtacaactgcaaactatatactgaatctcgaagtagtactccctgacggacaggttatttggacaggaaagaatgttaaaaaggactcttcaggatataatcttactcaattatttacaggaagtgaaggaacattagggatcattacaaaagcggttattaagcttatcccattgaaaaaagaatggcttttctttatatcatttccttcaataagtgatatgtatgatttcattaacgaagttcttaccttgggactcaatccttcaagtatagagtttttggatacaaagggttttgagctggtctgcaattatttgaaagatacgagaatgattgttaatactggtttctgtatctggatggagtttgaaactgaagtctggcaatctgaacttcctgaattggaagtcatgaatcaactgattggcaaatattctaatgataatgctttgtttgcggaatcatcaagagagaaagaagagttgtggaagtataggaataaaataggagaagcatgtttagattattctgaatttgttgattatgatttttctattccattttctgtttcccaagaggtatatgaaaagattacagcaatcctcgaagaatttaattttgaaagtataatcgttggacatattggtgatggaaattttcatatcaatgttttttgtgacaaaggtttgtcttcagaacaatgggagtcaaaaatatatcaatgttttatgatgatcacctcagttatagtaaattttggaggaagtgttccaggggagcatggagtaggttatctgaataaaaaatattttaatctttcagtaggtgaaaaacaaatagaactgatgaatggaattaaaagaatttttgatccgaaaagtattttaaattttgacaaaatattttaa

SEQ ID NO: 167 - DNA, 1113 bp, Chryseobacterium sp.
atgagaatgaaaaaaaagaatgttaaatcggaacttcacaatatcaaaattgagtttgtagaattttatgtaggaacggcaaaagctgtagtgtattggcatgttaaagctttaggatttaaagtaattgcctattgtggccccgaaacagggaacactgaaaaggtttcatatttgattgttaaaaatgatatcaaattaataattacatcagctataaaccctctttctcatcacatattatcttatgtaaatttacatggtgatgctattaagagaattggaattaaagtaagtgatgtagcggcttattttaataaatccatatcaaaaggaggtattccaattgaaggtccccaagcattaagcgatgatagtggtgtagtagagtatgccattttgaaattgtttgatgataacgaaatattcttgattgataatagtggctatgttggggattttatgcctggatttataaatattgagactgattgggaagatatcaatgaagaaaattctgaaatttcggaaattgatcatatagcatgtgctttaagaataaatgagatgtttctatgggaagattatctgaataatattctggcttcaaaaacaattgaagaatatgatgaaagaaaaacattagacagtgataagaaaataggaatgtatttaaaggcgttacagacgcaaaataaaaaaatcaataaagtattggtagaacctgaattaaataagaagaatcaagttcaattatatattaccgaaaattacgggtcaggaatacaacatttagcatttaaaacaaataacattgttaaaactgtcgaagtattaaagaaaaatggtgtaaaattcaataattaccctgactcctactatgtatccttacagcagaaatatccagatatggatattcaagatctcaaaaagtatgggattttatgtgatgtagatgaaaattccctactattacagactttcacttctcccatcggagatagacctacttttttttatgaatttattcagagggttaatgactatgatggttttggcttaaataacatacaagcattatttgaggcactggaaggtgaaattatgaaataa

SEQ ID NO: 168 - DNA, 1296 bp, Chryseobacterium sp.
atgagaaaaaaactaaatgaccacctgaattcaatcgaaaatgatacaatggagtttttgaacgaaatagcagaaaattattcttctgctatttctttagcttcaggaagacccgatagtagattttttgatcttaaaaaaattgatttctatatcaatacttatctcaactttatttctgaaactcaaaaaaagccttatgagactgtactctccaatttggggcaatacagtgaggctagtggaattattaacgaaataatcgctaaatatttattggtagaatatggcttggaaacaaccccggaaaatattcttatcaatgtaggaactcaggaaagtctgttgatttctgttcttacactatgtaacaaagaaaatgatattattattgttgaagatccgtgttatgttgggataaaaaactatgctcttattgcaggatatgaggtttctggagtgaagcttcatacagatggtatgtgtctggattctttggaaaaaaagattctaagttatcaggaaaaaggaagacatgtcaaaatagtatatatagtttctgattttcagaatccatctgggattagaatgtctattgtaaaaaggaaagaaataatagagctagcggaaaaatatgattttttcatccttgaagataatgcctatggtgacttttgctttgcagatgagatgtttcctactttaaaaaagttagataaatacaatagagttatttatttacatacattttcaaaacttatttatccttctgtccgaataggagtaatggttgctgattataaatttgaagatgggagaagcttgagcaaccagttaaaaaaggtaaagggatatacaacggttaatacatcctctataaatcaggcgattattgctggaattttaatagacaatagtttttcattaaaggaatataatagagaaaaattagaaaatctcaaagaaaagaaaaagttaatactcgatgctttacaaaagtactttagaggtaatagtgaagtgtggtgcgaaaatattaaatggaatgatccggaaggcggttttttcatggttattgatttaccgtttaaagtaacacaggaggatgttattacatgtgctgaagtatttggcgtaatctttacacccatgtcttttttccaattagatgaaattaatgagaaaaatataaggattgcatatagcaatataaaagaagatagaataatcactgcagttgaaagactttacaatttttttaaaaacaaaaatgagaatgaaaaaaaagaatgttaa

SEQ ID NO: 169 - DNA, 1980 bp, Chryseobacterium sp.
atgaatacagatactgcggatattattaatataatagacgaatgggagaaaaaaaaattatttgaattcctaaatcaaatatgcaataagctatctcttctaactgttgaagactttaaagaacaacactttaaaaacaaaaattctttaacatttaatgctcctgaaaacatatgttcgggttatagcggagtaattattcttatgatagaattttatcatcttaggataataagtttagaaaagatagaaaaaatggctgacaatttaataaattactgtcttcaaaatccatctcaagattattcattatttgcaggaagatcaggtgtaatttatactctcattcaattgtttgaaattacaaataatcatcaatatataaatatttgtcttgaacttgtccaaatatcggatcttagggaatttataaactcctcttataccagtgactatatttttaatggcagagcaggtacacttcttaccttggtgaatttgtatcttctaactaaagatcaagaattgtccaaatatatatctttaatttatcttaagattctaaataattgtgaagttgctgaaaatgggatttcttggaaggaacatgaagaaataaatataaaaaactcagttggatttgctttcggtgctgctggtataaagtattctcttctgattatttatacaatttctcaagatatagggatagactatatcattaaaaatattgatcaatatatcaattcaaactgggattttaaacaaagtaattttaaaaactttgaaaaagatattttaaataaagaaatgttttcaaaatatcttactcaatatattgaaaataaggagttactttctttctcctcctttcaaacagagtggaaccaaggattactaggcaatttaataccttggaaccaaaactattgctatgatttatcacaattagaaatcaacagctttgaaaacacatcactatttaatggcagcagtagccttgggctattttacttaaaacaaattaatacaaatcaatcctttattgaaccactaaaagagtttacaaaaaaaattattaaagacattcaatataatgatatctctggtggattattttttggagaactaagtaaagtctatttcctattaaagctattgaataataatatcgatacaaaaaatattctagagcctttttatgatcataatataccagctaatgacttatatttcattgatatcatcgaagtaagaactataattttaggccatttttttaagagaactctggactttcttaaagagtctcttcctagaatattaaataaatatttttcttcagaagttaagattattccagaaattaataattttatagaatttattgaaaatattttaaaaaattttaagggaactaaaattgctgaacaattagaggacatctatctgttggagaaaaagagatatgatatcaaaacactagataaagaatccaatattacaaagtactttgaaaactttgtaaataaaaaaaattcactagagtttttggatcatgatgatagttggtttttgaaacaatcagtagaaatttcgaaaaatgtatatataaatcaaagtaaatggaattggacttacgcctcggatagaaaattcttaaaagaaaacttacagaaagacgcagagagttgtgagtacattattatgttgaatgaaaaaaatgaactgattgaatattatctgggattagaaagcattatccttaaaactttccgtcaaaatattcaaattgaaactggtattaatgatttaaaatcttatttactatcacagccttacgaaaagcttattctattttcacgccagtcaggctcaaaagatatggatgacttcttgggcagacttgattttttattaatccaaagaataagatattttattttttctggaatattaaattatacaaaaaaagattag

SEQ ID NO: 170 - DNA, 822 bp, Chryseobacterium sp.
atgattttatataaatatttccccgagaacattaattctctaaaagctctctcttgtaaatctgtttggatgaattcagcccttaaaatgaatgatcctttagaatcattgacattaattagtcaagaatactctcaagaagatttaaatcaatacagaaaatatattaaagaaaatgaaattaacacaaaatcagattggttaaattataataacgagcaattaattgaatgtcttaacttcctacgcagaaatattctgactggactttgtttttcatcattttcagaagattacaataatattttaatgtggtcacattatgcttcatcacatacaggtttttgtctcgcatttgaattttctgaggatttattagttgaaaatgatttaataaaagttaagtattcagataaagtagattcattaaacattaaatcactaatgtgcgatgacaattctccatataaagatttagtagagatgaaaagagatttttataatagcttaactgttaaatcacctcattggagttatgaaaaagaatggagaaaatggggacatccaggatatgaggattttgatggtcgtgcgaaaattgtgaaaatatactttggatacagaattgataaagaatttgaaaacattgtacgaaatatattaaagtctgtggaacttgaagatatagaaattagatatatggatataatggataactcaacaaatctaattacaatcaatgaagaagattacaacaataatttcaataagagacaaagattagttgaaggaaaatatataaatgcaaaatcctttatatag

SEQ ID NO: 171 - DNA, 873 bp, Chryseobacterium sp.
atgaaaaaaacttatttacttctgccaatcttctttttggcttcatgttcaagcagcaatgatgaaacagatttatccaacaataatgggaataacaatggcaacaataatcccggcactcctgtcttaatctcgaaacttactgtagatggagatacatccgtattcacctataatggttcaaaaatttctcaggttaaaaatattaatactggagaagtttccacttatacatataccggagatttaataacggaagaattaaccacgggaggaagctcaacctttaaagtaaattatacttatgatggaagcggaagattaattaaaaaagtgagtgtacaacatatgcttgttaatggatacaccgcaacagatgaatataattatgcctacacttccaatactaccttaaaaataacttataccaagactgttgcaggaaatttcacaggatctccttcgataacaacaggaactaaaaatgcgacattaaatgcagatggttcattaaatagttggacagaaacagcctcaatccctattcctggtacttctggctttaattctgctaccggtattttgaagcctattgtatatgatacaaagaattctccacataaaaatataacaggatatctaaagattattgatactgaagatgaaaatggatcttctcacaatattttaagttatagtgataaactggatcttaataatggttctggaggtgctatgtggggaatatttaaatctacttatgaatataatacaagtaactatcctaccaaaaatgtcagagtttattatgacaagacatccactaatgtaacaagcagtgaggttattacttacgaatacaatcacctataa

SEQ ID NO: 172 - DNA, 420 bp, Chryseobacterium sp.
atgaaaaaaacaataacattctttgtatttctaggatttggactcacattttctcaggtaaaggaaactgaaactctatcagctaaagatcagtctgaagagtctgttttgtcgaaagacgaaaaatctgcagaatatcccagaggatggatggcacttcgaaaagatattgctgacagaataaggacgaaaaaaataaatatgagaggaattgagggaacaatcacggcgagggcaaagtttatagttaatatcaaaggtaaaatagaagacatcacagtaactggtgataatgccgacttcaataaagaaatagaaagagctataaaatctctgaaagcccaatggaaaccagcagaatccaagggtcgtattgtccgcagctattatacttttcctcttacgataaaacttgattaa

SEQ ID NO: 173 - DNA, 3348 bp, Chryseobacterium sp.
atgacatcaaaacaaatgagaagattttcaattgaagatattgaaaatgcgtatgataaattaaaaacaactatattttatgattctggtgatttattactaagagaacagattgttgaatttgaaactaattactcaaaaaataatttcattttttctgattttgaacttacaaatagatattttaaggttaaagataaggataagaacaagttagatttcccatcttttttacaagaaataaccttacaagacaaatttgaaattttaacagagaaaataaataattacaataaagattcggaattttttgatgaacttctagaagaaatatctgtaacagtatatccaaaaaaatttacacaaaataattccattcactctattatttctaataaaagaattaaaacaaaatatattctagataaagttacagcattcattcatgcaccaattgaaattcatattatagctgtcctatggacaattaaggatgggataaaaaaagatgcagatttagtagatgagtgtgtaggaaatagactgttattaacaaaagacaaatcaaaaattctttttggttcagctttatataaaccatatttttctcaatatcaacaatggagagacaatgctgttaatactgcacaacaattattaaataataataaaaacacacttttcttaaatttagatattaaagactattactattcggcaagaatatctgaaacctattttcgttatactgatggagctaaggaaatatatgataaccttaataccttaatggaaaaattacatagaatttttactcaaaaggttctacaattaaaaattccatatgattttaaaagtgaagttatagaaaacgatagaattaataaatttattattccaataggtcttcaatcctctttaataatagcaaatgaatatctaaaagattttgataaaattatacttgaaaaatataaaccagcatattatggtagatatgtggacgacattttaattgtaatatcagaacctaatacaacagacaataaggataataaagcattagataaatattatactttttttgaaaattacaaagaatcatcattcgataaaaacagaaattttaatttaaaagatttaacagatattgaactatatatattaaaaaacttttatcccttaatagatgttattaattccccgttttccattgagaaagaatttaataaaccagagaatcgaattttcaaaataaacggatattcttctttatattgtcaaagtgataaaaccttaatttattattttgataaaaacgaatcaagtgttgttatagacaaactaaagaaggaaatcgaagataaatctagtgaattccgagatatgcctaatgatgaagataatttaatagagtttgaagaaaatgcttatcatttatcatatgatggtacagatggtaaaataagaactttgaaagattataaagaagatcgatttggtttatctgtttatctttcacacaaaatcaatttaggattaagaaaaagagaaaaaatatcagaatatgaaaaagaaaaaattttaaagttttttaagggagaaaactgtttgactttctataagctttgggaaaagatattaacattatttgtagttaatgatgatcctaccgcctttactgagtttttatttcactgtctagaacaaattgaaaaaatcaatgtcaaagataatgacaaaactaacaacgaatatagcttaactagagaaattgcaatacaagtacatgatgcattaacacaatatttattttttgcatttgaaatgagcatttcgttgaatttaaaattcttaaaaaattatgatgtaaataagaattttgaatttcaatcgaataaaactagtcgagaaaatttcgctttgctatttgccgaattttcttttataaatccttataaatcacgaaaaaaagtaggttttagaattagagaagcaaatatgattagacatcattatgtttctatacctctattaaattatacagaagacggaaaaaatggtgacttaaatttaattgacaaaaatcttcatataaaaaattacaaacttgatcgcacattattaaaaaattccccccgacctataaaattctgggaatgttgcatagcatcagcatttgaagaatttcaaaaatttaacccagaaaattcaaatcggtctgaagtcatagaaactaatatcttatatgatattatggaagagtatgaagaggaaatttatgatgaagaaaataatgagttgaaaaaaagaattgcctataataaaaaagattatttagacgttgcgtttgatctatattgtctgggtaactccaaacataaaccgaatcatgaattaaatcaaaatcttaaaaatcagttttatacattacaaaagatttatggatcggaagaagactttttagtgaacaagtttacagtaaataaagacgagaaattactaaatccaagaattgcatttgcaaatactgatgttttagaggaaaatatagaagcaagtattttagattcacctattctatcaaatgaacgaataaataaattatctaaaattttatctaaagcaagaaagtctgatgctcagctattgctatttcctgaaaactttatgccaatgcgtttaatttcggcattaggtagattttctactgataaccaaattatgatagtttctggaattgaacatttgactctaaaaaatacatcttttaacttcgtaatctcaattctcccacaaaaaataaatggaattaatgatgctactattatttttagattaaaaaataattattctcctggagaggaacatttaattaataaacattacttggcagtccctaaaccaaaaccttcccgctatgaaattattaattacagaaatatttatttttcagtttgctattgctttgaattagcaaatataagtcatagagaaaaattaaaatcaaaaatagatttattaatcggagtagaatggaataaagatacaccatacttttcgaatatagttgaatctacttcgagagatttacattgttttgttgctcaagtcaatacaagtaagtatggtgacaccagattgacacaacctaaagagacagccactaaagatttattaaaattaaaaggaggactcaatgatactattcttgttggacaaattgatatccaaaagctaagaaattttcaaagagtaaaatcatctatcaatacaagtaaagaatttaagccattacccccagatttttctttagaagaaatattaaaacgtatttctaatcaataa

SEQ ID NO: 174 - DNA, 618 bp, Chryseobacterium sp.
atgctgaacgctaaaatagactttgataattcgtgtgaaagaataaataaaattcatgaattatacaatcatttaagtaacgaactacatttccagtctgattttatagttgatttgttacgaagtgaaattgtatatatggtttcagctttagacaaatttattcatgatattgttaagattggaatacttgaatcatataatggcttaagaattaatactcccgcttataattctttctctattagcatgcttcatatcaatactttggcaaatcctacttcacaattaactgcaaatcagattttagaaaatataattattgaaaaccataaacacttatctttccaagatccagataaaatagctcaggctttaagtcttatatggccagaaaatcataaatggcaaaaaattgcagattatgtaaatatggatcaaaataatctcaaaattgaattaagaaatattgtaattcgtagaaaccagatagttcatgaagcagatatagatttattcactaattctatacaagatatagagaatgtagatgttgaaaattcaattacatttatagcccaaattgtcgatgctatatataaccttgtaaagttataa

SEQ ID NO: 175 - DNA, 771 bp, Chryseobacterium sp.
atgaaaaaaatacttctactgacattggtttttgtttcgggattatgtatttctcaacaagttcatgtaaaatatcaacgcgttttatctccttttacaacaacgcatgaggacttatatattaagaataatcaggtattatcagttcaggattcaataataattaataataagttaactgattcctggactttgggggtgaatttggataatggtaaaaagccttcaaaacaatattttgtttcagacttagataattctcctgaaagaaacttcttctttacatcaagtgttgataccaaagaattttttatatatgataaagttcctcagccgaaatggaatattgaagaaaaagaaaccaaaacaattgcaggttacaagtgtcacaaagcaacggctgatttccggggttcaaagatcatcgcttatttcaccaaatctttaccatattctgtcggtccatttaaattttatgggcttccgggattaatcttagatataagagttgaaaataaagattatgatatatggaaagccgaatctgttagtacagacgatcaaagtaaaatagtttataagcctcaatttctacgtaaagataaaataagttttaaagagtatgtagaagctaaagaagcacatatgaataaaatttttgcaaaagtttctgatgccctgcccaaaaacagcaaagttactgtcagaacaaatcaaagattttctgtagagcaaaaatatgaatgggaaaataattcggaagtaaaataa

SEQ ID NO: 176 - DNA, 282 bp, Chryseobacterium sp.
atgaaaaaactaattttattagctgcttttggagcagctgggcttgcaagtgctaaagcaaatgatggaaaagcaatcaaaaatgacaacagtattgaggctaatactatgcaaaaaacagttgtttatcaagaatgtggcgttgttgttacttattggtctggtggtcaaatcgtaggacaggagactatagtttctgatcagccagatttacaaagttgtcaacaattccagaccggtgtaaaagttgctttatgggcggctggattttggctaagttaa

SEQ ID NO: 177 - DNA, 201 bp, Chryseobacterium sp.
atgaagcttcacaaaacttattttaagtatttaacgcaaaggaaattggatgctattatttatttaagcaggcaaagaattgcgactaaagtcgctgatgaagcgaaaggatattacacaagcttagaaaggatcaatttcattgattccaactttgcttccttagaatttaaaaaaaggaatattaaactttgcgtttaa

SEQ ID NO: 178 - DNA, 699 bp, Chryseobacterium sp.
atgaatattatagtaacaggagcaagtagaggaatcggatatgatactgtattagaattcagtaaaaataataaaaataaaattattgccatatcaagagatatggcaagattggaagaattaaaacaaagatgtaatgaaaattatggtaatgagattcatgttatttcacatgatattacagatgatcaaaacaaattaaaaaatgaattaaaggattatgagaatattgatatcttaataaataatgcaggtctacttattaataagccttttttagatttatctattgaagattggcaggaaacattcaatgtaaatttatttggagcagttaaaattatacaatctgtttttgataaaatagtaaaaagcaaatatgctcatatagtaaatataggaagtatgggaggaatcagtatagctcaaaagtttgaaggattatcagcttattctagtagtaaatctgcactggcaaaccttactgaatgtctagctgaagagtttaaagattataaagtatctataaattgtctatgcttaggggctgtagacacagaaatgctaagacttgcttttccggaatgtaaagattcttttcaaagtgtagatatagcaaaatttatttgtgacttttcatttaattacgccagattattcaatggtaaaattattcccgtttcttcagcaaccccctaa

SEQ ID NO: 179 - DNA, 474 bp, Chryseobacterium sp.
atgctattcattgctagacattgcttagagctaggactaaaagcaaacataggatatttttcaaagtattcagaaaaagatgattataccaatgcaggaacacatgaccttgaaaaactattcaatgcttttaaaatgcatgttgaaaaaactattgaaaatttaaaaagcaaacataatattgatattgaagatgaagataaaaaatctttcaaacaattatgtgacgaggttgaaaaattaaataatactcttcatattttagacaaaaattctgatgcttttagatatccaattgataaaaaacaaaatccatcatttaaaaataatgaccgaataaatttaattgatgttgctgaattacttgagaaaagcatgacactatttctatacacagctgatgtttttgctaaatatactgattatgtggatggaatagaaagcttttacgaagatataatgagagaacaatga

SEQ ID NO: 180 - DNA, 183 bp, Chryseobacterium sp.
atggatccaacagcgtatcacaatcacaaggcaaatttcaatagattgacaggtaaaaatgctgatgaagagttagctgcttttttcagctatcttaatatgttaaatctatttgatattaaagatcttttaaaagatctgagaattatgataaaaaatgtagaaactaatactaagaattag

SEQ ID NO: 181 - DNA, 144 bp, Chryseobacterium sp.
atgaaaaattttacagaagcacaattgagattattgtgcctaattttagcaaagggaaatattcaaaatgctaatgaaaattatgattggataactacaggagaattacccttaaaagatagggtgctaagttctaattcttag

SEQ ID NO: 182 - DNA, 150 bp, Chryseobacterium sp.
atgctgaaaacaaattgttcagatttttgtgaaaagaataatgttcatttatgtatcatgtttaatatatttgcagatatattttgtatcgatatgtggaaaggattatatgttttgactgaaaatagtaacaacaatggagcagcttag

SEQ ID NO: 183 - DNA, 201 bp, Chryseobacterium sp.
atgaaaaaagcagcattatatatgttattattgctcatgctgtcagcatgtacaaaatccgaaactcaatataccgatcaaaataacagaaaagaaacggtaaatgacaaggcttcagatacgatccaaacccttaccgagctttcagacaccttgcagcaggaaaacgacagtataaaagtaagaaccggcaatgaataa

SEQ ID NO: 184 - DNA, 846 bp, Chryseobacterium sp.
atgaataaggatcattatcctgtgaatccaaaaggcaggctcatcattattggagacagcactccctatacttgtctggaagtggaacaggcaccggatattaatcaaattccttctcagttgttcaaattattatcagaacataagaacatccgtattgaaattatcatttcagattccatgcctggatatacagaaaagtattctgctgtattacagaaatatggatatataaacttagggattattcatgttcatcaggaaagtaattttaatgattattatgccagaatctcgcagtccggaatagtttttatcgcgaatgagaatccggaaatttgtgaaatgctgaaaaaatctgaaatactaaagcttttacataagaagtacattcatgaagaagattttacaattatcggaatgaatgccgcttcaatgtatattcctaaaattttggtgaacgaaaaaggaattcatcaaggtttcggatttatcaataactgtatcattgatacaaaatttgagtgcggaacaagatttaaaaagctgatcagagccattatgcttcatcctgaatgtcttggcattggccttaataacggtatgttgatggttattgagaaaggctacaaagcttcctgctacggcagcagtacagtaatggcagtcgatgccaggcatattaagaaaagcaaagcaggaaaaggaactactgtttttataaaaaatctcaggggacatattcttaccgaaggatcaggtattaatgtatgtaccggagatcttattaaagataatcagtttcataacagtttaaattttacccgtagaaatacaattcaatga

SEQ ID NO: 185 - DNA, 285 bp, Chryseobacterium sp.
atggaaaatattgaagctaaattagacattattgaaaaatggttttctgtcccttcaaaaaaacttattaatgtttacaacattgtaaaagaaaaaggcattatgagttccgaggattaccaacaaattactgatattggaatcccgattattaacaaactatcaaatgctacaggtttatcaattgagaaagtacgcactacaataatacaaaaaggaatttcctttaattatttccatgaggcaataatatcttactctgaattctgtacaaaagaaaaataa

SEQ ID NO: 186 - DNA, 1026 bp, Chryseobacterium sp.
atgatagaatttgaccaatacccctacaagtacgaaaatttgcttattgaaatcttagagtacttttctgcacaccatgatattggccgaactgtggaaaataatgaaagaagaacaattgtaaaattttgccaatactaccattcaaaatataatcctgatgaaatgcctcccttttcaagtattgccggaatatgtgagatacttgttaaaaataaatatttatcagttgttgttaaagatactcctcacaattttgatgatacatatatttatctaccagctgatggggagggaaaactttttagaaatgaaactctaaaaaacatagtcaatgaaagattgaactgtttagtttatggttttaaatatataaaccaaagctacaaggacatcgtacgcccaatatgtcattacttagataaagaccctggaattggaacatgtttcttatttcatgacggaattgctactgctaagcattgtgttgagcatgcgaaaaaactatccattaaagatatcccaaaggaagtacttgaagcatcagagtttctggttcacgaaaatgaaaaaattgatttaatgtttattaaatttccacaaggattcgatcaagattttactcttattgaaactgaagaaggtcaagtattagatgaggttttagcacttggttttccaaaggtgataggctttcatacttttatgaccgcagaaaaagcaacaataagctcacgattcactccttctgttgggactattgcgtccttatcagaagatctatggattagacaagatcttatgttaattacagctaaaattaaaggcggcaatagtggtgggccaattataaataacaaaggcaatgtagtcggaatagcaactaatcttcctggtttaaaagatgattatgatgacttaggttatggtattgctatcccaataaaacatctacatgaaattattgaaggtaaaagtaaaattttaaacacaagtaatatcgagtttgttgattttatagaataa

SEQ ID NO: 187 - DNA, 240 bp, Chryseobacterium sp.
atgtttacagcgttttttgttttagtgcaggttccagttctgaaatttcagccgttttcgaaatccggcagtatttttcgcgatgaagtgatgtacatcagtaaaattcgctcaaaagacacatatcataaatgcccgaagaatctgcattcttcgggctatattgattatcagccgtcgtataatccattcagacatcgtttaagtcatgtaccaccttttaaatttcccaaaaattaa

SEQ ID NO: 188 - DNA, 834 bp, Chryseobacterium sp.
atgaaaaaagcattaagcattttatcaattttatcattttttatttttattatttatgcatgtactaatcaggatgaaaatatagtaaatacaagtcccgaaacaaaggttgttaacgcaaataaaacaatggagacagaaaatatttcacctgaagaactgggacaaatacataacaatatacttaaacaatattacagtttatatggagaaaatgatacagaagatttgcttgagatgaacaaaagacttaacgaaatatctgtagatttatatccttcgaagtttactctgttaagtgatgatgaaatcgcaaccttcacagagttttcctatggcgcaaccaatgtgactggctgggactatagaacgcattctattaatgcactagatgatgcgctaggaaatggtacaattagccaggatttttacgatatgtttaagtcattagtagtggatggaggtacatacgaagaaactttgggtaaattacaagattataaaactgctctttctaaccaaccagcaagcactattaagactactgaaacaaactttatcaatggagctatttcggtatatactagcagtaaagaatattgggcaaatgacccagatctacaaagtagcaatacttcagggaaatattttggaggatgtgatccggaagatcaaattgcaattgccgacacatatggttcgataatggggggactttttggagtagcgacaagtggaggagtgtcttctgtagtatggggagctgttggttcttggggcttctcaaaagctatcagaatgcagatcaaaaaaaataatgggaaatgtgtttaa

SEQ ID NO: 189 - DNA, 399 bp, Chryseobacterium sp.
atgtgtttaaatgagataaaaaaaaaattagacaaattaaatttcacttattcttgtaaagatagcacattagagataaagcttggattcggtttaattgctgaagtaaaacaaaataatactagtatatcggtttcgggaattctgaccccttggaatccaatttcaggattatttagggtagatattgagaaatcgttggtctacaactctatttcgttgattatattctatattctattatttttaatgatattagatgatttcaaattgaatagctttttgttaatttttgcaagcttaatctgtgtccatcttatcttgtggtatattttatttttagtaaagtactattcttttcgatctcaaatacaacaatggatcataatggaccactaa

SEQ ID NO: 190 - DNA, 201 bp, Chryseobacterium sp.
atgaacattacagcaaaaattacaaaaaatgccgtggtcagaaccaccactagcggtaaagagctcgttagctttggtattggcatccgccacacctacaaaaacaaacaaggcgaaaaaatctcaatggatacctatcttgactgtgcctattggagaacaacgaacatagccccataccttaaaaaggaaaaatcgtag

SEQ ID NO: 191 - DNA, 381 bp, Chryseobacterium sp.
atggacaattacaaaaagttcacagactaccttttcgaccagtttgtaacactggaaagatgcattggtaaaagcaggtcacacgactacctgcctatttttttcaattatattgaaaaaggattctattacaggaattcaaaaaaagcaaagcgatatgcccagatcgtattttccagtatatcctacgctgttctaaattggaaaacacatcttctcgacctgaaaaatgaccccaaagatgcccaaaagaattttacggcctatctcaagaggttggaagtattgcagtattcccccgaccagatcgccaacatgctgatcgaacgctataggctcaatcatcccacggatattttagaccctgaaaaccccctttaa

SEQ ID NO: 192 - DNA, 2475 bp, Chryseobacterium sp.
atgagcaacgccaaagtaaacgaggccaccttagaggccatgatcagtaaaatcatgagtcaggttttcccgacatttcacaaagtaggtttggtccaccaaaaatctttttcggtaaaagtgggacaccacagcattgttgttaaagcgaaaacccccaatagaaattcagtacgtgcgatttccgatatacttttcacaatagggaaccagaacgttattatgctcgagttaaaaaatgaaaatgtgcagctcagtgatgctgaccgggatcagggcatttcttatgcaaggctgctggaccagatgccacctattactttgatttccaatggaaaggacaacgtcttttacgatactttcaccaaagaaaagattgaccggcagcagattgactgggattttattcaggagtgtattggcaatgcttttgaaattgccacaaaagatttacgggatgctgtcgatcttcttctcaatagagaccctgcactatttgcagggctcatcaatggtatgagcggtgaaaaatttgcatcccatagaggcaatatttctgacccaaccgccatgatctgcgatgactttcaggtcgagcgtagtattcttaaggaaatagacgatattttctctacgggacagacacttgtaggagttaagggtgctgcgttctcgggaaagacaaccctactgtatcagttttatcaaaaagtaacttctgaaaacagctttgtgtattatattgattgtaatgaactgaatatgtctatattcaggcaattggcaaattcatttacctcatgcgccaaaaattcggtcaatccggaacaagtcaggaactggctatccacttcactttttgatgaaagttctggtaaattctacctgttactggataatttcaataaaaatatttcagaaggaattatggaagaaattctggaactgatcaatctttttgagggcagtcagcatcggatattgtacagcatagacgaattcaattacaagcagatctcggaggtaccccatagaattcaccagacagcattaggccataaaagtaccgttttaaaactcaatgattttgatgacgaagaatatcaccaggctagggaaatcatgttccgtagtttcaaggtaaccattgagcgaggggggtattttaccgaagaatatcgggagccaagaattttaagatatctgctcacaggccgggatagttcgggacttaaggccaatgaagttatcaaaatcgtcgctgtccccgactttgaactgttacaggatattgcccggaacgggatattttcaaaacgtgtccaccagctttacgaaaaaattgcgaactgtttcgttgaggaactggaaacccgtagaaccgtaccaaggctaagtatcgctgccattggaagcggagccgttctaaccacaacttttaaaacaaaatatcaggatgattaccaggaactcatccagagttccctgatattgatccgtgatctaccgcaaacagatcaaacaatcatttatccgaaacttccggaactggttgcttatcattgcatacgtccaatcctggcagttttcgccaaaaaatcccagggaatggacaggtcagagatgacccgttattttctccgtttagtcgaagctgctccccagtgggatattgtaggagcggccgttcttatcgggctttcacaaaaggatccggttctatttacctcccttctgagcggattgcgggccataaagcccagaacggagaccattaaaaaaggaacggaagcacagctgcatatggaagatatcggacacttaaatattatttttgattcagatttcgatccagcagaatcatcctttcttgccgattataatgcctattccattctttcccagttcgccggctatccaattgaaaggatttctcaggacccggaacagcatgagggatcacctttcgagattcatctggagcttatatgccagattgcctcggacccgcatttatttatcaggccaaataaaaagtctttccttcagatgaaatattatgaactttatgattgggacggtgttggacagatcatcaatggcaaggaaggtattatagaagccatcgtacagtcgatccaaaaaagttttatgcatatcactggatctatgaaagcactttatgaatacggctttcgttcgaaaaacgtaatcctgctctatcgcttttatcttgcattacaaaatctgatctatagtacagattctacacttgcccaggaggcgcaaacttttgtccgcttgtttcatcagtttttcgaagattttatggccaactacctaagcaagggcgtggagaatacagatgatcaggaggctttgtatcaaatactcaaaaagatgaattttgctgagcatttagatgatctcttacttgaagaaaaagatgagggtttggaagaaggtatcagctag

SEQ ID NO: 193 - DNA, 1359 bp, Chryseobacterium sp.
atgaaaacgagttctttacactatatgaaaattgtaattttgctctgctttgtggtttcatgtaaatgcccgatgctgcctgctccagcaatcaaagtcagccatacgaatgtctacgatggtacaagcctccagttacttgttccccatctcaaaaatgcagaagtttattgggaggggcccactgaaatacaagaaggagaaacttggcagatggattctgtaaacaaaatgatgtccggaaaatatagtgtatggtatagaagtactaagagaaaacgatgttattcagcagaagccgtttacaatctaaagattgattctttttccgggtttcccaaacctgaaattatccagtatcagaatagcctgatcagtgaaggaaatagtattgtattgagtgtgcaggatattaaagatgcaaacgttcattggaaaactcccaaaaacgactttactggaaatccactgattataagaaattcaacggtactggattccggactgtactctgtaaactatgtccataattttattcccaatgtgtcatcggagtcttccactaaaactattttcatatatcaaagacaatttgtaacctcttataaagataagaaatattttctcgattttgctttctttgataaatccatacagatctggttaagagaggatcagctgaagaatgatatagtgaaagataaaatgcttgccgaaataaacttcggaacaacaactcgtaaggatttttcggaattcttctgcgaacatgttggttatctagaaaaaagtaaatttctggccggttgtgcagtaactgctggagcctctgggtgtctgttaggagcaggtgaaggattaccattagttccttcctgtgttgtactacttaaattacttgagccagcaggtgccgcatgtcttgaaggagtactgggtgaagtgacaaaagtattgggtattcccgcagcagcagatatgggagggcttggcgccgcaattgctaaggaggaatttgcagatgcgattacaggtttacttaaaatggccctttgtaaaactgcaggtaaggagctggtctttaatcttgacggaagcgttatattaaagccaaaagctctatctgcttcgggtaaacctacgacaaattcttcaggatcacaggattggccaggtggacatgatggatctcaggggcagggaggaaaaggttcaaatagtggtgagaccggaggcggaaaaccgaacagcggaaatggcggtggcgataaacccaatagtagaaatggtggaccaaaaggagatggtggcctaggaccgatgccttttcaaaaaagcagtaaaaaacagcaaaagtaa

SEQ ID NO: 194 - DNA, 3525 bp, Chryseobacterium sp.
atgaacattaaactcaaacaccttcttgttgcattttactttatgcaatcaggtgtttcttatgcacaaagtgagcttttatataccaatcttttttctcagagtcccgtttctaaaagctttggtttccagggactttatccagtaaatttatacagaggactccctgatatttctgttccgatctttgagaaaaaagttagcaatactaattttaacatttcgctcaactatgatgttagtacggttaaacccgaagcagtacacagttgggttggattaggatggagtaccaatgttggaggggcaattacaagagtcgttaacgggcagtatgatgaactttacacaagtcatcttaacgaacatgacaaactttcctatctcgatcattacaatacattggataaaccggactgggattctcaggcctcattatctgctttttattacgatgcggaaaactcactacgatttacaagtttttataattactcaatgcagagtggaaatacgaacactcttaacttcggaggagggttagataattatacggataaatggatgctgatccccgatccggacgaatttatattaaatgtattgggtattaatggacgattttacatgaatgagaagggaaaatggatcggaagaactcgtgatggaaaaacattttcaatacagcatgtctataaagaaaatcacacaataaaacccaacagttatatcagttataatctgagaaggattttatatggttttacagtcacgatggatgatggtacccaatatatttttggacaggatgataatgccgtagaatttactgaagaaagacctccttgtgccaattgtaattttaatgaacagattgtagcaagttcctggttaatcaatgaggttaaatttccagatggcaaaaaaataaaatacacttacgaaagagctccaaagcctaactatattgcaagtcaggtaggttatgatattgtgttaaaagcacccaatattgaccttttcgaatcctatggttcaacagctttaaactggcagtataatacttatctgaaaaaagtggaaagtgatgaattttccgttgaaattaatacatcacaagtaaagccattaaattatcaggttttgaacgagcaattaagaggccaaatgggttcttatctgggctcaggagatagttcgcttctctttaacacctggtttaaaattgatagtatcattgtaaaggataaggataaccataccgttaacaccacaacatttcattataatagtgttgatacaaccaagcgaatgcatttggaagcagtgataaagaataacgaagaaaaatactcatttgattataatcctaagacgcttcccctataccttgattccaaatatgataaatggggatactatgctccatcaacccatagtactccggatcttgaatatacaaaagctgagactttagaatggataaaccatcctacgggaggagttacccatttcatctatgagctcaatgatttttccaagtatggaaataaaaaccctttctatacatctgcgaatacccttgagctgattgacaccgtttctcctaatgaaatagcgggtggcttaagaatcaagaggatcgaggcttgttcagaacatagtacaggatgtgtaatcaagaactattcctacaatggtgataacggaaaatccagcggtattttaccttatcagttcaactttaccagagctggagaagtccaagatatgtataagtttagtcataaatcaagcagctcatatcaatccttaaaaggggagaataacatgattgggtatagtaaagtaaccgtaacagataccaataatggtaaaactgaaaactattttaccaattttgacacccctaattgtaatgatcagagagggcctataattatgggaccgcctgatcaatttaccggactgtataaaagtgttcctttcacatctttttctcttatgagaggaaaacctcttaaagaaattacatcctctgctagtggagtggtgcagacgaaagaatatgaatatggatataacaatcatctgataaaagcatatggtctggtagaggaaaatattcattatatgttgaacctactaacagttaccgcttataacgtcaattttaatagcagcttccttaaaggaattaaaaccactttaaacggagtagaaacaaaggaatcatatgattatgaatataactataatactctgaagtctcagaaaattatagattcgaacggtgatgagtttcaaacgaactttacgtatgcttttgataagccaaataactttttagtaggaaaatatatggtgggttttccacttaaatctgaggaaatgaaaaacggaaaagtagtttctaaaacagaaacgttgtacccgttaagccaaacagaggctgataataagacttccggtttgccattacctacttctcaagtttcttaccagttgcaaagcaactctccagtcactgaagctacatatgacaagtttgacagtaaaggcaatctacttcagtacacaacaaaaaatggggtttctacatcgattatctggggatataagaataatacccttcccattgtgaaaatccagggagccaagctatccgatatacctcaagcgtatgttgatcagattatcaatgcttctaaaatagatgctcagcaggcgacagatgcatctgaacaagattttgttaatgcgttggaccaatttaaaaaccgtcctgaattggcaggatatcttattaccacttacagttatgatcctctaattggtgtgaaaagcatcggacaaccctcaggaattagagagttttataagtacaatgcagcgaatgaactggaaagaatcgtggatcaatccggtaatattgttaaagagtttgcttataaatataatatcaagaaattctataacagcgaaagaagccaaacctataccaaaaataactgtaactcgttacaggttggaggtacctacacatatatagtacctgctaataagtacgtatcattgatcagcagcacagatgctgaacaacaggcagccaatgatcttgcagcgaatgggcagaatgctgcgaataccaacgcacaatgttataatgcccaatgctatgcaagttcaataaatggattccaagttggacctcatgcagaaatttctcaaaacgttttaggacactttaaggtagatatacaggtcaaagtacctaactcactaaccaatccagatggcagccaatggtggcaaaaaggagttgctaacatcccgaatccatgtcgtcctaatacaaatttagcacctgatatattcaataataatgttaaagagcttacaacaaatacctggtggaaagtacagatcacttctgcgggtgaccttatattcattcctaatggttacgtggctcctggcactcagctgtattttgtttttgagtacgataaagttccaaactaa

SEQ ID NO: 195 - DNA, 375 bp, Chryseobacterium sp.
atggggcatatttacgaaaactatgctttaggaataacctctcaatccgatacaagatttggacctaacagtaccacagcggaaatatatggtacgcacgttgaaaatattgtaagagcagagtcgggtctaccattgcgaacccattatggtagtacttgtggaggttctacttgtattcctaatgatgatgggaggttgatagacaacgcaggaagtagtatttattataataaaagtggaggtcaaatatctcctactcctagtgttgaaagtattcttaagataaacggcaaaatattgcaaaaccgatataattatattggaactgccggatattataaattgcaaaaattcaaaaatcgccccagataa

SEQ ID NO: 196 - DNA, 684 bp, Chryseobacterium sp.
atgaccttaaacgtacctaaatacaccttaagtgcatttgaactcccgcaaaaagatattatgagttcaaatatgaaaatcaagaaggtctgcgagcactgcggactagggtttattgccagaactacagtgacaaaatactgtggtgaccactgtgctaaaagagcatataaggcaaaagtacgggatcaaaagatcaaagacagtcaagtaaaagctgaggccccctcagaccttgtaatccgtagggaaaacgaaaacgacaaatcctatttcgctctaaaaacagtagactatttaacagtcagtgaagcagccgctttacttaagtgtggacgacgcacgatctatcgaatgataaaagcaggtaaaattccctctgccaacctatcaataagaagaatacggctactgaaaaaagacattgatgagctatttcatgtcacacttcctgtggatttgattaatcagcaagacgaaaaactctcagaagagaaaatccttaaagattttttaagcattggcgagattcaacagcgatacaatatttccgaaacgagtttaaaaacccttattaaccgtcataaaatccctaaatatcccaggggaaggtttgtttacgtgccaagaaaaataatcgaatttttgttacaaaaaatagagacaggtaaatacagtggctag

SEQ ID NO: 197 - DNA, 2232 bp, Chryseobacterium sp.
atgaaaacaaaagaagaactaaaaaaatatttcgaaaacggagatatcccggtacaggaagaattctgggagtggcaggagtcatactggcataaagatgaaatgattcccttaaaccaaattgccaatgttgatgccgtaagtgtcggaggtctgctggacaatataaaaacaggaggggtcagagattgggttctgggctcttacaaagccggagaagttgtcagacatcttaatattttatggaaagctaaaatagatattacaagtgcagttcccggtaataatgctaattgggagatttattttccgtttcctaaatcaccgggtatattcacatcacattccaccactttaacaattgatactgttactaacacagttacattaattggtacctcaacaaataaacttattacaaatcaaggcgtatttaatgttagggcacagaccgttgatacctcggcaaatccaacatattatgcaattgtctataatacatcaagtacaaatgcaagagcggttacagtctatgataatgctgcaagacctttgggaattaatgattatgttttgttttatgtactcaatctaaattcgatcttacaggatgtttttggagctaaaggatatacgctaatcaataccacagaaacaaccacttaccccataaaacctgtagcgactgctgacgttttatataataaaacatttttaacctggcatgaatccagaacatcagatgaaaaattctggcttagtaaagccatcttagatgctgaattttataatgtaaaagacagtgcggtggttacattatacggactaggaaaaaatgttacaactaccaactcatatcttggttttatctatgcagaaagaggtaagtctgcactgttcttatatgcagacgaatttaataatgctttttctgccccttatgatcctgtactacactcaggagttaaaacctattttctcagatcaggaaccaaaagggaatccaatacaacgatatatggaaaagtaacaattgactggtctcaggttcctaatcagaaaagagtggttgaaagtaactcaggcgttaccaataatagtaacctaagcaggacgctgtataaaaaatcagaagtctttaataatcctttgggatttataaagtttgcaaagtcccgtagtttcaatgattattattctgctcctgcattagacagttatgcaggtccggatggatctggcattccaaaaaagccctatgaggattgcagagaatggtcattaaaatgggatgaacttgtcacaaatgtccctcccggatattcaattagtaaggaaacgcttacaactgatgtccctacggataccaatgctgaaggaaaactgccaatttatggatatacttttttacctggtaaactaaccgctggagaccctaccggaaataatgcccagacgttgccacgaattgttttaaattgttcaatccatggttttgaaaaaacaccttcatttgttgcttatgaactcatgaaacaagttctgacgaattggaaatctcatccgtttttagaatacctaagatttaatgttgaatttgttattattccgtttgccaatccgcacggatggaatgccggatccggtgcaggaacacgcaagaatttgaactcagtagatttaaacagaaattttccaaccttttgggcaggtggaggttctactcccgcagattctacatatcccggtcaggcagcattatcagaaattgagtctcaggcaatatataggtacatgcaggaaaaaatcactccaaacacaataatgggtatagattttcacaatttccatggtaccccccagacagatccgaaaaattacaatatggcatggattgtaaatcttggttctgaattaggccaaagttcagccaatattttaatgaaagaactgtcagcaaaatataaggcgaaatctttactaattccacaatctgatgattattgtatcggacagtcaaataactataacggcccgggctttagtggttctgctatgaaatctttgggagctctttatgcttcaacatttgaagtctgtcagaacttccgattcaatcccgcttttaaaagccacgacagtgatgctattacttttggtttggaaacatttaccaactatttaagaatttttcttgctgagcatttggaagaatacaacagaacaaaatag

SEQ ID NO: 198 - DNA, 2697 bp, Chryseobacterium sp.
atggcaaagattaaagatattatcgaatttctgaggctgaaccgaagaaatgaagaagcaaacaaaacacctgtcactccgaattatgttatattggaatcccttgatacccataaggagtatactgttagcaaagatgattttgaaaactttgataaatatataaggctggtaaatgtattgaatgattataaagccaactatatttatattcttgaaaccaatgctaataaaacattttacataaaaaatgcaagtagcaaatttgttgatattattactcatcaagtaaacaatgccgttactgaaaatagtcttaaacaatatgaaattgactttggttctaatttttatttttatgatacttctcaaaataatgtcgtgatctcagtcacacaattagctgaaattaaaatttttagtgacaccattaaatacattcctaatgaagagcccataaaaagcttccagaatgacgattatgcttacaattatgacagtcatgaaagtatctcacactctattttaaaaagaattgccgttgcagcatcatctcgttataccccttccggaatatatagctctgatcggatggtaaaacttacaaagtctgaagaaaacggaaaaatgtttctgattccggatattaaacatgataccttaaagggaaaatattttttacaatatcagttttggaaacccaaacaggatagtgaacaaaaaataaagcccttttatgctcctatcggagatgttgcaatgactttagagtttaactatattggagcttttctctcttttcttaatgaaactattttcagccagccaaattttaattattcatctgaaaacgatggaaaaagagaagaattcaaggaacagtttaaaaatattgttattgttcctttagaaaattatgcccttagagatactgacaaatattatcgggaaattattgaggttttttattatctgcacgaagatgtagcttccaccattaatcctaatataatctggaaactcatcaataaagcaattgaaaatgatgggcttactaatttttctattaacgaagaagatctatttataaaacttctggaaactcttttagcaacagaaggcagagaagaaaaattccttattcggttaaatgaaactatttctgttaaaaataccacaactgttttagaatatctatatgacagactgaatggagaaaatggggtcaagtttgtaaacctcatcaacaaagcttggagaaaaacgagatttgcaaagcctgatatcgaaaaaaatcctgaatttgcttcaacagatggtcctttaatgtttccttatgaatcagaaaagtggttgggcttatattttagcaatgctaaggtcagctttgaaaataattcaaaaaaagaacgtcttttaaacgtcacagttactactgaccaatataaaaaagttaccaaaataactcctaagggtgatacttatgaaactcgcgaaaaaataaaagaacatttttggtatcacccgttttatcctgtttatttaaaaaatgttgagaaacaagactcagaattgaaattagattccattgttcctgcctttgtactaaaagcaaacgaagataagcagttctggagcaatgtaattacgagtgcggagtatgcattggatgtggcaacaaccttatctggtattggtaatattacaaaattcaggtatcttacaagagttacccaactggcagaagtcatagagggaacaaatgccatttccaaagtagcaaaagccgcaaatattttacgctatgtgaaaggagcggcaggagtggtagaacttactagtggaagtataaatctgatgataaagattactggggccaaagataccgagtttggggaaagcctgagtaaggtacttttttacctagaacttataacattggctggcgaacttaccacttctatgaaaatggggctaaaaaaaagtgctaaagaagcaatagaagaatcgaatggtgctatgcgtgtaaaacaccctgagctttttgcagaactttatcgaattgcaggattgaaaaaagtataccaacatgtggacgattttatgaagacccggcctaagttccatgacctaaatttgataaaccaattgtggaaagaaaaaattgtcacaaaacttatttttccaactaaccttagaaaactttactttaaatatctggatgaatttccagagttgaagaaaggatttaaccaagctgagtttaaaactactattttcaatcaaggggaaaaagtgaaagaagtggtagagttttctttatctggaaaacgagaaaagttattgtctgcttttggagatcctcctaatttgccggaaaatacaattgatattctgagcgattatgagaattttgaaacattcgtaaaaggagcagaggactttggaggaatcccaagaaattatgacagtgaaataaaatatattttcaattttcttaaaaatcatattgataaaggagatgaatttattattgaaacccgaaatattttcaaaacctgcggaagctgtcgaagagaatttgtgatgttggaagattatcttaaattgcaaggtaagaaagttaaaattatcgtaatgagtgatgagacaattgaaggaggaagaatgttaagagataaattaaaaatcaaatag

SEQ ID NO: 199 - DNA, 765 bp, Chryseobacterium sp.
atgaaaaagttatcaatgttagtgttagccgtatgttctacaatggcttttgcacaaaaggtttcagattataaatatgtagctattccagaaaaattagaaacatttaaaaaagatagctttggcttggaaaatattttaaaaatgtccttgagcagtaaaaaatacgttgttttacctatgaataaagaagagtggccttctgatgctaaagaaaattcctgtaatgtacttattgcagatattcttgacagctcaagtctttttgttaataaagtaactttacagtttaagaattgtaaggacaaaattgtttttgaatctaaagagagttcaaatattaaagagtttgaagagggttatccagatgctcttaagaaatctttcataaaaatcccggtttctaatcctgtagcgctgctaccggcatctgataatattgctcagcgtacatttcctgaaacagttgtgccttcaacaacaacaacaacaacaacaacaacaacaactccggaggcgaataactactcaaatggcaagctggatcttcagaaaatacaacttgatccaaatcagtttattctggcaaagtctggcagctcagtgccgtttgcagttttcaaagcaacgtctaagaattctgttttccttgtaaagttatctgatggaagtactaccataggttattttgaaaacggaaatatcgtgattgatattcctcagacagatggtaaatatgctaaagaagtttttgcagcaaaataa

SEQ ID NO: 200 - DNA, 192 bp, Chryseobacterium sp.
atgaaaaagacagaattaagcaaagctaaaaagcttgaaaaaaaacaattgaaaatgattcacgggggcttgctggattgcatggaggctgttccgtgtacagagtttccttgcgaaacctatccacctggagatattagaaactgtaccatattttctccaagttgtgcgcagaaaatttgcagaccttaa

SEQ ID NO: 201 - DNA, 435 bp, Chryseobacterium sp.
atgaaaaaaaacgatcaatcaaaacaccgtatctgtatttcaaagataaaaagaactactattaaaccttacgatgattttcaatggacaaaattttatgaagacaattattctttttatgatgcatatcctggcatctcaatccaattaaatgaagaagaacttctgatctgttctactattattgacttagataattacagcattctgacaactcaaaaattgattacatccgaaaacggagttttagaatccggactcattatgcatgcagaaaatggattgtatggaaattttaagggatatggaaatgagaaactcacttttggaaaaatcattctggaacatggaaaaaccataaaatattttattgagacaagaaaagcatctatggttatgatccagggaattaagacattaattcaaattaaataa

SEQ ID NO: 202 - DNA, 414 bp, Chryseobacterium sp.
atgagcaacaaaatcacagtttctgccaccatcaatgctgatgcacaaaaagtatgggaatactataccaatccggagcatatcacacagtggaatttcgcagatccttcatggcagtgcccttccgcttccaatgatatgaaagtcggaggaaaatatgcagccagaatggaagcgaaagacggaagtttcggtttcgattttgaagctgtttataatgaaataaatgaaggtaaaaactttacatatactatgcctgacggaagagaggttgatgttgattttaaagaaaataacggacaaactcatctgaatgtagctttcgatcccgaaaaccaaaatccggaagaaatgcagaaaggaggctggcaggcaattcttgataatttcaaaaagtatacggaaacgaactaa

SEQ ID NO: 203 - DNA, 219 bp, Chryseobacterium sp.
atgtgtcgatacgctgggaaaacctataaatcacattatgcatgttttaaatgccggaaatcatttaagcaggcagatagtagtgatattttagctgcctgccagaaaactcttatagaggaatgccccggaaagaataacgaaattaaatattggtctgacaatattcagaaaataaaaactgaaattattggtaacaggtttgaaataacagtataa

SEQ ID NO: 204 - DNA, 1200 bp, Chryseobacterium sp.
gtgtacattgaaaaagtaaataaattacaagtcgtttttttggttctgatgctttatgggtatgaactggtatctttttttcccagtttgctgaatatggaatcatcaagacctgtatctgtagcatacagaatatttgtttttttattggccagctgggtaattcttaaaaataaaatcagaataacaaataaacaccttttaatatatactttttggttcctgtatttattacggttgctttatgattcagcattgacttcaaaaatgatacagtctcctattgtagattattgggctttctctgtagggatcattggctgctcattggcatgtacaacaaatttcaatcaaaatacaatcatatcagcacgaaaatgggtggtaattgttttatatattgttaatttatggggactgtataataacatcacacaacctcaaatagtaccggatgatgttttgataagagcagatgccaatgctgctctcaatactgtatctttcggtagggcagctggtgttatgttctttgtttgttttactatatttttagaaaaaaattcaacctggcagaaagttttactaggcataggaatgggcgtcagccttttcaacttgtttatggccggttcaagaggtcccttgttacagttagtaatagttattattgtatttttattaagttccagaaaacttattaagccgaaatatattctcttatttgtaattatggtagtaatactgatgaccctttttcctcaatacttaaacatttcagaattagtttttgaaagatttaaagaaacaggcttttcttctaatgatagtgaccggtatagagcagaattatttaaatcagcctggaatcagtttcttgatcatcccatctttggtgactcgattgaaactgtttttgaaggtacttatccccataatctgctgcttgaatccttaatgagtattggttttgtaggaggaataatgattattataattaccataatagcattcattaatgctattagatatataaaaattccctattataattggctgggagcaattttattgatggacgtgatttcatccaattcatcaggatctattgccaattatttattgttctggccattattggcatttaccattaatagccatattacaaaacaacaaaacggaaaaacaatacagacatga

SEQ ID NO: 205 - DNA, 1164 bp, Chryseobacterium sp.
atgaaaatattaatgctgtgtgatgcctactttatcaactttcagtatcaggaaaacttaattgcgaaaagctatattaaattaggatatgaagtggtagtgataacaaatacaaatgaaaaaattcttgactttattaatgatattcatgataattcacttcctgaaaaaattgaatatgataatggagttaaaatttacagagagccttatagtataaatattttacaccgggtaagacggttcaaaaatgttaaaagaattctggagcaggaaaaaccagattttctcttttctcatgatatacagtttaatatcggagatttggtagattataaaaagaaatataataccaggattattatggattatcatgctgatttttcaaactctggaaaaaattggatatcaattaacattcttcataaaattatacgaaaaagatacttctataaatataaaaagtatattgataaaatatatccggtagttcctgccagtgaagaattcctccataaaatctatgggatttcatataatgagatggaacttctccctcttggctgtgaatacgatgaatgtgaaaaatttagaaaagaaacggatattataaagcttaggagagaatatggtatttcacccaatgatattgtgattatcacaggtgggaaatttcataagttgaaacgtacagatttggctgtaaaggcagtaaaaaaaataaatcagaaaaatgttcatatgatagtattcggtacagcggataaaaatcatgaagagtacttaaaaactatgctggaagatgctgaaggtgctaatatacattttacaggatgggcagatagtaaaaaaatttatgaactaatggcaatttctgatattgctttatttccggccagccaatcagtactctggcagcagtcaataggaatgcatttacctcttattgctggcgatgctggagggcaggatatgtcttatcttaatcagaataataatcttataaaaatagatgctcctgatattaatgaagattttattaaagaaattttgttagatttaattctgaatcctgagaaaattgtatcaatgaaaaaaggagctgagaaaacagcgaaagagtatttagattattctattattgcaaaaagaactctaaattaa

SEQ ID NO: 206 - DNA, 1212 bp, Chryseobacterium sp.
atgaaaatactacaaataagcagtgaagtaaatatcggatctgtaggcagaattgccgaacagattggagaaaacatcctgaatgaaggatggaaaagctatattgcttatggaagggaagctctttccagtaaatctgaggtttttcagatcggaaataaactggacatttataaacatgttattttaacaagacttgcggatagacacggatttggatctggaagagtaacaaaagaacttattgagaaaataaaaaaaattaatccggatattattcatttacagcacttacatgggtattttgtaaatattgatatattgtttaattttttaaaagaagccaatttgcccgtggtatggacttttcatgactgctggtcttttacaggacattgtgcctattatgagttggtagaatgcaataaatgggaaacacaatgtagtgaatgtccacaaatttcagaatacccaaagtctatatggaaagataattcaaaaagaaattatcttgataagaagaagctatttacctcagttccccgtatgaccattgtacccgtatccagttggctcgaaggtgaagtaaaaaaatcttttcttaaaaattacaatgtaagaactattcataatggaattgatattcaaaagtttgtatatatcgaaaatgattttaaacaaagatataatattgaaaataaatttctaatattaggagttgctagcccctgggataagagaaaaggattaaggtattttatagaattatcgaaaatcttgtctgatgattacagaattgtattggttggattaagtaaaaaacaagttgaagctctgcctgtaaatattattggatttgaaaggacaaaagacgtaaatgagctcgcccagctctattccgctgcagatgtgtttgtgaatcctactttggaagacactttcccaactaccaatttggaagctcagtcttgcggaacacctgttattacttttaaaacaggaggttctccggaagcggtcagcgccttaacaggaattgtagtagaaaaaggtgatgtttccgggcttgtaatggctattcagaaagttcgggaaaatacccgtgctttttattctgaaaattgcagaaaaagagtcttggagttatttgataaaaaaaatgccttcaaaaattatattgatttatataaagaattaataaccgagaattaa

SEQ ID NO: 207 - DNA, 912 bp, Chryseobacterium sp.
atgaaaagtttattatcatcattatttttactgttgatggcttgcacatcaacttcacaagttaaaaataaccagacaaaactctattacgcattgggtacaataggaaacaaggctgacaattattttaaacagataggggcggttgaagtgggctttttagatgaaggacagttcatttccaaaaccggagataagtactatctgaacaaagaattgctggagaaagaaatcaatagaggagttcccgataaaaatgcaaaaggtattgtttatatagacttagaaatgccatttgaagatatgaatggtaaggataaaaatcttgctatgaaaggcatgaattattgccttgaagtattaagatatgctaaaaaagcaagaccaaatataaagtggggcttttatggattcccatttaccagtgtttggggaccgaataaggaattttttgatgaacaaaacaaatttgcgctcctattgaaagaatgtgatattttttttccgtcactatatactttttatagtaatcctgcagcggttcttgctaatggtaattacctggaaaataatctgactggaagtataaaattaggaattgcttataaaaagcctgtttacgtttttatgtggcacagataccataacagtaatgagaaagatggtatgaaggaaatttcagataagatatggcaggaacagatggaaactgttgcaagtcaaaatgtaaatggtaaatttgtagatggaattttatggtggggagccgatgcctatttttatgagagacctgaagcggaaaatatgagaaaagaatttaaaggaaccctcaataactttatttctcataatgatgagtcgataataaggaaagccaagataataaaagacgttttacaaagtaaaaaatga

SEQ ID NO: 208 - DNA, 150 bp, Chryseobacterium sp.
atggaaaattttgctaagcgattaatggatcaacaatatggaaaaggagaatggaataaaacaaaagcagatgtagggcctggctcggaatatcaaggaataaagaaatggggtgatagatcatttcaaaacccacctaaaaagaaataa

SEQ ID NO: 209 - DNA, 195 bp, Chryseobacterium sp.
atgacatactatatagattcgaacagttattatttgttaagatttttcaattgtaaagaacttaaatataaaagtttatggttgttttataatcatgaggacggtattcaaatgggtgatttttttcctgaccgaaaagtttattctttttttatgggaatatgccagtacagatattttaataaaaatagatga

SEQ ID NO: 210 - DNA, 2070 bp, Chryseobacterium sp.
atgaagaaaatactactttttacagcaatactatgctgtactttattttccagtcagtcattgaacactgattggcaacttactaccccatttttaaaaggtgaacgagtgatgaaaatggaaattttaccagatggaagctatttggtaaaaaagagaaatgaatatgatgacttattgattactgaaaacgatggtaaaacatggcgacaaatcaatgaaatgagttcagtagcagattttacaattcataataacaaaggatatgcagtaataggatataatctgataattacagactctaaattctctactccgggtatttcccatccattacctagctcatactttccccaatctttatttgttctgaatgataacacaatctttattagtactacaaatagcagaataatgaaatctactgatggcggggtgacatggaatgtgtatatgatacctactgtttatgcagacaaaattaccagtgtcttttttaccgatgctaatactggatactgcgtaaccgatgctacattaggtaagagttttatttttaaatccaccgacggagcagcaacatggactaaggtaagtgaaaccactgaaaaatttgataaaattatttttaaaaatccactcaatggcattgcaactcttactggaggaactacgagatatacactagatggtggtaatacatggattgatgttagcatcaatggactgagggatattaagatatataataatgaattcgttgcagttggacttggcattccaaacaaattatatagaacagctacaggagaagtatgggattcaagtcttatatacccttcttcatactatatctttacttctttggcagtaagcggaggaaaatttcttttgggtacagataatgaaacaagtgacgaaataaaccattctatttttaaaagtacagatcttattaattggattcctacaaatgtcaaatggattttacgcgggggcttaatatataataatgcctatgcatctaaacatttggcaacagtaggaggttatgtttcagtagataaaggaatgacctggaagtatatgcctcctaatgtacctactggttctttaagtatactttctaatggtaaaggaattggaatacgtaacagttcctatgaattttggagaacacaagatagcggtttaacatggactgcccaaaatattccgtatcctttaactggtgcacttgcaatgaaacctaatggagatttcgcaatggcaacaagaggcgacaatgcaaattcttataaaggatacgttactacttacaatgcatctacaggatggtcaactccttttgaagtagggcggcatgttagagtaatgaaatttgtagataataatgtaggatttcttcttactagtgaaaaaatgatgaaaacaattgatggtggtataacttgggctgtcattaactttcctggagtgtttgatcaaccccgggatattgtttttggaaattcgtcaagaatatatataggacagtactgttctgttgatcttggaaacacatggtttataaataataacatgacatcatcttttaaagattttgaaatttttgatgatggtattggttatggagcctataaaggtgatgtttggaaaacaacagattatggagtatcctggcaaaaaatactgaatacaaaattattatatttaattggagcgaatatgggaaagttcgctatttataaggactatataataggaacagcaccgtatggattttatgcattggatttggtaaatggaaccttgtcaaccaatgatgaaagaatagaaaccaagaatacaatgaggatttatcccaatcctacttcttccgttttgttttttgatagtaaagaacaaataaagaatattgttgttgcagatatgctgggtaaagtctttaaaaatattgatcaccccaaaggaacttccatagatatttctgatcttacgaaaggaacttattttgtgaaaattaccaccaataataaaacatactttgaaaaagtgattaaaaaataa

SEQ ID NO: 211 - DNA, 288 bp, Chryseobacterium sp.
atgattacaaaagaagaagcttataataaaattaaaagttatttagataaaaatattaattactcaagtattgatggcattgataaaattgcacttacgtcaaaagaagaaatgacttatccaatttcttatggaaaatacaaaggggaaaagatagatcattatgcaatttcctatggagagatttggggaattgaagaaagaagtatgggaattttaattcatgcaaaaacaggggaattgttatatatcataactcctcatgggtatttggatattgaagaataa

SEQ ID NO: 212 - DNA, 288 bp, Chryseobacterium sp.
atgtcattatggttatctactgttacctataaaaatcacaaaactgtgcctgtcaccggtataatattattccgaactttgaataagactttagatctaaataaaaatttagttctttatatacaatttaatcttgttgataaaagctttgctgatgtttttggcagagctttttttatgttttgttgggtagacgcaaagacgcaagttttttcaatgtttactgttttaaggcgcaaagattttatctccgataaaattgaatactcgtttgatttctctttgtag

SEQ ID NO: 213 - DNA, 165 bp, Chryseobacterium sp.
atgattaaatatattttttcaatactatgtatgatgggattcttaaatagttacggacaaaaactatataaaatagaaaaagatcaattcggggaacctttattaaataataaagcacaatattcatttacaggaaaaccttctggagaagatttaaaaaattga

SEQ ID NO: 214 - DNA, 231 bp, Chryseobacterium sp.
atgtattttggaaaacttaatgagcagagaggaaaaaactctgtttattatggggaaaaatataggataaaaaataatatcatccaactagaacaatttggaaaatctccagattcaaaaaaatggtataccaggagaataactaatggtagaatagatggtaataagattatttttaatgaagggctagtttctgtttttgaaaaaagaaaaaatttgcccgcaaaataa

SEQ ID NO: 215 - DNA, 954 bp, Chryseobacterium sp.
atggggactgtagaatcttgttcttatcaaacagtagatatgtatttctcttgctatacaggagaccataaccagactaatgaaagtacttggggcagttgcaactggcaaagtcagggaggttatcctgcccaacacctaaccgtagtagcattagtctgtacagctagcacagctttaggagatgacggtactggaggtggtggtgaattaggacccactacaggcttaggaagcggaacaaatgatggaactcctacaaccccgactctcacactcccaaaaaatacaccttgtggaagaataaaaaaatctactaataatgaaaaatttaaagctaacataaccgaattacagaagaaaacaggtttcagctatgaaaatggttatagattgggaacatctcaaacaggaacagaaaaccaactcttacaaaatatgcctggaacaaaacaagtcgacgttaggtttttccctaatacatttgcaatacaacatactcattatgatggtttatatccaatattttctccaggagatattttgcaatttaataaatggatagtttgggcgaatggtttgaataatacaccaacaagtacgtctcaaattcctttaaatgaacttacatatacagtagtgactagtaatggtaattatttaatggcttttgatggtacagatgttgtctctcttcctaattatacagcagaacagtttgaagagttaaacacaaaatatattgattatcttagtagtgctgtgaaggtaacaaatgtaagtcaagaggttatatatgatatggataaattagagaaagagtttttaaaatttatgaaagataaaatgaatatggttggatttaaactctttaaaattgatagcgatggaaccaatatagaaatttaccttgaaaacggaagtagaaaaacaagacaatgtccaaaaatataa

SEQ ID NO: 216 - DNA, 567 bp, Chryseobacterium sp.
atgagtaaaacaaataattattgtgcattttatgttagtgaaccatttaatgaatcatcacttggagctcacgcaaccaaagatttttgttattacaatatgttgaaagcatggaaaggggctgacagtacatttccattcaataatgctcatgatacaacatataatgttcgcgataatagtgattgggaatcaacattaaaaccaaggcttcgtgaaagattaagaaattctaaaaacattatcttatatttaagtaataacactattaattctagagcattaagggaagaaatagattatggaattaacaacttagaattacccattattgtaatataccctgattttaaaaataaagaagatgtactaaattattccaaaacagaactgaattctacagtaatttctttatgggataaattaccaatttttagagattcaaaatttaaaatacctgcattacatattcctttaaataaagaaatcattagaaaggctttaaatgacactgatttaagggtagggtcaaaaataaaaaatggtgattatttttataaattataa

SEQ ID NO: 217 - DNA, 843 bp, Chryseobacterium sp.
atgaaagtaaatttcttagacaaaaatattagaaataaattctggatttatttttcagtaatttcaggtattttatcattcatattgctttttaatatagttcatgatgaatacaaagattatttaagatattctggatatatattatttgttgtcttgatattaatatatctaataatttggtgtaaagcaaataaacttactgatataaatatagatatagacggaagtactgtaaatattaaatgtggtgatttattttcagaacctggtcttaaaactattccatttaatgaattcttcgatacaatagtagatgataaaattatatctaacagctcacttaatggaatttttataaatcgtttttttcaaaataaaatagctgatctcgataattttcttattaataactcagataattcggacatcgttgatagccaatatcgtagagcaagcggaggaaaaaatgtaaaatttaaattaagtacaatttttgtttatcaagactttataattactgcattttcaaaatttgatgaacacaatagagcaaccttaacgatgcctgaatatattgagtttttgattaatttttgggatagagttaatcgtgtttacgctcaaaaaaatgtatccgttccaatttttggttctggtattactcgtataaaagaacataaaaatattggtgatgaagatttattaaaaataatgctttggacgtttagattgagtgaaatgaaatttgcatatcctgcaaaattaacaattgtcatacatgagaaaaaaataggtcagattaatttatttaatttgaaatcaatggaattaggcttatag

SEQ ID NO: 218 - DNA, 312 bp, Chryseobacterium sp.
ttggttttaccgaaagaacggatgtatgtagaattaattgattattatcccgcagtgagtaagaatcaatctaatttctatattgttaaaaatatacataataatgatacaattttcgttgtagatataaataatttaccagtttatgattttattaaaaattatgaaggggtaaataattctacaattactttggaaaaaggaaattatgttaataagaaaaaggaatatataatcagaattcctgtaaaatacaataaaataaatagtaagaaaacttatctcggtgaacttatcaatttagttgactaa

SEQ ID NO: 219 - DNA, 195 bp, Chryseobacterium sp.
atgaaaagaggattaaaaatattacagtttatttgtattattagtaccttatttttcggattatatttattaattgcacttagtagcagtcacaatatcccctttcagacttatttagggataggaatttcaatattgttgtccattgtattctatttcttgattgaatttattaaaagaagaaaaggattttaa

SEQ ID NO: 220 - DNA, 345 bp, Chryseobacterium sp.
atgttatcactcgattttcatcttcttccaaaacatatgggtagatttttgtttcatacattaatcattttctgtataaattttttatattttttactagtatattataatgtttttaaactggacagatttattaacgtatctaaagttaaaaatagtgttactgtgatggagaacatgatgatcattgtatatcttattcctgtttcgctttcttatatgtactatgttatttttatttatcggagagaaaacttattttttaagcttagtttttttgtgttggcatttgcattatctcaacagccgtattcttactggataaaaattatattaggtaaataa

SEQ ID NO: 221 - DNA, 168 bp, Chryseobacterium sp.
atgccaaaattaataatcgttcctaaaaataaggaagctgaaatagctttatattatgataaagtagagtcagaacacattatagaatggaatgtgtccaatgaagaattcaaaagattatggattgaaggtgttttttctttgatcaataaagtattcagggactaa

SEQ ID NO: 222 - DNA, 1230 bp, Chryseobacterium sp.
atgaagctagcaaaaaatatcagtgttgaagaactaaatactaaagcctgtcagacagaagttctcaaaaatattgaggatggggaagctgtattaactcattatcttcataatatacataatggattgtcctcgcattataaagaagatgccatgcaggtaataaaaaactatttagaatacaaacaggataataatgtatcgatagttgaggaagaagctattcagcagtttttatttgaagtagaaaacgttccttttcctacccctgaaaactattcatttaaattcattgatttatttgctggtataggtggttttagaattgctatgcaaaattctggcggaaaatgtatttacacgagtgaatggaataaagatgcaaaaattacttatagagaaaactttggagaaacaccttttggggatataacaaaagatgaagttaaaaggagaattccaaatgaaagaatagatgttctttgtgcaggttttccttgtcaggccttttcaatagcaggttatcaaaaaggattttctgatactagaggaaccttattttttgatattgagcagatcgttgaaaaacatagaccgaaagttgtgtttttagaaaatgtaaaaaatctagtatcccatgataaaggaaatacatttaaagtaattattgaaattttagaagaaaagcttggatataaggctttccataaagttctaaattcaatgacgcatggcaatgttccacagaatcgtgaaagaatttttattgttgcatttgatccggatcaggttcctaactatgaaaattttgaatttcccaaaaaaattaagcttactaaaacaattcatgattttttagagaaaggaaaacaagatgaaaagttttactatcctaaaacacatcagtactatccagagcttgaaaagacaatgacaagtagggatactgtctatcaatggaggcgtgtctatgttagagagaataaaaataatgtttgccctacattaacagctaatatgggagctggagggcataatgtcccattaataaaagatgattttggtattaggaagctgactccaaaagaatgttttgctttccagggatatcctatggataaatttatactacctaatattgcaaatagcaaattgtatatgcaggcaggaaattcagtaaccacaagcttggtagaaagaattagtaaacaaattataaaagttttgtaa

SEQ ID NO: 223 - DNA, 153 bp, Chryseobacterium sp.
atggattcctacggaatgacaagcgttgtggatagattaggggaatggttgatattatgtctggagaaagtagtaagctatacacccacatatacgcgcccaccttgtcattccgcaggaatctcgatcattttatttaagtcatttaattga

SEQ ID NO: 224 - DNA, 6603 bp, Chryseobacterium sp.
atgaaagcttatcataaaaggatgaaagtcttttcatctattatatcctgtatatttatactaggatttgtaccattgctctcaggacaaaatttccatgatactaaaggcaatattgaagtaaacggagcgggccaattacaattttctttaccagttgccctaccgccgggggtgaaatctgtagctccacaagttaacttagtctacacaagcgggtctaataatggaattgcaggctatggctggaacctttccggtttaacagctatctcaagaaccggaaaaacagtagaaaaagacggagaatctaaaggggcacagctagattattcggattattatagtttcaatgggcaacgtttggttcttaaatcaggagaatatggcaaagatggtgctgaatatgttacagaaaaatattcaaatgtgaagattaaatccgtgggaacagcacaaacggcaactcctcaacctatgtattttcatgtaacatttgaagatggttctcaggcgtggtatggagacattcaggctgatgatcctgagctcaattctttgaacgggcgaacttccattgaatacaatattgtaaaatggaaagatcctcagggaaattatattatttattcatatgattataccacagggcagatgcaaggccgtgtaagcagaatatcttccatagaatggggcggaaatgaaactttaaacaaacctcatttcaacaaaattaactttaactatacggacagaagcctgattgaagatacttatgtagggggatatcgatttgtccagaatcaactgttatctgaaatacaggtaaatacaaacggaaatctttttaaaaggtatactgttaattatattaaaaatggtacaaactatcagcagattgataaaataacagagtacaatgctgataacagtgctgccaatcctataacctttacttatccccttccgacacagccggctttggagttttctaataataatgtagacagcttcgataatgtaagattaactggtgattttaatggtgattcttatcttgatttcattatgaataatggcgttgtgaaactcggaggtctgaatgatacttttactgatgtttctactggaaaagtcttcaattcagatgctaagattgtccatacattactagatgaagaaggacaggtttataacggaaatggaatcgttcagtatgaaagtggtaaaataaccggctatattttcagagacaatacctttgtaaaagtctttgaaaaagcattgtttgatccttctacctgcacttcccaaccaggtggtgtaggatgcagtacaacagtaagtctttttaatgaaggagatattaacggtgacggcatttctgatatatttgtgaccttaaaacaaaggatatgtgagtttgtacaaattcccggctgtactgacatagaccctgttctgtcttctgcgagcaagaatgacggagacggaataatcaagccgccgctctgtcagcaattacaatgtaattcttacgaattaggcaattttattgtagatctgaaaaatgcaaataacccattaggtacatatgttcttgatacaggaattaatcaaaattcctataccaatcaaaagtatctggatgtggatggtgatggaaaagtagatattattgacgtttctaattctacctatactgtatttgaatttattaaaaccgctcctgatcaatacctcaagaagattaaatttttcggtagtctggcagaaacaaaagcctctgaatatcccgtattattcggtgatttcaatggtgatggaaacctcgattttaccataccgaccacggaaacaaaagaaaaagataactggagattctatatgggaactgaaaagggattttcgaatttcttaaaaacagactttttgaagtacagaaagcctgatgattataaaaacagctcgtatcctacttttaatatttacagaaacttttattcggcttctgatattaataaagatggtaaatcagatattatacacatcaactcattcaataaggcaggccaggtaaattcaagcggcatgattattacaagatattttggttataatattgccacttatgcagctaatggtgtcctgaccaacggaactccggatttttctgccgctaatgactttggaggaacaaattatgtaacttttaacgtaggtgaatttactttattttcaccaattacctcgcaggtaaaagtaaataacaattactatgatgtgctcttattctggaaagagaggatgcataaacttaaatctccttcttctgttgcaagattatcacagatacaatcaatcacacaaggaggaatcactacatcagcagattatcttgaaatcattcctaataatagcttaactcctggtttttatcaaaaaattaaaaaagaatattacccttacttttctttaaacagaatggatcaatcttatgctgtatcacaacttagacaagaaggacggaagcaggatttccgatacagaggaatgacaggacatatgcagggcaaaggaatgatggggtatcatcaatctgcccgctcatcatggtatgctgacggatttgaaaacattaaagtgtggtcaggtgcagaaatagatcctctttttgatggtgttcctgtaaaagaatggagtatcaaaacaaatgatgaatcaaaaatattccctgtagatctgtctgaaaacaacacccagcttttaagctttaaatcgacagtataccagacggataaattagtaaacggacaagtaataaccggccctgtttctgatactgacaagccaaatcttgtaacggctactgttgctaaaaataccagaactaaggatttcctgacaggtacattaacaaacacatctattacctatggagaatattatcttccaaagcaaagtgttaccaatgtaaataacggttatgccataaccacttcaaaccttgaatatattcataatttatcaggtagcggatcagattatttttccgggcggcctcaatctaaaacagatattatacaggcctatggggatacccaatcttcaaaagaagaattcacctatgagaataaccttccgaaaactctaaaaaagtggaacaggaatactacaggatatgtgcttgaaagctataattatgatggtttcggtaatattactcagaaggtagtaagcaatagcatcgattcacaaacacgcacagaaacaaatctttatgaacctaaaggaagatttgttgcaaaaaaaacagatcatcttgcactggagactcttattgagtacaacgattgggggcagattacaaagcagacagatccattgggaaatacacttaccaacacctatgatggttggggaaaactgctaacctcctctaccaatctgggaggtacaactacttatctgtacaatagagataataattctaatattactcttacgcaaaatgatcccgatggtaatgtatctaaaaaatacaccaacaggcttggccaggaatacaaaatttctgcaaaggctttcggacaggggcaatttatttctaaggacattcaatatgatgtgttaggaagaaagctcaaagaatctgagccttattttgaggggcaaaacgctacccaatggaataccattgcttatgatgattctgtatttcctatcaccaaagcaacagctactgcatttaacggtaagaagatggaaactaccgtttcaggtctggtaacaaccgtaaaagaacttaacggctatggtagaaccaccacaaaaattcaggatgctttgagcaatgtcgcttctaccactgataaaggaggtacaatacaattctcttataatgcctccgggcagcagatcaaagctcagtatgcagaaaatattgttgttacgaaatatgatgtatggggcagaaaatccgaatttaatgatccttctaacggtctttacaaatacgagtatgatggattcgggcagataaagaaaatcataagcccgaaaggaaccaaagaatatatctataattctttaggccaactgatcactcaaaaagaactttccacaaccgataacgggcaggcaaccaataagacaatttcttttacttacgataataaaggtaagcttatctccaaatcaggtactctaaagggacagttatttatctctaattttacctatgattcctatggaagattgttatcatcttctgaaaacagtaatggcagaagctatatagaaaagggtattacctatgacaataagggcagaatatcctcctatgaaaaggaactgcagtcttcggggataattaccaaagctgagattgaaaacgtatacagtacatggaacggagaattataccaaataaaagataaagttactgggaaaagtctttgggaagttaaggaaacaaatgtcaaaggacagatattaaatgccaaacttggagctgctgatatcaataatacttatgattctgatggtttcttaaccaatgttaaccattcatcagcagtaaaaccaaatattctgcaattatcttattcttttgacgcgataaagaacgagcttaagagcagaatcacaggtggagactttaacattgttgaatcttttgattatgatgataacaacaggctaatcaactggacggaccctgttacgggaataaagccgtcagccatcagaaatgtctatgatattaagggaagaattacccaaaatgatcaggtaggagacatcaaatttgaaaattctgaaaaaatataccaaccgacaggaatgaccttaaatgcagctggtacacagaattacaacggtgatcttatccaaagcataatttataatgagaataacgatcctgtaaaaattaatggagagaaagcccgtataagctttgaatacggattaacaagcatgagacaacgtctcgatattgataagctggttcaaattggaggcggaggtggaagttcagattctaaaacaactggagtttgggatcctaacgcgccattatggcaaagaaccctaactaaattatataacgaagatggcagttttgaggtaatcagggatcaggctaccaaccaggaaaagcatattttatatattgccggcactccttatgagtccaatgtcatctatgttaaagattataatgaaagcaatgcctcttacagattccttcataaagattatataggaagtattcttgcgattagtgatgaaataggtaacaagcttgagcaaagacattttgatgcctggggtaacttaacacatttaaaatcaggaaatgacactactataacagatcaggctctgatccgtacctcagcattatttgttgatcgtggttataccagccatgaacatttaatggatgttggaattgtccatatgaatggcaggttgtatgatcctctgctaagaagatttctaaatgcagatgaaaatatacaggatccttataatactcagaactacaataaatatggctatgtactgaataatccattaatgtataatgatccaagtggggagtttcttcaattcttagccatcccaatcgtaaaagcacttgtttttgctgttgtatcctatactgccacagttttgattaccggtgcgaagtttaatatcctgaatttatattctaccattgtaatgagtctgataagtgccggaataacaacggtgataggagatgtattttccacagcctcagcaaccatcggaaatgaagctttaaaaagtctagtgcatgccggtgtgcagggaacattaagttttatgcagggaggtaatttttttacttcagcagcaagcgcattttttgctagctttgtatcttacggatatgcaaaagctgtaggatctgcagcatatagtggtgtaggtcaggtggcattcggaatgctcgctggtggtgttggctcctctcttacaggaggaaacttctgggaaggagtcaaaattggaggaattgtagctttgtttaaccataccatgcacaaaattactgataacctgaccattgataaagctaccaggaaagagttcagaaaattggtaagagcaaagaactatcagggagcatttgatctggtgaatgcaaaatatgatttagatgcagatattaaaggcaagtataccatgaaatatgaagacagcaacgagttttcaggattgacaggcggagaggcttttgaaaatcaagaagttaccattgccacacatgtctttaaaagctctgtagctgtttttataagggttgttcaccatgaatttatccatgtttaccaaagaggtgtcatgggatttgcaggaaatttaaacatttatgaagttagggaatttcttgcctaccatgatacattatttaatgacaagttgcctaaagcaacgttttcaggcatggaaggatattggaataaggctaagcaattttataaatacatgacggacaatcctgcacttatcaaggcatatcagtctcagtataatgattttgcaaattcaagtttttttaaataa

SEQ ID NO: 225 - DNA, 453 bp, Chryseobacterium sp.
atgtacaagtttctattactattttttgtaagttttgtgtccgcacagcagacctgtaaactatctttttccaatacaccgctttcggaaaatggtgaaataatgtttacagttaaaaatttaaacaatgagaaaatacatgtaccaaagcggtattcaggtatatgggccagacctatagatattcaggtatacagcgatgaaaaaagagaatttcaggatacaaaatacagctttgacggggcaggctgtttagacacaaaaaaatgtttaggacaaatggaatgccttaaaaatggagaatccaaagaatataaggttatcattcttccgggaagaatttcaaaagcttttagggagaaaaaaaagtatagatttaagctggcttttgaaacctatcttttcagcggatgtgctgattataaaacagattggctttattatcagaattaa

SEQ ID NO: 226 - DNA, 903 bp, Chryseobacterium sp.
atgatattaataatttctgataataatgatatttctactacggatgtaataaaatggctgatagtactggagaaaaaatttatacgtatacatgaggatgaaatatttgaaattaaaatcatcaaaaaaagattttttttagaaagttcttctaaccgattttttttagatgatataagcagtgtttggtatagaaggggaggattgaattttaagcgtattcgatataaaaataattccattaatatcaacatgaacgaaactcagcactggctggaagattatgtaaagaaaaaacttgaaactataaaacatatcaataaagagagtaatagcttagtaaataaactattagtattagaagaagcagaaaaagtcggtttagatgttccgtcctattatctggctgaaaatactgatgatgttattttaggagaaacgattgtaaaaactattgcaggaaacgcaatgcttgaatctttttataaaaattcgaatggaatgatgttcacatctgtagttgaagaatttgaaaatgaagacttctttcccactttttttcaggaaaaaattgaaaaggattttgaaataagaacattttatttaaatggtaaatgttggtcaatagctatcttttcacaaaatgatgagcagactaaagtcgattttagaaattataattatgaaaagcgtaataaaaatgtaagatataacctaccaaaagagattgaagaaaaagttcatcagttgatgcagcttcttgatcttaactgtggttctcttgattttatgaaaagcggagagaaatactattttttggaagtgaacccaatagggcaatttgggtatttatctaaaatatgtaattattcattagaaaaagaaatagcagaatatctatga

SEQ ID NO: 227 - DNA, 912 bp, Chryseobacterium sp.
atgaattataaaaaaatatgtattaagataagcggagttattctattaatcagtttttcttttttaacatcctgccgaaataatcaacatgattatattgcatattacaatagtgtaaattctattgatagtacttatagattaaagaatgatactcttgcggctattaaaaaatttagaaaactattccgtaaatatcagccgagaaatgatgaacgaatggaagaatatgaaaattatattaagttttctgataaatacaataaaaactttggaggaaaaaaaagtctttataaacttatcccgctagttgctccatactggaagttcaaacgagaggacaaagatttttttaagctatataaaaagtatggaatcgatagtataactgttgagcagaaagttacagaatggaaaaagtctctaaacaaacagcttattgattcttttagaatagcttttatcagggatcaggctaaagattctataacaggacaacaatcattaaaaaatttcaagaaaaatgctgaactactaaaatggactcttaataattatggttatccgtctttgcaaaaaattggacttgaaacggatgatggtgttttaatgccaatgttagtttatttaaatcatatgtctcaaatagaagattatgaatatttcaaaacgaagttggtagattatgtaagatccggagatctcccaccaagagattatgtagaaatggtagaaagatatgttcagattaatcatttaaggcccgtatatggcgtgaaaagtactgatgaagaaatcataaaggattcagcaaatatcaatcgtaatagaaggcttattgggctacaaagcttcaaagttagaagaaaaataacaaaagaatttttaaagaataattcaagtaaaaaatga

SEQ ID NO: 228 - DNA, 189 bp, Chryseobacterium sp.
atgaaaaaactaaatggaatgaagaatttctcttcattagaaaacaaaaaattaaatgatttatcaaaaatcacaggtgggttaatggcagaaacaagtaagcagtggacttatgaaacaggaagtggaagcgatacaggagtatatgtagacaataagctagttgctgttattacagaacctgcctaa

SEQ ID NO: 229 - DNA, 1074 bp, Chryseobacterium sp.
atgaataatgtagatttttctaatcattcagaatttaaaatgatgtttaaagatgaagagttaagtaaatatttatttttttattctggtactattattatgcttggagatgaagatattcaagaagacgaaataaaacaacctatttctctaatcaccacagataaaacaggagaatggaaaaagtataaagttatagataaaacactgttatttaattgtaatttagaaattgaacacaagacacttaaatttaatactaaggaaattaaaaataaggattttgttaggattaatgcttactataatgcgaataaattaggagcaaaatttcatcacagaattattaatgttaatagtgtagaagtaattgaagaaaaagaggctcctatatataaattttatataatttttttttccattgttttactatttttagccagttccattatggcagatttttttccttcagataaaaatgaaatgtatagtagtaaacgtttaaattataaactagaaccacaatatacagctataagtaattttgaaccaatgaataaaaaagattcacttagagcgaagagacataattataatgacttatatattgtaaatggcgagaaattagaatctgattccatatttgttattaataggaagcttaataataagaaaaatgcttttagaataaagaacgaatataaaaaaattgatagtactttcaaggataggactagtgaatacgataaattcagaatagacttggaaaagcagttaattaaaaaaaaagattcattatactttgaaaatgattattctatatcagataaaacagacactattatttacggtcttcttaaaaaaaatcttagtataaataaaaatgtaaaatataaaataaatgatactatatctgtttcatttgtaaaaaaagcagacgaatctacaaaacagattgacactgcgtttttgataataaaaattatcttatttttatttatggttgttgttaatgttatattgatatttaaggtttatttactttataaatataggaaagttttaaatgattag

SEQ ID NO: 230 - DNA, 426 bp, Chryseobacterium sp.
atgcgaattaatatacataacactatcaaaggtgataaaacaatagatgaatggacaagaaatgatgaatataaaggcgcatcatggcgtaatttcgcttttgcggaaggcttggctttagatttgtttaaagaaaaattatcaaaaattccttttaaagatgaacctttaaacaaggaagaaacagaaaaattaaaaataattcttgaggataaaatcaaagaattgttatcaacaagaattcctgaaccggatgtaagaacaaaaatcgaattttcgggtaaaattataggtataaattttactcctttgggtaaaaaccctcaggataattggataaatattttttttagagcatacaaaatatgtgaagaatgtttggaagaaaataaacctatttatttaagtattacaggggaagactag

SEQ ID NO: 231 - DNA, 330 bp, Chryseobacterium sp.
atggaaacacttgaacttagagaaaccagcagtaaagaatggcgtaaagacaatatcatccgattaaaaacatatctcaataagaatactgagattgttgatcaggtacaggtacagtacaaacttaaaaatgcaaggcttctgtcagatgaagaatattatttggagcttttgatattggacgaaaaccaaactgaaaaattcaccgagaatatggtcaccaaagaactttttcctttgaatgaattgaaatgtttaacaactaaaaacaaagaaaatggaaaaactaatatctccacaaaagctattagaagattggagaacggatga

SEQ ID NO: 232 - DNA, 1497 bp, Chryseobacterium sp.
atgccaattataggaaaaattatacgtgtcaatgaattacctcccattggagaaagagaaacgaatgctatttaccaggtagcagctcctggctctctatcttacacggattatgccgttgacgaaaacggtgatttaaaaacccatgcggttgttgatggtaccattcccctggaattagctgatagccatgtcagcatttcaaatgcagatcttttagcagaaggaatagcaagccaggctaagtataatatcaaaacaagagagaaattagctaagaaactagagattcctctgacagatggaactgtccaggattatcctaaaatcataggattaaatgataatggaaatgttgctaaacttcctgcaggtgatttgggaaaaaatatagcaaactcctctttaactagtgtttctggtgcaggattaactcttggtgctaactggacccttaatgcttccggattttattattcgataaccgggctgagcgataaatctgcagacacaacttttaacagaatgatggttcaaaatccgtccgggcagctttcatggagtaacggaaaaaatatgatttccaattatcccctgctgctgaatgatgctgaaaaaactgagtggagaaaccgtatgaaactttctactgagaattattcaaccggagccccaagaatagatgtgttattgctcccgtttattgataattcaaagaactttattcagtacacaacattagtaggattaaatctctttgtagataatgtttctgccaacgcatatatcaaagtgaaaagagtaaaagacgtgaacggtatcaatctggcagttccagaagaatatagtgtagataactttacagtgatgcataactttcccaataatttgaattttgggatcaactggagtacaaaaccagaaggatattataaggtattcgtgacacataatgggttaacaaatgccagctcaccagaactcattgtaaaggcaggacttacctatagtaagtttacgggaattgctaattggactatgctaacaggcagttcaacaatcacggatacttctatatcaattgctcaaggctcatctgcacaaacggataatttaatttccatctcagatattaacgccggatttatggtctctttttcagttaataatagccaaagtaattttggtgctaatttcgtaggtcccttttctggcggaattcgtggagatgatggagtattttatggtttttcaaattatggaggtgatggaagctggatcatttatcagggagatcttttgccaatcagaaatgaaacctttcacattgcttattataacggaattgtatatgtaattgcggaaagcaatggcgtgacttatcagcaatttaattcaacctttaatctacagccaaggagattttatctctcaagaggaagtggcggccaagggtcactaacaatgagtgtacttggaaaaatattattgtcttaa

SEQ ID NO: 233 - DNA, 264 bp, Chryseobacterium sp.
atgcttacaggaagcgcatcaaaggggaaaatggggatctattataatgattatcattgctcaagctcatgtggtgttcactttaaagcagaaactgcaaatgagcttcttgtcaaacaacttaagtacctgattccaaaagaaggaatgattggtatttttatagaagcatttattaaaaattttaacgtgcaaacaaaatctcaaaatcaggaaagaacaagtctactgagacaaattgaggaattaaaaaaattgtactaa

SEQ ID NO: 234 - DNA, 846 bp, Chryseobacterium sp.
atgattgtaaaatcatatatgaataaaacagttttaatagtaatattaatatcaataacattgtcttcctgtacttctaatgaggattctcaagaagtaaacatggagattagtgctaatgatttaagtcctgataaactactgaagtcaattgtcggctttgatgaagatgagcctaatccactacacgattattatcaattgtttacttatgatagtcagggaaggcttataaaagctaggaaagattatgggtacatatatccaatatatacaaatctgtcatatatagaaaatactgttgttgtagaaaataaaagtgatgatgggagttcagttactcctaaaactattagatatgttttaaatagtaatgggaaagttattgaaaaatatattcctgttccagatggtggtaatatctatgatgtaagaaaatattattacgagtatagttccgatggtaaattgactaaaattacattgaagtatcccaatattactcctgggactccaaactattcttcacttggctttttagagaaagttgatatactcatatatgaaggggcaaatttaaagaaaatagtgcgtcagaatttgaatgattataatgaaaataaaagcactagagcagaaattaccttttttgattatgataatgccaagaatccttttaaaagattgggtttgctagacacttttttttatcgtagcctttcagaaaataattatcgagagataaaaactgaattatatgacgaaaataatatcaagtggggagaaaatggtggaaagtggaaattttcctatgaccaaaataataatctgattttaaagttttaa

SEQ ID NO: 235 - DNA, 603 bp, Chryseobacterium sp.
atggcatatcaacaagtgccatcaatacaaaaggggatgttgtcaattggtgatactcttccccactttcgtaaacaagcagtagtctcctcagaaaaaggacccaaaatcatagaactcccccatacttattctactgaacaagataaatggctaatctttttttggtggccaaaagatttcacctttatctgtccgacagaaattataagtttccaaaaaaatatggatgaattttcgcaacgaaacaccttagtacttggagcttccacagattcagaatatgtacatgctgcctggtgccaaaatcatccgggactgacaaacttatcttttcctatacttgcggatacctcaaaatcattggctgaggctatgggaatcttagaaaatgaagaaaaagttgcttaccgggctacatttattattgatcccagtggatatatccagtaccattctctatatccgatgaatgtaggtagaaatatcaatgaaattctccgtgttttagatgcattacagactgaggagcttaccgcttgtgattggaaccaggatgagcagacattaaccgctaaactgaaggaagaaaatgaaggataa

SEQ ID NO: 236 - DNA, 465 bp, Chryseobacterium sp.
atgagcgacacttgtatgaaccatattgaagatcattggaaagcattaacaatttcaaccaatgattattttaacaaaggaaattttcaacaagctttgtctggatacaaagatgctttttatagagcagaagtgctgaacggacatattttggattgcattcgattgaaaattccttttgtgcaggtatatattatttcttgcaataatcttgcaaatacctatgaagagctgggaaaaccggaagaaacagagaatatgcttaaacgggttatatactatcttttacatcttgccggaaaccagacactggatttagatgaaatacagccggagctaaaaaaagcaacccttacctacattcattttgcagaaaagatgaataaaggaaaagctaaacaagaaaagttgtttatgatattaaaagaacaactactggaaaaaaaaataattaaaatcaattaa

SEQ ID NO: 237 - DNA, 171 bp, Chryseobacterium sp.
atggaatatgcaatagaattattggaaaaaagcatgaagtctttagagcgaaatatacgccagaccgacatgttgaaaatgaatatgtctcaagcaacaatagaactgattaaagtaagcgagttgaaaaaagcaattagaattttaaaattaaaaaatagaaaacaatga

SEQ ID NO: 238 - DNA, 723 bp, Chryseobacterium sp.
atgcccttgggctatgaagcagacaataccggaaaaaaagttcttctggacagtcatggaaaacaatattattcgtattatctggatggaattgtaggtgatggtatggtaaattctagtcttgaagatctcctgaaatgggacagagctttgtataccgacaaactggtgaatgaaaatgataagaagctgatatttaatgacgtcactaccacaaacggaaaggcaagtaactatggattcggatggtttgttaaaaagacaaccaagtatgggaaaatagcaaatcattctggaggctgggccggttatacaacttttatagaaagacatcttgatcatgataaaacttttattctgcttcagaataacagtactcctgagataaagattcctactgatgatgtgcgaaaagttctttatcatgaaaagctaggcgtagaaaatctcaaaaaagcaaccccaacggctgatcaattacaggcatataccggagtgtactccactgctgacttcccgatgaaaataaaagtatttgttcaaaacggtactctttacgggcaggcaatggcgaaaggacagaatgcatttgaactggcagcctatgaaaatcatatttttaaatttgatggtgcaggcataagaatggcttttgaccttgaaaaacgtaagatggatttcagccagggagaatcttcaaaatacaccttttcgaaggagtaa

SEQ ID NO: 239 - DNA, 150 bp, Chryseobacterium sp.
atgaatgagaaggaggaagagatcatgcatggaaaatattttggtgtcggaactttttgtataaacgtaaaattaaaggaaaaaaatacagataacacaaatgttgctgcacgaatttcacgaataaaaggaggggaaattcattcataa

SEQ ID NO: 240 - DNA, 297 bp, Chryseobacterium sp.
atggaaacagtactttatccttttttttaccacacaaccagagcatctgagccagcagaagaatacataacagatgatcagttggtatttatcatagatggaaaggctaccttaaatacgacaggagggagatgcgattttaaacaaggtgatgtatttcttctgaaaaacaagcagtatatatcatatgtaaccgatactttaacaagaaaaggtagatatgaggccattaaactatcattaactcaagatctgctcaaagaattctttctgtattataaattggaaatcaattaa

SEQ ID NO: 241 - DNA, 282 bp, Chryseobacterium sp.
atggaaacagcattttatctttttttttacgagcaactaagccagcaaaagaatacataacagatgatcagttggtattttatcatagatggaaagactaccttaaatgcggcaggggggagatgcaattttaaacaaggtgatatatttcttctgaaaaacaagcagtatatatcatatgtaaccgatactttaacaagaaaaggtgaggccattaagctatcattaactcaagatccgctcaaagaattctttctgcattataaattggaaatcaattaa

SEQ ID NO: 242 - DNA, 1182 bp, Chryseobacterium sp.
atgagcataacttggaaatccccaaatattataataggtaaagaagctactggaaaattctactatagaagagaattatttgaaaacgaggtttggaaagaaattgagaaaggcaacaatgtgcttatagcagcgcctcgaagagtaggtaagacttcagtaatgaagttcatgacagaaaatcctagagaaaattttaaacttattttcagaaatgtccagggtattgatgatgaaactcaattttacaagacaatttaccagctgattattatctgcttgagcaaattcactaaaaataaaaccatgatccagaattacttatcaaaaatgaaaatatccgaaataagtacaactggaataaaaatagaaacaaaagatatagattacttaacagaaatcaatagtttaattccacaattagacaaagacggagaaaatattgtattacttattgacgaattacccgaagtattacataatctttacttgaaaggacaaaaagaaacagctttaaatatcttaaaaaatctaagacattggagacaagaagatacatttaaaaaaattcaatttgtattagcaggttccataggcattcattatgttgtgaatgctattgcaggtagaagctcagatattaatgatttatataaaattgtatatcaacctttaacagaaaatgaagttattgattatattacgtcagtaacaaaagacgcttctgttaattataatgaaggattaataacccatttaaaaagcaaaatacaatattttgtcccttattttgtcaatttaatgcttgatgagatagaccgaaccgctgttaaaacaaataatattaatatcactaaagaaaatattgatgaagcatttaataatattataaaaaataatgatcatttctcagattggaaaaaaagactttttgattatatgccaaaagaagattttctatttataaatgaaatcttaacacaaatagcacataatgaacaaataaatattcaatttatatatgacattgctataaaacataataaagaaatagtattcatggatttattaaaagatttagagcaagatggatatattgttgaagagaataaaaactatgttttcatatccccttttctaaaagaattttggaaacaaaacaacccaataaaaaatgcctag

SEQ ID NO: 243 - DNA, 2823 bp, Chryseobacterium sp.
atgcctagcaaaacaaataatcaaataagtaattggtttattgatcaattaaacctttatcaatcagcaaatagtgattttgaatcaatcaagcgaaattttattatacgtgaagccgaatttattatcatcactcagtcattattgaataaagacagcaatgaccctttacagcatgaacttattctagggcgaagaggtagtggaaaatctacacttttaaaaagaattgaaattgagattacggaaaataaaaaattaaataaaaaatatatacctataaatcttgcagaagaacaggctggaatttatcgtctatttgatttatgggagcaagtaatcgaagagctccaacatcaatttaaaataattgagactaaaaaagattttgaagattttgagactacacaggattatacaagacatttgtatgatgtgattcatacagcttgtattaaaaataaaaaaagaataattctgttgttagacaattttgatagaattgtagaaaatttcactgatgatggcaatttactccgagaaacattaattaattacaatgatatagaaattatcgcaggaagcacaaggatggatgaacatttttggagatatgatatgccattttatgaatttttcagaaaacatagattagaagccctaagtagagaagaaatgctactccttctgaaccattgggcagactctctcgatattctagaattaaaagattttataaaaaataatcctggaaaattagaaaatattagaattctcaccgatggattgccaagaactttacaattttttatacagatagtcttacaaaattcgcacgcctatggttatgattacctaaaaaaaatcatggatcatgttactccactttatcaggaaagattaaattacattcccgctcaactaagaaaaattgttttggaaatggcctttatatgggaagcatgtaccaccaaacaattggtggaaaaaacccgtatggaaagcaaacttatatctgcaaaccttaagacattaatacaaaaaggcattgttgataaaatagagacatctaaaaagaatcatctttataggatatcagagcgtttttttaatatgtggctcatttttacccaaggtaatcctgagcaaaaaagaaaagctaaatgccttagtgtttttcttgaaaattggtatgattatcaagattttaaaacattagcaaataatcatatttctttactaaaagataaaaaaataagctataatgaggccctaatcttatctaaagccttgagccaaacaaaatatatttctatagaacaaagggatcttattttagatctaacagaaattattaatgataataagataaaagatactttaattcatttacctaaaaaatcaaaagagattataaatgaaataactgaagccctaaagaaaaacaattataaaaaatctatagaattagcttattctatagaaaatgaagaggatggatttaagttttatttgttaggaactttataccttaaacaaaatatctatacggaggccgaaaaatattacttgttagcaattgaaaaaaagaattacaatgcaatatttaacctagcaaatttatataaagctcaaaaaaaatattcaaaagctgaaaaatattatttactagctattgaaaaagagaattacaatgcttccttcaatttagccaacttatataaaaatttaaaaaaatactcagaagctgaaaaatactatctgctagctattaagggaggaataaataaagccttaaataatttggcaaacttatataaagcgcaaggaaaatatactgaagctgaaaaatattatttactagcaatcaaggaaaaaaataataacgcattatttaatttagctaatttatacaaagcacaagaaagatatatcgaagctgaaaaatattatttacaagctatcgaaaaaggaaacaataatgaagcattaaacaatttagccaatttatataaactccaaaaaagatatactgaagctgaaaaatattatttatgggctattgaaaaagaaagtaataacgcattattcaatatagcctacttatatgacaatcaggaaaaatttgatcttgctgaagaatactatttattagctattgaaaagaaaaatactgaagctttgaataatttagccattttatatcacaatcaagggaaactcgaacttgctgaaaaatattatttatccgctattgagaataacatggatagagctctaaataatttagctcttttatatgacaaacaagaaaaatacaaaaaagctgaagaatattatttatatgcaattgaaaatcaagacaatgaatctttaaacaacttagcctcattatattataatcaaaacataaataaagagaaagtagttgatttattaataaaaaataatgaaaatcctcgaaatttaatcattgctgaaatctggaatggtatatttaaagatctagaaaaaagaatattttctatcataaaagacgacagcagtgaactacagaattttataataaatctacttattcatcaacaaaaaaacttggttttaaaattatttaaagatcctgatttagggccaattttaaaagaaaaatatgctatactatattatgtttgcatgcttaaaaataaccctaatgaagaaaatttagacttaaagatacctccagaaatagaaaatacaatacaagaaatcttacaaacaataaataccaaagaaaaattctatggttatacaaaccatgaccatccaagacctaaaaaataa

SEQ ID NO: 244 - DNA, 690 bp, Chryseobacterium sp.
atgataaaatacctattcaatatattatttatttttttgtttagcctatcttcatatgctcaaaaggtctccatattaaaagattcggtctgtatttctaaagaatgttttgagctgcaggaattaaaaatagacactaagaataccggaatttataagaaaattcaaaaaagctatgacctttttaacggtacttttttcaacagtccggagaaaagattgaatgcaaaaaaagatactttaaaaaacttaatttcaacaaactcgttacgggacaaccaattcggatttgaaaaatataagatttttttgaataaaaatggattgttgaatatatcagtacacattcagtcttatggttccccgtgggaagatacaatctattatttctttgatgaaaagaatgatacagaagttggagaaaacttattcatcaacaaaaagatacttctgcagctgtgtcgcaaaaaaaataaagaaaataatgacatgtcctttccgataaaaaatctcagtcaatacaaaatggatacaggggcaacagggaatataacaggtatagactttattttttatgatcaaaaaaatagaaccaatagcggttatcctggatattcagtttctttcaaatggaaagaaattgagaaatttattgcgccacagtataaaaaacggttgacgaaagactaa

SEQ ID NO: 245 - DNA, 801 bp, Chryseobacterium sp.
atgaatataaaactttttgtttatagttcaatgatactaataactggactaacttatttgcttttagaatatgattttacaattttaaaaattttatctttaggcattcctattttgtccttaatatatttgcttctaagattatcaataaaacctgtagaaagagtcgtatttattttctttaatgaacgaattacagactataacaaatacattgaaaaacctagattattagtttacattatttttatccccatattagtttttgtaatatattatataggagacataaataaatcagaaagttattatctcaagttattaaaatttataatttataattcagcctcttttctttgcattttattcctgcaatttagctggactaaatattttgttgatggggtgaaaaacagaaagtccaaaattgaatataaaaatgaaaatgaagaaagtttcatttcctataatcaattaatttctcaacagcagaagtggaagctttatgaaggattgctaaaatattcattcatcaatgaaaatactagtaaagaggagtttgaaaacaaattcttaactgagccgattgaattatttatggatgttccttcttttagagaattttataatttgctattaaataaagaaaaagagttaagagttttgaaacccaatatttttgttacattctttatgaattacaaaacaaaaaaaatatataatttgaaacaatttggaaaagtttcaacaccgacatctagagtttctgaagaactacaagatatgattagcaacctttaa

SEQ ID NO: 246 - DNA, 624 bp, Chryseobacterium sp.
atggataaagattcaattacccttttatttcaaataattacagctgtaggttctctatctacttttggtgctttcttatatttatttcgaagagatagagataagcaggctcagattgatagactaacacaaatatcaacttttttagaagctcaaaatgaggtgatgaaagaacataatgatctggtatcacaacaagttgatatttttagaaatacttcaattttaagaaatcaagatgatattgctgtttcacaattaaaagatatcgaagagaagaaacttaagttaagcgtaaaaccaaacttatggctaaatggagctggatatgaaggtcatacaggggaacttaaaattgatttaaataacaaaggggaaaatgctaaactaaaggaatttaagttgaattcttcagatatagttttacataatgagcatttaccctggaatcttgataaaggagaaagaaggtatatcttagctcggtctaatggtaataaccacataaaagatgcaaagtatattattgaaataatatatgaagacaaattaggtaacaattattcaaatactattaaaggtgaaggtgctaatgtggccttatctgatactatagaaatataa

SEQ ID NO: 247 - DNA, 1023 bp, Chryseobacterium sp.
atgattaaaagtacaataaaaggtgtgggattttatgttccagataatgttgttaccaatgatgatctggcagaattaatgaccactaatgatgaatggattacggaaaggacagggattaaagaaagaaggcatcgtaagaatagaaacgattctcaggaaacggctgcttatctaggatttaaagcttctgaaaaagcccttgaaaaagccggtcttactgcgaaagatattgattatattgtttttgcaacactttctccggattattattttcctggatgtggagtattgcttcaggatatgttgggatgtgataccatcggagctttagatataagaaatcaatgctcggggtttgtatattctatgagcgttgccaatgcttttattaaatcgggaatgtataagaatattcttgttgtgggagcagaagttcattcttttggattggatttttctgatgaaggaagaggggtttctgtaatctttggagatggagcaggagcagtaatactttctgctacagaagatgaaaaagcgggagatatattagctgtaaatatgcattctgaagggaaatatgcagatgaattgtgtacacagtttccgggttctaagttcggatggagtgacagaatgagaaaagaacctgagaatgttaccaataaagaagtgtatcctattatgaacggaaacttcgttttcaaacacgcagtaacaagatttccggaaacgatgatggaagcgctgaataaagctggaaaaactgttgaagatcttgacatgtttatcccgcatcaggccaatctgagaattgctcagtttgttcagcaaaaatttggattaccggatgataaaatatttaataacatccagaaatatggaaatacaacggctgcctctattccgattgctttaagtgaagcgattgagcaagggaaaatcaaaagaggagatcttgtacttctttcagctttcggaagcggatttacgtggggaagtgtcctttttgaatattaa

SEQ ID NO: 248 - DNA, 612 bp, Chryseobacterium sp.
atgccttttgctctcataactgcaggaattgctttaaatggtaatgggaaaaatgatattaaaaatcaagtaaaagaatggcgaaataatcaaatacctggttttcgtgttcatatagatgatgttctacaatttactcctgtagccgctacctatgcttttgacatgatagggatgaaagcaaaaacagatattagaaaccagacagctataattataaaaagtcagattattacactaaccgcagtttatattttgaaaaagtctttgaatgtaccccgtccagataatacgcaatattcttttccatcaggacataccgcagaggcatttgcaggtgctacaataatagccacagaatttgaggaaaattataaatggattccttatatagcatatggcacggcagcgactgttggtattttaagaattgctaataataagcattttatttctgatgtattgcttggtgctggtttaggtattttgtctaccaaagtagcgtattggacacacaagtataaatggaataaatataagtctgaaaaggatcctcttgagccaatttatactaaaataaaagaaatagcagatcctacttgtttacaataa

SEQ ID NO: 249 - DNA, 1788 bp, Chryseobacterium sp.
atgactacacttaataaaacactaaaaggaggtgaattcctgatcaaagaaattcctgcaaacgaaattttcagtcttgaagaactttcagaagagcaaaaaatgcttcgcgattctgcgaaagaatttattgatagagaagtgattccgcaacatgatcgttttgagaaaaaagattatgcattgacagaggaaaaaatgcgtcagttaggagaaatgggattgctgggaattactgttcccgaagaatatggcggtcttggaatgggattcgtcagcacgatgttggcttgtgattacgtttcaggaggaaacggttcattagcaacagcttacggggcacacacaggaatcggaacattacctactcttctttacggaagtgaagaattaaaaaagaaatatcttcctgatttagctgcaggaacaaaattcggagcatattgcttgacggaaccggatgctggttctgatgccaattcagggaaaacaagagcaagattgtctgaagacggaaaacattatatcatcaatggacaaaaaatgtggatttccaatgctggttttgcagatactttcactttgtttgctaaaattgatgatgataaaaacatcactggttttgtgattaaccgttcagaattggaaaatcctgaaagtctgactttcggtgaggaagagcacaaattaggaattcgttcgtcttctacacgtcaggttttcttcaacgatatgaaagttcctgtagagaatatgttgggagaaagaaataatggtttcaaaatcgctttgaatgcattaaatgttggtagaattaaattagcggcggcaaatcttgacggacaaagaagaatcttaaaccactctattcagtattccaacgagagaaagcagtttggtgtttctatttcaacttttggagcgatcagaaagaaaattgctgaaatgtcaaccggagtttttgtgagtgaagctggttcttaccgtttggcaaaaaatgttgaagataaaattgcagaattggttgccggaggaatggatcatcagcaagctgaattaaaaggagttgaagaatttgctgtagaagcttctattcttaaagttttcgtatcagatcttactcagactactgctgacgaaggaatccagatctacggaggaatgggattctctgaagatactccaatggaatctgcatggagagacgcaagaatcggaagaatttatgaaggaaccaacgaaatcaacagattgttggcagttggaatgttgattaagagagcgatgaaaggggaattagacttattatctccggcaatggcaatcagcaaagaattgatgggaattccttcattcgaagttcctgattattctgcattcatgagtgaagaaaaggcaattatcgcgaaccttaagaaagtgttcttgatggtttcaggtgctgctcttcaaaaatatatgatggatattgagaagcaacagcatttattactaaacgcttctgaaatccttaaccaaatctacatggcagaatctgcaattttaagagcagaaaaacacttcgctgctgattctgtggaagctgcaatggctcaattaaacctttacaaagcggttgaaaaaatcatcgtagcggcaaaagaaggaattatttctttcgcagaaggtgacgaacaaagaatgatgctttcaggcctaagaaggtttacaaagtataccaaccatccgaatgtagtggcattaacagaaaaagtagctgcacattacattaataaaggatcttactag

SEQ ID NO: 250 - DNA, 450 bp, Chryseobacterium sp.
atgagaaaaagtgaattgctaaggtcaaaaaccaaaagtctcttgaagttttcaatgtatttatttgtttttgtaataatttcgacatcatttactaatatcccaaaaactagaaatggtgaaagtgagaatgttagtatgtcaagagctaataaaaaatcagatttaactaaggtatatacccgcaaaaaaaatactgaaggtagtgatagtcatattttagtactccattttattggaaagtatgtacaatataaatatgaacttgatttaggtgaaaaaattcaaaaaggaaaatttgttgagataataaagaacggtgatgtatattattatttgaaagatgcgaaaggcaaagttaaaaaagtctttatgtgttcaggtaatgatgcaacaatttttgaattgaataacaagaatgaaaaagttgatactttatacctaaaataa

SEQ ID NO: 251 - DNA, 192 bp, Chryseobacterium sp.
atgattatacatttcataccacattttatggtcaaaacaaggaaaaattatgttttgcaaccgtactatatctttttaaaagctttaattgctgtatcattaattgctacagtactaatccaggatggaatgtcaaagaaaagttttagcaaaaggattttcatccaaaaatgggtcaacgaagcagtctaa

SEQ ID NO: 252 - DNA, 189 bp, Chryseobacterium sp.
atggcagatttaagttttgataaatttttaaatgcatttaaaaaaatgcttatcaatagatatttttggagtgtaaatgatgcttaccattttgattctgaaaaattgaaagctccttaccatgaaggattagataggtatcatgcttatttcaaaatatttaatattgagcaatatttaattaggtaa

SEQ ID NO: 253 - DNA, 141 bp, Chryseobacterium sp.
atgaattcaacagaagacaaaaaagaaaaagaagagacgttacagaatcaagatttggaaaacaacccatctccaaaaaagagagagaaagaaaatattccaaaatcttctacaaacaaatccggcaaaactgggggttaa

SEQ ID NO: 254 - DNA, 213 bp, Chryseobacterium sp.
atgcaagaaactgagcgccttcacgattcttatgttgaagaaatggacgctatacaaaaagacttacctgattttgggatttatcaaaaggaaacagagcactatgtataccacatattattgaatataaccggattggataactggtataatggtgatactattcgatacacgccttctggattccctagacatatttatcccgatgcataa

SEQ ID NO: 255 - DNA, 957 bp, Chryseobacterium sp.
atggaaaagaatgagaacgtattatggggtgaatttggactacaactggaacaaaaaataaggtcattccatcagaatgtatacccaatcagcataggaaataatggagaggagctgaaatatttcgcctcattaattacctctgaaattcatgaaataaggaaagtatcagatatcagcaatcaaaattttgttggtcaaaaattttcagatcccaggaccacggagtttgatccattacaattagtcatccaatattttcagaacggagaaacagataatgcatgctggttactttttttatattcctatatcgggaaacacccaaaacatggatggaatctcattaaaaacatctatttcaaaacaggaagcaatgatctatggaattgggaaaacatcaatagtaattttgaagtttttcagaaatggtttctggaaaatatccctgccataaaagagaatgcaggactgggagagcatcacaaatattctgagctgagcgactccaaagccattgtcatatgccgggatatgcaggaatatattctttggatacaggaatttggaaatcatcataccctcttatcaaatcaggctgaaatcactcctactaaactatttagggaactgtataaatcaatggatgctaaaaccagttttaataagcttgttaagtttaaatatttaagtctgttaggcattctttctatatttcctattcaacccgatcagccctatctgaatgattttatcttatccagaagaggagcacagcacctttttgaaagtaagaaccgcaaaaaaattcctgttgagaagttgaatgctctcctactttcattacatcattatttggaagtaaaccatggcttagaagtattacagaaagtcttggcaaaatgggggaaagaaagatttaaagtagaaagacaaaattttaaaagatatatttga

SEQ ID NO: 256 - DNA, 1554 bp, Chryseobacterium sp.
atgaagaaaatcttactgatagttattctaactttgggtattggaatttcggcccaaatacccaccaacgacgaatgctacggcgctgtacctttgacagtaaaccctgatacaagctgtaattctaaaactgcaggaacaacaatagcggctacaaaatcttctccgacaacatgtgccggcagcaatgatgatgatatatggttttcttttactgctacaggaacaaaacatatagtcactatttcggatatcgtcccgacaactataggtagtaatgaacaaatgtattttgaaatactcacaggaacctgtggcacacttatcaataaaatatgttctttttctggtgcaaatgtaataacaggactaactccgggacaatcttattatataagagtttatacagaaagctcagcaatacgtgctacattcaatatttgtattggaacacccgtaaccaatccgccccctgttaataacgaatgctcaacagctactccattaacagtaaaccctgataccaactgtactacagttacaactggaaatacactcggagcaacaatgtcaatgcctgtatcatcaggctgtaatggagcaccggatgatgatgtatggttctcttttgttgctacagcaaattctcatatcataaaaatctcagatatagtttctacaggtgctctaccaagcatttcaactactgtaacacaaatatttagtggttcatgcaatgcattaacaagcatgggatgtacaacttctaatgtaaatgttattggagggcttaccccggggcaaacttattacataagggtatatacatgggactctgaatggtacaatgttagttttaaaatatgcgtgacaacacccgctccaacatctgcacctactaacgatgaatgtgctgcagccataccattaaccgtaaacgcaaatactaactgtaacgcaataacagctggaaatacacttggtgcaacacaatctgctaccccttcttgtgctggagaaactgatgatgatatatggtattcttttgttgccacacaaaatacacatactgttacattgtctaatattgtatcaacaggtaccctgaatacaaatcaactctatacccaggtcttttcaggaacatgtgctgcactcacaagtttaaaatgctctttttcaaatactacaaatataagcggccttattgcaggacagacttactacttaagaatatatacatcacaaggaagcggatataatgctagttttaatatttgcgtatctgaaacagctacactaggaacctccgatattttagataataaagtcaaagtcacagtatatccaaatccatttaatagtattttaaatgtttctaacagtcataatattaaaaacatattaatttctgatatgacaggaagacatataaaaaccattcataaacctgaaccaaaaatagacctaaacattctaaattcgggagcttacattataacattagaaatgaaagatggtctaaaacaaacagtgaaagttattaaaaagtaa

SEQ ID NO: 257 - DNA, 351 bp, Chryseobacterium sp.
atgtggatagagcaagtatactatcaaagaaagcaaaggaagatagaagttttattctgtaataaagaaagtattacggatgataaatttaatccagataatgtatataagactaaaattgtgatatcttatctgtctgattttggaataggatcaatatataatgttgaacaggggagttttgaaaatttgaaatttatcgaagtttatcgtgttaaaattgagcaaaatctttacttagcaaaaaacattgagtttccacttaatggtaatattgattttctcaaaaattctaatgaaatggttccgttaggatttaattatttaaaggcttttggagagagtaattaa

SEQ ID NO: 258 - DNA, 339 bp, Chryseobacterium sp.
atgtctggtcgtttggttgatggatttgaattaagtgaaatgaaatttcgaagacctgatgaaactggcgaaaggataggaatgctaagatatgatgctaaagaactaacgaaacaacaagctacaattgttgctccttatatatttttaaaaaataattcaggaattaagtttttaaggagcctacattctcacgttgaaaaagcttttctaaatagtcttaacgggcttaaaagagcatatctatcttttcattggcaagattttagaaattatgaaatagctgtagtaggtaaatcatactatgtagatgctaaaaagtatttgcttggattttga

SEQ ID NO: 259 - DNA, 330 bp, Chryseobacterium sp.
atgtatctggtagaatttggtagcggaataattggtattttcaatacggttaatttaaatcgccttgaaacggaatacttatattctttagttaatgagttcattgaaaaggaaagtgaaattgagcaaggaaaaattttctggaaatttataaaaaatgagtataaagaagtatatgaaaaaagaggaattataatacatactggagctaaacatctacaggttccaaatgggacaatggccaaaaataaaaaagaagccttgcaggcagcaacacatagaactgctaaaaatatatatcagtttagaattaaaggtaatattacctaa

SEQ ID NO: 260 - DNA, 711 bp, Chryseobacterium sp.
atgagaaaaaaatatgtaatacctggttacattccaccggagccttatgaactattatctagctggattttccgtttagcacgttcgcataaaatgaagccattctcatttacgaaatattgcttagaagagctatccttatggaatagggattttgataaattttactatgaaaatcttgtcatgctgcttaccacaataactcctttaagttctaagaacataaactctcttcacttaatttcatatcaggatatagtttttaattctaaagttcatagtgcgtttacggaaggtattttaattgtcggtgtgcaacaccggacaagaaaaaataaagggttagtcgcttgccctctttgtttatccaaaagtgaatatttcaaaaaaagttggcgtctacttagctcaatagtttgtacagattgtaattgtaatttgattgatgagtgccctaactgcaaattaccaattatttttcaaaggctcgacataggaaaaaaagatgtatatagtgaacagccaatttatctttgttggaactgcagatacgaccttcggaaagaatacactctaattgatgaaaactcttcttcacttcaatatcaaaaatatattaacgaaactataaggcatggctataaaatcacacacaatattcttttgaatacttactaccctattctctatattgagaaaagtaaggtctag

SEQ ID NO: 261 - DNA, 186 bp, Chryseobacterium sp.
atgaaatcgacgatgcagcatttacaccctaaaacagaagaactattaagcacttctacaaacgcacaacgtatcaatcagcttaaaaaaccaaagtggataagatatacagtagcaaaaaagatgcataataaacttgaagagcttagaaattatccaatgaatttaagaatgcctaattcttaa

SEQ ID NO: 262 - DNA, 795 bp, Chryseobacterium sp.
atgaattataaaaattttcttttatccctattatttctaatgctattcatgagtgtacatgcacaaatggatagcattgaaattaaaaaatatcaaatagaacaagacaaaatatgggattcaatctgtactgcagagacccaattagctattgaggaaattaagcttgggaagctgacatatgtaattccaaaaggaatggtagaaatgtttgacagtgataaagaattgaaccaactattaaaaaagtataaaatcaaaactactcctcaaggaatattttgtactgtaccttatgaaaaacagttttgttacggtgatctcatgaataaagaaattgaaaaattgtatggttcaaattttattgagaaaaaaagagaagaagctgaaaaaatatatattacaaaaaacatttataaaatttttcccgggaatgaatgtgatagaaatcactccatttatcctctggcaaaaaatgtagatgaatatattgatagatatagaggggattatttcaaagattttacctatccggctaattatatacatagaaaagagggagacctctattcacatactgatattgaatttatattaaccagaaaaggtaaaataaaaaatttaaaggtgcattcaacttttcataatccttataatcaaaaattcgctaaagaatttgaagaaaaagcaaaatattttattcaaaatatctcttggattcctaataaaaagtctgaaattattgtaaagagtaaagaaactctcacttttctctatgataaatatgacaaataa

SEQ ID NO: 263 - DNA, 489 bp, Chryseobacterium sp.
atgaaaaagtataaatggttcattatcctagcaaacctcgttattttgctggtgtatttcaattattccgtttctaaaaaagaagaacttataaaagatggaaaactgattcttttgcagctagctcccgtggatccccgttctctgatgcagggtgattacatgaggttacgatacagcatatctgaaaatataaatgctgaacatcttcctaaaagaggatattgcgtggtacgtctggacaataaaggtgttgcagaaaaagtaagattccaacaggaaaccactcctttgaataagggggaatatttgattaattatacctcgtccgaccaatggaatatcaatatcggagcagagtctttcttctttcaggaaggacacgctcagaaatatgaaaaagcaaaatacggaggtataaaaattgatgaagacggaaacagtttgttgattggcctttacgatgagcagctgaaaaatatacaataa

SEQ ID NO: 264 - DNA, 1071 bp, Chryseobacterium sp.
atgagaaataaagaagaaataaaagaactgctggattatttccggaccacagaaaataaagatttcacctatgatgaaaaagcgatcctcacagcttatgagaagaatgagactcatcaatctttagccataaaaatactgtctatttttggaggtattttagcaagtctctcttttttgggtttcctgttcctcattggattatatgactctactacaggtattttgacattggcaataatagcaattgctgccggagtattcattaataaagcctatgataaaatcatcattgataccataagtgtttcatcttatctcataggatttatccttttggccgtgggattgtctaaacttgaagtgagtgaaaatacagtaagccttatttctattctgattgccgcagcctcattagtgatggtcagaagctatatcattgcctttatttctgtacttattatcaatggggggattctaaccctgattgcatcgaataaaggttttgatatgattcatctttatacttcttttctggccatcatggtcactgccgttttcctgaaagaagccaaaataatttccaagaatactactttttcaaaactatacaatccggttcgcatcgggctggttttttcattcctcgcaggattgatttttcttggtaacgattttattgaagtatccagggattatctttggatatcatccgtcgttattatcctggccattatgtatgttctttcgcgaatttttgaagttttaaacatttctcaaaccactcaaaaagcaggaatttatattgtaacgatcgccctgttattacctactatcctatctcctgctatatccggatctattttaattattcttttaagctttttagtgaattacaaaaccagcctggctattggcattatggcatttatttattttgtttcacgatattattatgaccttcattttaccctgctcaccaaatccattcttttattttcgtctggtatcttattcctggggctttatttattaacccgtaaaaaactgacatcgaatgaaaaagtataa

SEQ ID NO: 265 - DNA, 957 bp, Chryseobacterium sp.
atgaaaaacctccaacgggaagacctccatatcatcagccaccacagcaatgtgacagagcaaggcatagaaagagctttgaaagaaaacatttaccatgacaaagaaatgtggcaaaaattccttcgtctgttttttatcaccctaggtatagggtttaccacggcaggaattattttcttttttgcctacaattgggcagacctgaataaatttgctaaactggggttaactgaagcccttgtcatcgcaacgactattatcgtcttactgcccaaaacaaacagtaccacccgaaatattatccttaccggttcatcattcttggttggagttctttttgcggtcttcgggcagatttatcagacgggtgccaatgcgtacgacttctttttggcctggaccctttttataacactatgggttgtcgtttccaactttgctccgttatggttgttgtatattattttactcaatactacattttttctatacaccgaacaggttgctaaagactggtcatcaatattggtcattacgctccttttcctgttcaatacaacgatacttcttatctttctctttttggagaaggataaaaaaaatcaaaatgtccctaaatggtttacttatattctagctttagactgcgtgacttttgcaactgcagggataattttcggaattgttgatggatatgatcctgtatttcctgttctcatccccatagttttagtggtttttgcgtttggaatctggcacggaatccaatcgaaaaacggattttatctttcggtgataccattaagtatcatcatcattatttcagccttactcctcaaaatatcagaaggaggagatatgcttttattagtcagcctgtttatcatcgtaagtgttacactggtgattatgaacctgatcaaccttcaaaaaaaatggaaccatgagaaataa

SEQ ID NO: 266 - DNA, 333 bp, Chryseobacterium sp.
atgttttgcgcctaccgaatagtatatttagaaaatagtatttggaaaacagcaaaatcaaaagatgaattagcaaactttatagataccattgataatgaatcagaagctttcttaatgggaaaaataaatgactatgcagtagatttttattctactgaaggcaatggttttataaaagaaaaaacgggctataaagtgaaaatgatgaaatacaatagttgtcctgaatcaaaggaaagttttacacttttcattaatgagtccggaaaaataatgagtactaaaagcaatggtttttatttaaaaagtaaaaactgcattgtatactga

SEQ ID NO: 267 - DNA, 498 bp, Chryseobacterium sp.
atgaataaatgtgacaaaatttgtattcctaaagaactacattgggatgcaaggcctattgatcaaaattttaacaacgagaatctatttagaagagtacgagtacctgtaagtcaaaataaaattagggagacagaaaactcggcaatgattttccctataaaagatgattcttgtaacagagaaaagtattccaaagctaacgacgttctttataacattatagcaaataattgtgatgaccattttctaaactatggaattgtacaaattaattccaattatattattaatgaaaggttttctcctcaaggaacagacgatatttacacgtttaagatacttcattcacctacagagtgtatgtatcctcattgtgaaattactgtttttaaaaacgatgagaggatatctgatcacaaacctaaatctgtaaaagcatacattagggatattataatttcaaattgtgaagtagtaaaggattttgggtcttag

SEQ ID NO: 268 - DNA, 558 bp, Chryseobacterium sp.
atgccaacaatagataaaaaaaacataaatgattcaatacaaaaggctaaaaaaggatcaaacttatcctattttgctaagaatgaatcatatttttggatatcatctcagtcttatggatatcacagatatttttggacaaaaaaaggagcatttcataatacaaaatctagctttggaagaaaaagaaaaaatagaattatgtttcctttcaactataaaaatgacttattcagtattcataaaaacgaaattatccgaaataaaaagaatgaaaacaagcccttaacgggagttaaacttataacccgttatcttgatattttaaactttaatattaaaaaaattaaatttaaagaaactattgaaagttatttaatcgaatttatttatcaagaaaattattttctaattgaatttttttatgacaatgatattgttttgttaatacgtaataatgaaagtaaaagtagacaagcatgggattttacaataaatcatatcgttgaactattgcaagttttacaacaaaacataagtgaagacaggcatgaataa

SEQ ID NO: 269 - DNA, 138 bp, Chryseobacterium sp.
atgcagctaaataaaatagctttagctatttcccttaatattctttacaacttaaatgatcttaacttttcaaataagtggtatatagtttctcacagatcacacaaatttttatactatctgcgtgagactaaataa

SEQ ID NO: 270 - DNA, 594 bp, Chryseobacterium sp.
atgaaaaacttatttttcgcatgtacactgctaatctgcggtgcatttgctcctgctttaaaagctcaggcatcagacccatatttgggacaaattgcttttgtaccttacacctttgttccaaaaaactgggcagaatgcaatggacaacttcttcctatagcacaaaaccaagctcttttttcgcttctggggactacttatggaggaaacggaacaactacatttgctttaccggatatgagaggaagagtacttgttcataacggacaggctccgggagggcccactacttatactatgggacaaaccggaggaactgagagcgttactttaacagtgacccaaatgccggcacatagtcatacagttaatgctgtaaccgctgaagggaatcaaaattccccaaccaataatcttcctgcagacaccaaaattcttgataaagaatattctgacgcagctgggaatactacaatgaagagtacaatggtaaacaacacaggaggaaatcaggcccatgaaaacagacctccgtttattactctgaaatgcattatttcattagtaggagtctttccatcccaaaactaa

SEQ ID NO: 271 - DNA, 129 bp, Chryseobacterium sp.
atgcctccatttagtggaggcatttttttattcaatcttaatgtatctatcctaagtaaaaatacttcttatcctgaaaagcaaaagcttccggaaattccgaaagctttaatcatttattttctataa

SEQ ID NO: 272 - DNA, 288 bp, Chryseobacterium sp.
atgagaaaaattattttcacgatgttattaacaacatcagtaatgttatttgctaaaaatgaagaaccaaaagcaaaaatagatgaaagcaaaagtaagacggaggcaactttcatggtaaaaaagaattttaagggtgaaaagatagaaatgaaagtagctaaagaattaaaacaagcagcgatgaatttagaaggatgtctagcaattgcttttactgtagtaagtgttgatcccccgctgggaacagcaatggtggggagttgtttgaatacatattctaaataa

SEQ ID NO: 273 - DNA, 1089 bp, Chryseobacterium sp.
atgaaaataaggaaaaatattctattgtatcttttaattttattgacatgtatttattcatgtagtaaaaagcaaacagttaggattgttggggatatccccaaccttcctgacggtattatctatctatggacaggaacaatgcttgataaaatagacagcgtacaaacaataaaaggacacttcgaaatcaaccatgattttaaagagaaattacctgtttatattgggatatttcatagagataagaaaaatgttcaacgagttttcggattcattactaacgttcctaaatgggggtctccaacttttatgtctgatcctttagttacaataaaaggaaacatggaagaatatactccagtaaactttacaccatctcctagtgtaatttttgtgaatagtccccgaataaaggcaggaaaacaaaccgaagcgctatataatacgggtgatgctatttttacaaataatagtcctggtaatatagatatgattaaagaaaaaattagaaaatatccttattcctatcatattttatacagtattataggaaataaaacagcatttagcacaagtcaaactgaagaatttttacagttatttgataatgaggtaaaacaaagtaaaccttacaaaaaactcctaaagtacaataataaagcaaaagaaattggagatattaaaatgcctgaactggaaaattcgaatggaaaaaaagtttcagtactggacaaaaattataaaaaacatcttttagttttctgggctagctggtgtggtccttgcagaatggaaattccgatgcttaaaaaagagtatgaaaagtataataaagatgtagaatttatttcaatatccatagatgaggaaaataatgcatggaaaaaagcactttcacaggagaaaatgtcctggaaacaatttatcataaacagtgaaaaccctgcttataatgatctccaaatcttgtttaaatttaataatacgattccttatacgattctaattgacaataatatgaaggtattgtcttcttctacaggattatccggtgaagaggaatttaaaagagtaattaataaataa

SEQ ID NO: 274 - DNA, 285 bp, Chryseobacterium sp.
atgaaaaatttaaaaaaattatcaagaaatgaattgaaagatgtatttggagggaatacaggtgatccctgttctgtatctgttcaacaagctaacggatcatggataacttaccctggaaaatgtgcttatgttatgaattccacttcttctaatggagtaacctggagtggaagttattattgtgaaacaggtacaggaaatagtcattcaattacttccaacggtggtgtgagccgttgtactggtaaagccggcgtaggtgcaagtacagatttaagctaa

SEQ ID NO: 275 - DNA, 1239 bp, Chryseobacterium sp.
atgagaatattaatcataggtgaaggcggtagagaatctgctttagcggcaaagcttcagaatgacccgagaatttctaaaatgttttttgccaacgggaatgctactaccgatgtaatagggaaaaatgttcatttatcagaaatcaaagaacttagagatttcgccattaaagaaaagattgatcttacgatcgtaggtcctgaggcaccgcttgtagcaggtatcaaggacgagtttaaaaagcacgatcttaaagttttcggtcctactcagaaagtggcaagccttgaaggaagtaaagctttctctaagaaatttatgcagacctatgatatcaaaacagctaaagctgtggtatttgattcatataacgaagcgatcgaatatgtaaagacacagcagtatcctttagtagttaaagcaagtggtttagctggaggaaaaggtgttgttatttgtgatacccttgaagaagctgaagctacgattcatgattttatgatcagaagaatctatggagatgcaggtatccgtttagttatcgaagaatatttacaaggttttgaagcgtctattattgcgttctctaatggtgaaaaactattcccatgtgtagcagcaaaagactataaaaaagctggaaatggtgacacaggacctaatactggaggtatgggatcagtagcaccaagcccggaatttactcaggaacattatgcagattttgagaaaaatattttagagcctactgtaaaaggactaaaagctgaaggtttcggatttaaagggatcatcttcttcggattgatggtaacgaaaaacggagcttaccttcttgagtacaacatgagattcggagatcctgaaacacaggtattgatggctcttttggaaaacaatcttttggatgtgatccaggactgtatggatggtaaagatatcgagcttaaattcaaagatgaaaaagctgtttgtctggtaatgtgctcaggaggatatcctagaaacatcgaaacaggcttcgaaatcacaggagaagataagttgaagcatagtaaactattatatgcaggtgccatcagcaaaggtgataaagtggtttccaatggcggtagagtactgaacattgtggctacaggagctacctatgaagatgcccgcaaaaaagtatacgaagacgcagctcacgtacatttcgattacggcttctacagagaagacatcggaaagttttaa

SEQ ID NO: 276 - DNA, 966 bp, Chryseobacterium sp.
atgaaaataaaacatgtgctcataatgatcagcctcggttcaatactgaccagctgtatgatttcccataaaaataaatcttcttcagaaaattattcgtggttcccgttttcatggtactctgcaaaaatttcagggaagaattttgataaagtggcaatgcttgttcctgttaaagtaaatgatttaaaagctgattttaccctacagtttgatctgggaagtgatgcaacattgatctacggaaatgcaataaatagctactacacagaaagcgaaataaaaaactttctgatagaaagctctaagtctacagataatggcggaaaaataggatacaagacaaaaggactgatctatcaatttgggaaattgtctaaagataatttggtatataaagacaattacggagataaaatacctaaagactctctgtttactaagaagcccaaacacatgggaacattgggcgcagatgtatttgaaaataaaatattagtgatcgactatccaaataaaagaatgtgtgttcttgattcattagatagtcactggagaaaagtgacaacatttgtagatgctaaatctaataatggcaggttgcacattccactcactattgctaacaaaacccactggttcttgtttgatacaggagcaagcttatttcctatcaataccaacaaagaattgtggactgcattggtggatcaaaccagtaaaacagacactattattgccaattcatggggagaaaaggttaaattctatggacgtcccattaaagaaaaagtgtatctgggaaaaagaaaactggaaaatgattatgcctggtataacgataataaaagacttcaagagtttaataaggctgaaaatgtagatggtttaacaggaaatgctttttttatcaataacattgttatattggactttaagaataaaaaattcggagtagtaaactaa

SEQ ID NO: 277 - DNA, 813 bp, Chryseobacterium sp.
atgaaaaaagctttattcctgttgctctgtttcttgaatattcatatccttttcggacaatccaactatgatttaggttatagagaatatgataatcaaaattttcaaaaggctatctcttattttgacaaagcgatcagtgccaaggagaatatttttgattcttatttatatagaggaatgtcctatctttttctatatgagggtcaaaaatctaaagaagattttgataaagtgcttgaattagacccacaaaacacgaaggtttatactttttatggaaaatattatgcattaaccaatcagtttgccaaagcggtagaaagctatactatagcattgaaaagaatgcctgatgattatagactgtatggtgaacgagctgcctctaaagctgaactgggaatgtatagtgaagctcttactgatgctgatatctctatacaaaagctccccaaaaattatagaggatatctgaaccggggatacgtcaaaatgcgtatggacaaatatgctgaagccgttgaggacctcaatacttcattaactatacaaaaatcagaaaaaggctatgaatacagaggaacagcctatgctttattaaaaaaatatgatgctgcattacaggattttgaaaaggctctggaatacaatccggccaatccgcttgttctttactatcaaggagaagttttattatccacagggcaaaaagaaaaagcctgcaaaagtcttttaaagagtaaagaattgggaaataatgatattgatgatgttatttctaaaaccaaatgtttaaagattaaaaattaa

SEQ ID NO: 278 - DNA, 1485 bp, Chryseobacterium sp.
atgaaagttctattaacctcagcattttttctattaatgctccatgggtctccacttttggggcagaaagcaccacaaaacacctctgacagtattgatatttttatcaaagataaaatggatcagctgaggatcccgggtcttcaactgggagttatcaggaatggaaaaattgaaaagcttaccaactacggactggcaaatattgaacaccatactgccacacaatctaaaaccgttttttcgatcaattctatgaccaaagcgtttgtgggagttgctattttacagcttcaagaacaggggcaattaaacatagatgatcctatatccaagtactttactgatatccccaatgaatggaaacccatcactctcaaacaattactaagcaatacatcaggtcttcccaataatattgatgagaaagagcaggtgctgggtgacggaacagaagaaaaaaactgggaaatagtgagaaaacgtcctatggaatttgttcccggcagccaattcagctataatcaaaccggttattatattttaggaagaataatcacacaattgagtggaaaacatttcacacaatttattgaagacaatcaattcaaaccctgcaagatgcttgttactcaatttggtgattccaacgacattattgagaacagtgccggggcctactctacgatcattaataaagacggtaaatggatcaatgacggatctcttcacattgcatttgcaagctttcctgtctttttccggacggctacaggaattatttcttcggctgaagatatcagcaagtggctaattgctttgcaggagggaaaattgcttaaaagcgaaaaaagcgtcaaacaactttttacaacaatacctcttaataatggcagtattggtggttttaacaagctgactaatggatatgctttaggctggccaacagtagtacgatctgaacatcctgccgcagctcctgttggaggtatgcgctcagctctttttgtatatcccgaagaccatttatcaatcattgttttaactaatttgcagggatcaaatccagaatggtttatcgatgaaattgcaggatattatattcctgatatgaaaattgaaaatggttttgggctaagccgtaatatgaagcttttacatcatcagattattcaggatggatatcagaacattgaaaaagcttatcaaaaaatacagaaaaagcagaaaaaatttaaggtgtccgaagaggaggtaaatacctggggttaccagcttatgggtcgcaacctgaaagataaagcgcttcaggttttcaaattaaataccatcttatttccgaacagttccaatgtctacgacagctacggtgaaatattagatggattagggtaccagaaagaagccattattaattataaaaaatcactacaactcaacccgggcaacacaaatgctgctgattatctaaaaaataaaagatag

SEQ ID NO: 279 - DNA, 459 bp, Chryseobacterium sp.
atggacattacaattaaagcaattcctcacccctctgaagataaaagagctatagatctaatccatagattaaatgcgtctcttattacaatctctggtgagagtggaagcaaaagcgcaaaccttgacgactttactcaggagaaagctttgtttctcattgctttaagtgatgaaaaagctattgcctgcggaggttttcgccctatctcaccggagatatgtgaagttaaacgcatgttttctctaaagaaaaatatgggactaggcggaaagattctctcagcattagaaatagtggcaaaacaatttgactacaaatacatttacctggaaacccgtaaaaaaaatgagagtgctgtaaagttttatctgaaaaaaggatataaggtcattgaaaattatggaatttacactggacgtgaagaagctatatgcttcagtaaagaactaagataa

SEQ ID NO: 280 - DNA, 987 bp, Chryseobacterium sp.
atgaaaaaacaaattttgataatttgggcactattttttattcccggttggatagtgtcacaaatgaatattaatcaggcagatctgcccagaaatattcaggtgggtgtagcagcaaaagctattatagagcttcaatatggaacccccaatgtaaggttcggaataagtacaggagtaggatatcttgcttttaattcattgctgccagccgtaaatattgagtatattatcaattatggcggactaagtacttatcagggtccagataaaaagcggttttcgaaccaatttgtaggttcattatctttaacttcgggtttgaataatgaatttaggaacaactctttagagtatatcaggaacagaaataagcctctttattactttacggatttaacgcagccatcattacaaaacccatttaattcttcatttacttttggaaccaactgggtctatcatctttctgccaatatctctaaaccgaaccgtttacaaagggttggttttttgggccttaaaatagaaaattttcaatttggatatcttaatgatgggggaacaccaattaagaaaattggcttaggagacaaagaagatcgatattacaccgggggtggatttgtcaatattaatttaccgatggaccgtaaaatcaatactattaatgcaagtttttataggtttacaggatattcggaacttgcttttgatactgcagatgaatttcttttcggttatgtggattatgctgacccgaagcaaaaatacttcaatcatggcttctggaattttgggataggaaatacagagcattggaacggatttataaggctcaataatgtttatgatttatctgaagttcagaatattatccattatttgaccaaaagctcttatcatcagaatcagaaacccttttatatttctgcaggaggttcttataatatgtctaatcttaatctttccaatcatgaaaaataa

SEQ ID NO: 281 - DNA, 852 bp, Chryseobacterium sp.
atgaaaaataaagtgcttatgtttttgttattactttctcttttcagttgtaaaagttttttcaatcacacggaaaaagaaatagaaatattgagtgataatgaagaaatcaggctttctgaaatcaaactttctgattttaccgcttttatccgctatgtaaacagagattatccttctaaatgtttctatggaactaataatcctaatagattttcagaagtaaataccaatagcgaattaaatccgaaccctgaaaagtctgaaaaattagaacaacagtatgttttgattgataaggttaaaaatgctaaaggacagaagagagtgatctttattagtactattcaaccttttaaaagtggaaaaaaattaagctatgattatcctgtttttgataaagatgaatatatcaatattaattttttcaatttttttaagttagggtatttggatgaaaataagtccgtcattactttttataaggattgttgtcataaagattattggcattttaagtggaaagaagatggctctattcacataagaggtttagaatttgattataaaacaagatttgggggagctaatgaagtctattctttagataaaaaaacttggatgccaatagaatatcatccgttaaataattttaagtttatgatcaatagtgatctggaaagctctccggaaggcgagtgtagtactgaaattgcagaagaaaataaaatttactttgatgaaataaataagagaatgtattttcacttcaatgcttattttgattatggaaataagtataagtggctgtattttaaaggagatagggtgattaatcattggatagattaa

SEQ ID NO: 282 - DNA, 756 bp, Chryseobacterium sp.
atgagcagaataaaatctattgtagtagacgatgaacaggaatcacgtgaaacccttcttcgtttcttatccaaatattgcccggatattgaaatagcaggagaagccgcctctgtaaatgaagccgctgagatcatcagagaaacatctccggaactggtatttctggatgtcaacatgcctgttgaaaacgggtttaaactatttgaaaaggtatccgatagtaatttttatacggtatttgttaccgcttatgatcagtatgctgtacaggcattcaaacatcatgcggtggactatcttctgaagcccattgtgattcatgaattgatcctcaccgtgaacaaggtagctaagcttttggaagataaaaataaaatccagcagttatctgccctgctccatcatattaaaagtcctccagagcagagtaaaatagcgctaccaaccatggaaggtctggtctacgttcataccatggatattgtacgccttcaggctgatgacaattatactttaatctatttcaaaggaggaaaaaaaatgatggtatcacacacgcttgcctattttgaagaaacattgaaagagcagggttttgtccgcatccatcatcaacacctgattaacctccagcatgttgaaaaatatatccgtgggcgaggtggctatatcattatgagtgacgaaacttctttacaggtatcacaaaggaaaaaagatgagtttctccgaattattaaaagaatgaaatag

SEQ ID NO: 283 - DNA, 2880 bp, Chryseobacterium sp.
atgtatcattaccgtctcatattattcctgttgcttcatagcctgctgatgtacagtcagaagccacaacttcgtcattatagtttaagtgacgggttacccagcaatacggtatactctgtatatcaggacagcaaggggtttatctggttctgtaccagctggggaatttccaggtttgacgggcatcattttgagaccattaccagtaatcacggacttccggataatgaaactttccaggcatgggaagattcctggcatcgattatgggtaagcacctataacggaagccctacttacatttataatggaaaagtatattctgtacacaatgataagctctgtcgcctcatggaaaaaaggggaattggtttttacgatattgttccaagatgggatcttcattctaaccggtatacaaaatatattatacgtaaaaatgatatttccaatccaaaagacagcacatcacaatcccctcacctgcatttttcggatcagggcaataattattacgttactttgaaaaagatcataaggaaggataatcaaaaatcaataacagtttacacatttaaggaaaaagcggttagatcctgtttctatctgaacggccacctgtatgtaagaaatctaaacacattgtatgatattgtatttaaaggaaatacacctctggttaaaaaaattgaaatgcccagcagtatcatagaacttactataggtaaaaacgataagatatggtgctgcactacaagcggaattatggagtatgatcctgttcaaattacaggtcaaaatccacggtatatcgcgatgaaaggcattgtaagctacagcagttttatagatagacaaggtaattgctggtatcctaccaatgaaggtgtatatatgcagccagccaataaaacactagtatatactacagatgatgggcttatagataacaatgttttagctctaaaatatttgccgggaggaaaacttatcgcaggatatgacaacagtgctgttatgataagagaaaaaaacagattcagacccttatatacgctgggtgacggacaatggaacaggctccggtattttttacctattgataatgatacattttttgccggaacagacagaggtttatacaaatgcagtctgaccggaaatcaatacacaaagcttctggagttttctcaaaaatcagcgtccatcagaaataataccgtgctgataagctataccagtactgaaaaaaagaatcatcttatttatgaccttaaagaaggaaagtttagcccactgccaacactgagcaccaacatagctgccccggcaacagccattgatgcaaagggcatctactggctcggaacaatacaagggcttttctattacgatccagctttacatcaattcattcaggatccagctttaggcagaaaccgcatcacctccctgaatttcctgaaaggcagacttgttatcagcacccattctgatggtattttcattcgtgatggtcagaaagtaattaggttgaataaaaccaatggactcatcagtaatatttgtgaaaaagcctatatagacgagaaggaaagactatggatcaatacagacaaaggattatccagagtcacctttgatgatcgcatgcactattctatttatcacttttcagcagctgacggagttccgagtcacatgatcaatacgattacattcggggaaggaaaagcttttctggctacgtccaatgggattattgtcatcaatcaggatcaggtcagcaaaagccagccttataaagtatatttcctgaaagcctccttcaaagacagcatcgtttattatcctaaaaagatcagcctgaaatacaatcagaacaacgcacaaatctcctatacagctatttcttatctggatgaaaaggatattaagtataaatatcttctgtcgggagcagaaaatgacacggtaattacggaagaaagcacattaaatctgggagctctgaaacctggtaattatcatctcaacatctgggcctccggaaaaaataatatatggaataaaacacccgctgtactggctattgcagtaaaacctcccttttgggaagaactttggtttatgggaggaatattcctgttattattggttttcattatcatcatatacagacaccgtgtcaatattatccgcaaaaaagaagcggagaaaacggaaagaaaaaaaatgatcgctgaactggaaatgcaggctctccgcgctcagatcaaccctcattttatcttcaacgtcctgaatgccatccagaattattatggtaaagaagatgaattgaatgccaattattatatggctgctttttcagacctgatccgaaagaccctcacccactccaaagagcactggaatactattgataaagaaatggctatgctgaaaacttacattgaactggagcagatgcgttttaaaaatcattttacatatgagatttcagtagaaaccggactggaacaattaaaaatccccaccatgctgcttcaaacctatactgaaaactctatcagccatggattgagacatctgaaaacaggaggaattcttcggatttcctgtactcggaacgaagattctatcatatgcattgtagaagacaatggcgtagggtttgaaaaagcccgtgaattcgacagcagaccagacgattataaatctatgggcttgaaaattactgccggcagaatttccgccatcaatgaactctatggaacatctatttctacagagatcactgataaaaataccataagcccctccacacagggcacaatcgtcaaaataaccatcaaaaacactccttttctatga

SEQ ID NO: 284 - DNA, 882 bp, Chryseobacterium sp.
atgaaaacaactttaactaagatctttcgatcatcagactcatttttgaaagcaagaaaaacaaaccttcttatttttgcggttctattttgtagcacagctttaagtgcccagataataataactgatcctggtgttccatccgttcctgccaatacaaaagtaaaaataaccagacagtttgttggggctaatgtacctggatttgtaccttctcctgtatcattggaaattaagtcaggttcaacaccggaaaccaaagtttttacaacaactcaaaccgatccccatacctatacatttccaatactttttacttttccgggcaatcccccaacagtccgaacctttaaagtttatttttctaatcctggattgacaagtaaatactatccggttccaacggcgattggaggttctactacgattattcccggatgctggtctcctgagatggatcgcggattattctatgatattggcccaactagcagttatggatacggagtaactcttacccgtacagcttctgcagaatatcttcttcaatgtactaaatttctctgccatgtatgtcagccatgtcctcctatagtttcaactgtaagtaaatcagctgtatccgaacagagcaagcctaaactttatccaaatccaagcaacggattatcagaacttgcatatactgcttcagaaaaagagactattactgtaatggttgcagatattgcaggcagaacagtatatgggtataagacagatatggaatcaggggttaataaactgcctatagatattcaaacttcggtatccggaacctattatgtcaactggcgttccagtaacggaaactccggatcattgcaattgataaagaaatag

SEQ ID NO: 285 - DNA, 270 bp, Chryseobacterium sp.
atgcagggaatagaaccaaaacttcacatgaacctgaccagccgtattgaatattaccgtctgctgatagaagctgcggaagatcctgaaagccagccttcagaggtaattacccagatttcagaactgagccatctgtatgaagagtatctgcttaataagaagaacctggaaaacagcatcaaaaattaccgcgcatatcataatgatttaagaaaaaagctaacctcaagacttcgggaactcagaagaaaggcaagacagaaatag

SEQ ID NO: 286 - DNA, 423 bp, Chryseobacterium sp.
atgaaaccaattgaaaaagagttttttaacacatttactgattttcaatgttttattctggctcatatgaaccgaggggatattaacggggttaccgcagctcattataatatcattgagtttatcatgaggaaagagatcgcaacgggaaaagagatatcaacagcgtttaacatcagccaggctgccatctcaaaacaggtgaaatttctgatcagtaatgatttcattatccggaaacaggtggaaacagatcacaggaaattcaatctttcagtaacggataaaggaagatttgttatagaaaattcggaaactttccgtaagaatatcactcgtcaggctgcttctatattcacttctaaagaattggaaaattttaattatctgctaggcaaaatgctgaatcatatgaaattataa

SEQ ID NO: 287 - DNA, 282 bp, Chryseobacterium sp.
atgttgctatctatctatggcatgagacgtagcgaaattattaaacttcaattggatgatattgattgggaaaatgacagaatttatataagaagatcaaaaaaacagtccaaaccacaaatatttccgctctcatcgaatgttggaagtgccataattcattacctgcaaaaagtaagaccaaacaatattcccaaaaaagaagtttttctaactattctggcaccttataaagagctatcagttcatatggtatacaagattgttgaaaagcggggttaa

SEQ ID NO: 288 - DNA, 459 bp, Chryseobacterium sp.
atgcaaactgcacttttatgtaatgcatcaattataattcttgcgcataatcatccgtcagggaatttaaaaccttctgcagaagatttgaaaatcacacagaatattaaggaagcagcaaagtttctgaacatccagttgctggatcactttattttaacatctgaaagttatctgtccttagaatattccgccgctgtttttaatgatttatggaaggatcaggagcatttaaaaagatcctctgatacaaagaaggcagaacctgaatcactcccaacaaatcaatttttaccccgtcaacttcatcccttatttggatttttaaatgataatatacctgatgttgcaacaacggattcttttcccggattgctgccaacaatgcagggagaagatgatgacgaacagctttttttacagcaaatgcggaagcggaaaaaaagaagaaaaagatag

SEQ ID NO: 289 - DNA, 210 bp, Chryseobacterium sp.
atgaaagtagtattagcagaaaagccaagtattgcaggagaaatagccctagttttgggagcgacagaaaagaaagatggatatataacaggtaatgggtatgccattacctgggcttttggccatttaatagcattaggtatgcctgaagactatggaatttcaacttttagcaaacaggctttacccattttacccaaccccttttaa

SEQ ID NO: 290 - DNA, 849 bp, Chryseobacterium sp.
atgattaagaaaaaaaatgaaacatgggaattaagatccaatgtaaaaaagactgtagcttttttgggaattgttcctgtacttttaatgacttcatgtcatagtgacagagagcaaaataacaacgaacttacttcttatcctgcaagcattatcagtacgccgataataccttccaatttctctgctgctgttgcagaatctcaaactccaattaatattcaacctttaactgcgattagtttccacagcaatgatcctacaattcattatggagctgttaccctaaattctgttgtaaataatgccggtgaaaatcttaagataaatgtatcgggagctgataatcagaacaattatattactgttggtggtaagaaatataatctagtaaatttccattttcattacagcagcgaacatacagttaatgggaaatacagcactatggaaattcattttgtgaatgtagcatcggataattcttatgctgttctaagtgtgatggaagatttaggaaatgccaatatttcacttcagaatttatttgcacaatccccaacgataaacaatggagttaattcttcaaatatgatatttgatattacaagcttattaccaagtaatacaggccagtactatacttacagcggatctttaaccacacctaactttggaagcaattcagcaatcacaaacggaggcccggtaacctggtttgtatttaaaaataaacaacagttatcaacagatgagtttaaccactataaatcaatttatactgagcctaatttccgtgcaattcaacctttaaatggtagaaaagtatattcaaatcctggcttctag

SEQ ID NO: 291 - DNA, 288 bp, Chryseobacterium sp.
atgtttctgctacctcttttagattcaatagagtcagcaccgaagatcgtcttaaagcctatcacctatgtaagtttaacgtcttatagtatgtatctggtaaattattctgttgtccaaatgtggattatagataaaattgattttttaaagaccccaaaaaaactaaatactggtttaacgtttagtctatttttaattctggtaatggctctttcaattttaatgtataaatatttcgaaataccaacaacaaaattaagagataaactgataagaaataaatga

SEQ ID NO: 292 - DNA, 138 bp, Chryseobacterium sp.
atgttgaatagcatcctgtatgctctaaaaaaggtagtaaagattataatggataaaatagttattaagattgctttttttacacttaatttaaaaatattgatcaaggaaaaaatcattattggagagatcagataa

SEQ ID NO: 293 - DNA, 399 bp, Chryseobacterium sp.
atgaaattgaagaatttatttaaaattcaccttgatgaaagtaggatctttggcttagatattctccgattctttgcaatcatctttgttgttttaggacatggtttaatttatttgccaaaaaatgttgtggaaattttttcatatttaatttttgacggagtttccattttttttgttctaagtggttttttgattggaggaatcttaattaaaatattaaataaaggatcttttaattttaacacattattagatttttggaaaaggagatggcttagaacacttcctgcttatcttttagtactgatacttttacttgtattaaatatagcttataatgaaaattttgtttttaattcgaatattataaaatacttttttttctacagaatttaa

SEQ ID NO: 294 - DNA, 321 bp, Chryseobacterium sp.
atggagagtaatataaatgacgaactgagcaatattaaaaaactggagatagcttattggtgttacatcataaaaacaggtaccgttggtattgttcagggaattgatgataaaggtgaagtacataatgtaggccctgaggaactgctccgtattgatcgtaatgaagattcttttacagcattttataatcagcttaaagagccttctgagttttcgttttttaaggtaacagaatatgaagccgggcagactgctttacacttacagaagtatattgacggggcattgggaagagaaagaagaattaaaagaatatga

SEQ ID NO: 295 - DNA, 363 bp, Chryseobacterium sp.
atgccgataccaggaacaatgaataaccagcccgtagaagtactggatgtatggtcccatgagaatcccggcggaacctacatgcaatattcttcagggagcaatgggatcaagaaccagctccacgtcttttttatgaacagtacggcaacggtgtctgatgcttcctttatacggcttaagaatctggaactcgggtatcaggttccggtaaagggaacatttaagagtgtaaaggtctattttcagggacagaacctcttgacctttacgaaatatttgggggcagatcctgagttcaggaatattggttacctgccccctttaaaaacctattcaataggggtactcatttcactgtaa

SEQ ID NO: 296 - DNA, 492 bp, Chryseobacterium sp.
gtgatccttacagtcagttactataaaatacgtaagaaaaggaaggagagaggtgggcgttctcagataataaaggaaactaataatgaagatcttaaggagaacaatcttaccaagccttccaagctgcccgaacatctggttgcagatattttaagtaaactgaagcatatggaagaaaagaatttttacctagaaaaagggttgactcaaaatcagttagctaagaagctaaagactaatacagcctatctttccgcagtgattaatgaacataaaggttgcaattttaatacctacattaatcgattgaggattatatatgcaaaagaaatgctgacccatgaccatcattggcggaaatatgctattgatgatatctctaaagaatgtggtttctccaatagatcaaatttttcgaaattgtttcttgaaatgacctcgatgagccccattgggtttatacaaaaaattgaaagtgataaaggataa

SEQ ID NO: 297 - DNA, 1248 bp, Chryseobacterium sp.
atgctacttgttgcatctgcagctcttgtttcctgtaatgatgatgattcaatgatgcaaaattcaaatacaataactgttgagaacgtattagacagcagaccattagtagaatccggaacttttaaaggaactggcacaccttcggttatactgcccggacagtctgtgtcattttctttttatgcgggtaaaaatcaggctttaacatttgctacaatgtatggatggagtaatgatttattttttgctcctgcaaatccgggaattaaactatataataccgatggtacacctgtaaccggtgatgtttcttctcaaattaaactgtgggataatgggacacgagttaatcaggtacctggtatgggggttagccatccaggggttgcagaaactacacaaaaaaatgttcaggaagttaacggaatggatgcttatggaaatagttatcttcctgcatctcagcttatgaaagtttcattagcttataacggaaattcaaattttacaattaccattatgaataattcgggaggaacaacaaatgaaacaccttttagccccggtgtatggggaatttcttatgcgcagggaactaacctgttattaccagaacctatttataagccgtcagtactgtcagcaaatggcttgacagaattatctgaaatgggaaatatctctattttaaggaattacctttctgggcttactggtgtgtttacgcctttatcacctgttctggtagtagtttataacggcgataaaaatccgttttataaaaatggtgaaaatgataggggagaaggcttaaaagaattatcacagatgggaaatgctgatatccttgcggcagctttaaaaaataaagcgggggttaaagcagtatacgtattaaaagatcctgctaatacagtattacttccaagaatgaacggagctgcaggtggtaaggtttctcagcagctttcaactcagaatggagataaaatcgctatagctactatgtatggattctcgaatgattggttcttcgcaactaaagacggagatatatcggctaatcaaaaaggagatttgtcttcttctattgggttgtttgataatggcacatcagtgagccaatatcctggagcgggaattaaacaaggggctgagaatatacctattcaagctgtaccaaatccaaatgcatatacaaccttgccggcaattaacagtatgattaaagtgactttgcagtaa

SEQ ID NO: 298 - DNA, 1179 bp, Chryseobacterium sp.
atgaaaaagaatttacttaaaccgaaactcaatactagacttgagttccataaattctcaaagactgagtacttggtacatcaattagaatttgaacatagaataaaaatctctactgaagtttatcaattactaaacaaaattgatggagaaaagactttacaagaattagtaaatgaatccaatgaatcagaattgacggtagatgttctatataccttattgtattcaaatttgggaaaatatggaattttagaagataagactcttcaagtattaaatattaatcccccttcatatttaaaattgagttttattataattcatcctaaactcgtctctaaaattactccatatttaaaatttcttttttataggaaattctatatattcataattccagtatgcctattcatcatcagtggctatgtttttagaaattttgaaacattaaaaaattattcactagatggtagtgatttaattttgttttttttactgggctttttgagtcttacttttcatgagtttggtcatgttacagcaactgaattttttggagcaaagcaatccgggattggaataggattttacatatttactcctgtatattttgctgatgtttctgacatatggaagctttctgttaatcagagaattactgtaaatattgcgggagtatattttgaattaataatttgtactatttttattttaattggttttgctttaaaaatagaatcatttattctcattgctacacttatttttattaaaactttatacaatttaatcccattcttaagaagtgacggctattggattgttacagattatacgcaaattcataatttgcataaaaattcaagaattgctttatctaatttttttaaatcattattcgaacggaatcaacaatttaaatacagttacaaaaacatattcttaattgcttattcatttctcaattacttaatacttttaatttttatatcttatattgttttttaccatttacatgcaatagtcaatttccctgtaaatatttacaattatattacagaattattaagagggaaagaaatattatcattaaaaaaaatttctccttttattgctcctcttattttttatttccttcttttcagatacattttaaatttaaaaagaaaacattaa

SEQ ID NO: 299 - DNA, 234 bp, Chryseobacterium sp.
atgaatcaatactttgaaaaattcgaaaactgtagctctaatataattaccggcaaccataaaccacttcctcttgcagggccggatagaactatccctataaatacaacttttattcttacaggaagaggtttagatcaagatagggatgatcttacttatagttgggaacaaacagatgggtgcagtgcctatgctgccaagttcaaccaatactgttgggcttatgtttag

SEQ ID NO: 300 - DNA, 447 bp, Chryseobacterium sp.
atgggaaaactttcttcagtagcaaggaagttgaatttttcattattggtaagagacaataatcctaaaggaggactgacagagcgtgataatattgaatttacagttgctacggaagtagggccttttaccgttacttctcaaaatactactggagttgtttgtaattctagtgaaatcaaaacaattatctggaatgtcgctaaaactaatataactcctctaaatacagctaatgttgcaatcttaatttcttttgacggaggtttaagcttttcctatattttaatggaaattacaccaaataatggatcgtatacttttactgttcctaccggtaccggaagttctcctaaaatgagaataatgattagaacgattgataatgtgttttttaatgtaaacatgacggattttacctttaatttgggctatttaatttcctag

SEQ ID NO: 301 - DNA, 738 bp, Chryseobacterium sp.
atggaagcagggcaaaaaatgtatacaccgaaatccggatatattgtggaccagaaagatattgatcgtccttttgccggatatctttatattgcgtcccatcttaatttattatacaataatgaaagtagtttaaagctatcactccagttggggattataggtaaagattccggagctgaatatctacaaaccatgttacataaaagcttgggtttatatcccccgagaggatgggaataccagattaataaccggttaatagttaatatattggctgaatgcaacaaattgttacttcgagaatcttgttttgattttatgctgagcgggcaggctagcttgggaagcggctttaccggggctaatgttgcttcaactttacgaattgggatatttaatcaattgtttaattctttaacaacacaaagtgtacttagcttgcgtaaatataaaaggtctagatcttatgaattgtatttttactacaaaccccaaataagttatgttgcttatgatgcttcaatacaaggtaacatattttctaaagatgtatcagatgagaaacaagttactactctcaaagaaccgttcattattagccatcaaatgggcatagattatactaataaaattttcgccgttggaatagctgctacggtacaaacgaaagaatctaaaactatggtaaagccgcagcatcaatggggaacttttcgattctcatatctattctaa

SEQ ID NO: 302 - DNA, 1251 bp, Chryseobacterium sp.
atgatcgggctcattaccagcatcgggctttgtatgaaaaaatttattccagacaacagccgtgggatgttctacggcctatattactcactgtcatttagtctcagccagctgtatgcttattgggttacactgctcttacaatcattttcctggaaatattcatttcttatcagtctaccggggattttcgtcagttttctcatcattatttttttaatgcacccaagaagaatggagaaaaaataccctttgtatcaggtcgactggattggatatctattatttgtaggttcaagtttttgcctgtcattcgtttgtattttcggagagagacttgactggcttaaaaataatcagatatgctttatactttccttttctatagccgggtactcattatggatacttagaatgttgaacactcgaagaccctatgttgatgtccgtgtattgtttagataccgccacgttggagtaggcataattttaatgatagccctatttttcatctataacactttcagtatctctactgaattcatgaaagtaaatttaggatataatgactcctatgttgcagcatctaatctttatctaattattccgtttgtaatatctatccccattacaggtatttggctgcataaagttcatcgggtacgcgaaagtctttttgttggtttttctttatttgctgtatattacttatatactgcccaatttttttatccagaagaaaacagcaacttttttatgatccctatgttcataaggggtgctgcttatggaatcagtataacctcattatcttattatgcttccgtaaacctgccaactgcggaaaattcccacagagcttttttttctattacctgccgctctgtcattgcagcacctataaccagtgtactatggcttgacagatttaatttttttaaacaaagacaatatgaaataatatccacccagtacagtatggatgattatagggttaccggattatggaaaagcttaatttcatcccatttaaaagcagggagtagtatggaagaagctgaacagcttacaaattcggctttacacagtatgatctataaagattcacttattttaagtgctcagaatattcactatgtattggctgtaattagtatacttcttgctattgcggcgatcagcttaaaagtccttaatatacattatgtttcagataaaaataaatacccgcttacctatgtggatttatag

SEQ ID NO: 303 - DNA, 300 bp, Chryseobacterium sp.
atgaaaaattcaatattccatgaacaggtccctgactggctggagaaattttgtatcattttattactctgctcccagatcatggtcagcggtatcccaacaaatgcaattgcgcagattacatcatttcttggtgatgaaaaggataccattcaatttatatattatggtgggattattggaagtgctgcaatttatcccttgaccgggcgctttttgcgttacttccgcaaaagcaattattactgctatgtatttcctttgagtttcttctacttatcctatctgctttttgtgtaa

SEQ ID NO: 304 - DNA, 975 bp, Chryseobacterium sp.
ttgacaagtattatcatatggggacttattaaattctttcatatcggagatcatgaatttactgaagatgctcaaattgaagagtatgtaagtccgctgagtacaaaagttacaggatatcttaaagatattagatttaatgaaaatcaaaagattaataggggtgatactttagctgtgatcgatgacagtgaatataaaatacagctgaagcaggcattggcaatgctaaaacaggctgaggcaggaaaaacaattgccgatactgatgttaatgtttctgaaaatataacggtaacctcacaggcaaatcttcaagaggtaaaagcccggcttaaaaatcaggaactaaatcttaagcggtacaccaatcttttaaaagctgatgtaataccacagtttgaatatgataaagtaaaaacagaatatgatgctactagagctcattatgaatctttattaagtcagaaacgctcttctctacttaatactaaagctatttcagaaaaaattgacgtgtcagaagccgatatcatgaaagctgaagcagcagtcgaccttgcaagactaaatatttcctattgttatataattgccccttataagggtattatgggaagaagaaggattgcagataatcaattagtccaagcaggccaggtcttaacaactattgtaaaatacggtgaaaaatgggtaacagccaattatacagaatcacaaattgagcatatccaaattggtgatcgcatgaatattaaagtggatgcaattaataacctaacgtttgtaggtgaagttactgcaatttctggggctaccggcagccgttattctgtaacacctatcgacaattcaacggggaactttgtcaaggttcaacaacggattcccgttcgtatcaaatttttagatccagaaaaaaatctggaaaatattagagcaggaatgaatgctcaggtaacaagaaagtaa

SEQ ID NO: 305 - DNA, 1320 bp, Chryseobacterium sp.
atgaaaaaattcttaatcatactgctggcgatttttggtcatttagaggcagtatttggccagcaggtactcttattaaaagtagacagtctttttatccttgctgaaagaaacagtaagcatttggacataagcagatataaaacccagatagcgtccaatttaactagtattgaaaaacagaaagccaacattccagaagttaatgcagtattttcttatgcttatcttagtaatggacatgtatgggataatggctttaattacgaaagtacagtcaaggtcccccacacatcattggatttttctattgaagcaggatatacagtttttaatggaaacaccttcaaaaaccgtattgctaaagctaagctccaggaacagatgacacaactgagcttccagaaagataaagaaaatatagaatttttacttttggcaaaatatcttgatttagcggcattagataatcaagaaaaagtatatgtgcaaaatatagcttttgcagaaaagcgtatttacaatattgacaagcttattgaacaaggtatgcttacacataatgacaaagtgcgaagtgaactgcaacttacagatctcaaacagaaactttcggaaataagaaatgataggtctatcgtccaatatgacctaaaagtagttctgggacttcctaaagaaatatttttacagacagatacgctttttactccccatgagatattagctataaacgatatccctactgattttactgacaggcttccagaaatacgtgaagcagaagttcagaacagaattgcagaaaaacaggtagatattgttaaggcaaatcgtctgcctgttgtatctctttttagtggcgatgtaataagcaggccttttcttaacactattccacccgttgatatctatttacatttattccaggtaggagtaaaaattaagtatgatatagggacactttataaaagtaaaaacctaatacagcaggcagaaatggaacattctctttttcaaaaaaatcaggagctattaatagaaaaagctgaaatggatattaatgctgccaaaatcaaacttcagaatagccaacaaaaatatctatcaatgaaagatagttatcagctagcacaagataattaccgagtcgttgaacagaagtatctgaataaatttgtgaccataaccgatatgctggatgccagtacttcattgcttagtgcacaagtcaatatgagcaatgcacatattggtattgtctatcaatattataactttctaaaaactaccggactttggtacaaggtaaacaaataa

SEQ ID NO: 306 - DNA, 450 bp, Chryseobacterium sp.
atgttagagaatgaatatacccaaaccatgcacatgtactttaatatagtgttgcggatgcgtcaggaactgaggcagcgaatacagcgtaaactgagtgaatttggacatactggtatcactatggaaatgactcaagtattatactacattcattttattgctaaagaccaatgtacaaaccaacaggatatagcggataggacaaacaaaaccaaatcaagcataacatccctaatagacaatcttgttaaaagaggattggtaaagcgtaaaatggattcaaaagacagaagaagtaatgtaattacactaactcatgacgggctcaaatttgtagaagatatatatgataaagtttatcagacttttgatcttaaaaaggcaaacttatctctggaacagatacttgaaatgacaactttaatgcaagatcttatcgaaagttaa

SEQ ID NO: 307 - DNA, 1308 bp, Chryseobacterium sp.
atgatcaaacaattgacatgtttcattatagttggaatactcctttcttttaatcaaccttcgagtaaaattccagcagaaaaaaaaataattgagtttattattaaaaataaacaggaacaattaaaactcttagagagtctagttaatatcaatagtgaaacatcaaatattgaaggtgttaaaaaaaacggagaactcataaaatcagaattggaagccatcgggtttaatgtaaattggcatgaccttccttcagaaatgcatcatgcaggaagcttagttgctacaatcaaaggtaattcgcgtaaaaaaatactgatcatcggacacctagatactgttttccctattgacggcccttttcaacgtttcacactttcccctgaccataaatatgctagaggaccaggggttattgatgctaaaggaggaattgttaccattttatatgcgatgaaggccctgcatcacattggaaaacttaaaaatgcaaatattaccattgttttcactggcgatgaagaactggcagccaagccaacaagcacatcacgaaaaacactcattgacattgctaaaaattgtgatattgccttaggatttgaatttgcactttcacctgatgaaatcattgtgggaaggcgaggccttgatgagtggtttttgagctcaacgggcaaatcccaacattcttctaccatatttcaatctgatacaggatttggagcggtatatgaagcatcccgtgtacttaatgagattcgacaaaacctttccactactccggggcttactattaatgccgggttgcttttaggaggacaaaagattaatgaagatattgaaacaggaacaggttctgctgctggacgtaaaaccattgttcctaccatagcatatgcgcacggtgatatgcgatttctttctaatcaacaacgaaatgaagcacagaagaaaatttttcaaatttcagctgattcattacagggaacccaaagcagtataaattttagacctatcattcctccaatgcaggcaacaaaagctaattatgagctgctagcgttatacagtgctataaatcaagacctgggaggcccatcaataaaagcagcgtcacccaatttaagagggggagccgatatatcttacactgcttcatatatagcagcgggattggatggattagggccttggggtaaaggtgcccacacagaaaccgagaccttagaaattgatgctttgactatagctacccagcgaaccgctttgtttatatttacttatataactaaaaacaaatag

SEQ ID NO: 308 - DNA, 2592 bp, Chryseobacterium sp.
atgaattcgttagatgagattttagaggttatttctaaaaataaagtatttgttatatttattaccatttgtctttcattaaagagtgttgttgtttctatttatcaaaaatatataattaatatatttctgctaaaatttagtagttcccttataaatgatgttatttttttattcgtttctttattttgtgtaatatggaccattagtaaggtttataaaaagttttatattcagaggagtacatttgtatacttcattttttttatacttttatatacttatataaagttgttttatagtgaacagttgctaggtcttaaagctgttcctacagtaagatactttgatgttatttatgtattcctttgttgtggacttatagtaaagcttttatccaatcgaaaaattagaaaggctattaataaagctataaatattgatgataatctttttccgatttatgatgacagtcctatagaaagttcaaccgaagatattttaaatagaaaagaccttgcgttgaaagttgctagttacgttaaaggaaattatacattgaactctacggcaattggtatagttggaaagtggggagaggggaagtcaacgtttatgaaatttattgaagagtcttttgtaaacgataataggtatataattgtacatttcaatagttggataaatatttctgctaagtcaattatagatgatttctttacaacagtagaaggtaaaattagaccccatagtatcgatattgccaaagaaatcaaaaggtatgggagtagtattttttcaatttataaaaacggtacaactgagactcttttaaatgctgtgaacctaattcctgatagtagtttatcagatagttttgataaagtagagaaactattacttaaactggataaaagagtgattgtttttctagatgatttggacagacttcagccaaatgaagtatttgaaacacttaaattgataaggaatacggcatctttcaagacatttcattatgtagttggatatgataaagattatattatcgaatcactgaagtcgaatcatataccaaatccccgcaaatattgtgagaaaatctttattaacgagttttatttattaccgattactaaaagtcaaattagtgcttatattaaaaaggagcttcgtgcgtgtgttcaggatagtgtagaactttctgctgcttttgaacgattttatgtttttgcaagaaatggtgaaatctttgattcaatcaagactataagagatgcaaaaagatttcttacagagttttcattgagttttcacgttgtaaagaaagaagttgctttaaaggattttttactaattaagcttcttaaattttcgtatcatgaggtgtattgtatgttgtttttaaataaaaataaatttataactaacataaaaaagaactcttacattcgtgggagtgatataattgaaatcaatctgaaagaaaaaggaagtaataatgtttcaagttttagcggttctgaattggagaacgtccttacaaaaaataactattataatacagagcaattagaaggaataaagtccatctttactgttttattttctgatttaaatgctttttctttcggttataataaaaattattacaggtattttaatgatgaattagcaatatcagagatttctaatcgtgagtttttaaaagtaattcactcgaattggagtgtaattgagaaatctatattaagttggagaaatgaagaggagcttatgggtgttttaggacagattaatcatactgatataactgattttaagaataaaaatgcatatgaaaattatcttaaaatgttatttaagttacagtttttgctaaggaatgatgatactctgaagcagataagtatagattatgcctatatagaacattgtgttaaagataataatctaagagtctccctaaggttttatgggggtgataaagagcaattaagaaactttgtaatagaattattaaatgatggggaatttccatataaatacgaaatgggcttttgtcagtatttgtatagtttaatttttgaagaaacgggtaatggtgtattgtctaagcaggatatagaaactttcttagttcaacgttttaaagatattacttccaaacatagttataataaatatgatttttttgatgctttctatcatacagagttagtagaaaagtaccaattgaacaaagatgataatcgaatttatgagagagatgttttcttaccagaaataaagatgatatgtcaggatgtaataaaaaataatgctgatagttttttacttgatatacttgaaatgaatgggaaatcaattcgaaattatagacaaaagcgacaggtgaagattcacggttttgtactattaatctttaatacttacgaagattttattgtttttttagaagaaaatgtgagctctgaaaacagttcattcattagtgaattcttagattttgctaaaagtgttttgccatcaaatgattttacaacctttgattttcaacatgaaccagtactagagttaatgggaaaataa

SEQ ID NO: 309 - DNA, 2706 bp, Chryseobacterium sp.
atgatttcatatatagttgcaggagcattaactatcggggcagtaggttgggtaaccaatgttattagagagcaaaaagaaaaaaaaataaaggaaaaggaagaaaaattagaaaaggaaaggttaaataatctgttcaaatccattcttcccagtgtctattcagctaatcgaggttttcgaactttgacaagtaatacaaatggatatttctcgaactctaggcttgctcaatggagagataagcatagtgaaatactaaaagatactatttttcaacaatcatttaaaaacataggtctatcaccttcggaagaaatggaggttgttttttttaagaatcttattagtaatgatgaaaaatctcgtgaaaattttaataatgaatttttaaagtatgaactgaagcaaacccaatctctattgagtaacatagatggagggaaatctttagatgagcaacaaagagaagccattattcgtgatgaagataatagtttagttattgcaggagctggttgtgggaagactacgacaattatgggtaaagtgaattatcttaatagaagtcttaacgttcagcctgagaaaattcttttaatttcattcacaaatcaaagtgcaaaagaccttgccaataaagtaaatattgcaggaattgaagctaagacattccataaattaggattagatatcataaaagatgttgaacaagcaaaaccatcattatacaatgcagatgagttaacttattttataaaagatacatttaaaaagttactagctgatgaaagatatcttagagttctgacaaggtacttctctgattttattaagattagtaaaagtgattttgaatttaaaaatcaggcagaacatatacaacatcttaaagaccaaaattttaggccctataaaaaggttgaagtcaaagtaaataacaaattaacagtgctaagggaaattgtgaagagccaagaagagtgcaaaatagccaattttctactatttaacggtattgattatagatatgaagagccttatgaggtaactacgagaactttagaccacagacaatacgaaccagactttagtttatatcaaggaaataggaggatttatttagaacactatgcattagataagaatggaaatgttcctccgttttttgctaacaaaaacactagtttagagacagcaaaaaggaattatcatactgggattcgttggaaaaggaaaacacatacagacaatgagacagtttgtatagaaacctttagctatcagtttaaagacggaactgttgagaaaagtcttatcagcttacttaaatctcatggatttaatattaaccctttatcagaacaagaaaaatggaacttaattcaagagaatgcatctgatgaggtagcatctttaattgctttgtttacaacttttctaaatctttataaatcagtaaatattacctacgaagagctacagaataaaattaaagctaaatcaggatttgataaagaaagatgtacatactttattgcactattttatccactctataaaggttatgaagaaatgctgaaaagaaaacaacagattgatttcagtgatatgataaatcaagctgtaagctatcttgaacgaaacaaatacatacaccaatataagtatctcattatagatgagtttcaagatattagtataggaagatacaagctgattgatgcttttaaaaaacaaagtgaggatgtcaaattatttgctgttggtgacgattggcagtcgatatatcgttttactggtagcgacataagtttgtttaatagttttgaaaaatactttggatttaccaatacatcaaagatagagactacttatcggtttggactacctatgatagacatttctggaaattttgtaatgaaaaatcctgctcaaattaaaaaaagtcttagaaacaagttgaaagttcaatccgacatggaaattttttatactttttctgatgacaatgatgacacggagggcttggaaaaagctatcaataaaataatcgagtctaagatattgagtaaagataatgaaccaactgatgatgaaataaaaggaatcatgtcacataaatactatctaattggcagatacaatcacgactttaacagaataaaagtagaacatagtaagttcaaaattataaaagaaagcactatagagtatatatatagtgaacgattaagagttaaattggaattctttacagcacataggtccaaaggtttagaagcagagtatgtatttgtattaaattgtaattctggtagactagggtttccatctgaaatgtatgatgaccctgtcctcttacttttgttaggaggttctgaaacgtatcccaatagtgaagaaagaagactattttatgttgctttaacaagggcaaaattaaaaacgtctttaattgctaataagaagtttgcttcaaaatttattattgaattagatgaaacgttgagtaaaacaactagagataattcaaaatgcccaaactgtcgctcaggagatttggatttaaagacagggattaaagatggtaagagatgggctttttatggctgttcaaactttgccgtgtatgattgtcagtataagaagcggattacagatggtgaaattgaacaagtattacaatcaatagtaaaaagataa

SEQ ID NO: 310 - DNA, 564 bp, Chryseobacterium sp.
atggagagtaactttttttcaggttcggagaatctttataaatatcttgtgagtattggcattttgatgttagtattgacaatctattatccattaaaagagaaacaagaacttgaaatcctaaagattaatttaaaatctgagctgaaagttttaaacttagagattaaggaaaataataaaaatgtaattgaactaactaaatacattagccaaaagaatgttgatgagagtcaaaaaagaaaactatttgtagaaattagccaaaaacaaaaattaaacgagattaagcaaattaaggctgatagtaaaataattgaaatccaaagtagggaaaaatatattaatatttatgataacttgttttgggtctttgttgtatcaggggcaatatttgtattatttggtttctataaatggtacaggtctaaagatgttgatgatagtaagtgtgaaatagaggtcgaaattttaaaactaaaacttgaagaagaaaagcgaagacaaaataatagcactacatcccaacctacaggtactggacaaaaccaatctgttccatag

SEQ ID NO: 311 - DNA, 654 bp, Chryseobacterium sp.
gtgaaagctaaattattttttttactattattcatatccatcaaattatggggccagcgttccgtggttttaaaatatgaactggattatcaaaatgataataaagtatatgttgataaggataatgaaatgataataaaagaaattagcgcagacgttccatacaatattgagattataaaaaacaggaaatctaactattatggagggagcattaaaaaaaccttcaacttagtagtagcttctgattataatactgaggttaaagatgttgtaaatacctatgaaattttatacaatgagaatcaaggagtcacaagtataaatggctttacctgtaaagaatatgtagttctaaaaaataaagaaatttatttccgagtacttattgatagtgaaaatgctataaataatacagaattactaaattttatgacaagcattcctttttcacaagttatttttcccaaaggtttaattataggcattaaaaatgaaaaaggtaaaatgtcatttgaacttaagaaaattaccagtatcaatttcaaaattatgtatgatattgagaatgacatcaaaaaaaacaatgaattggagcgtaaaaaatcacaaaaattcaaatctagcggtgtttattatactccccctaattaa

SEQ ID NO: 312 - DNA, 930 bp, Chryseobacterium sp.
atgattaacacgaattttaaatcaattttagatcttataaaagcctttccagacgaacaatcatgtattgatcatttggaaaaattaagatggaatggtaatgtaatttctccatttgatccaacttcaaaagtctacaattgtaaaggtaataaataccgatgtaaaaatacaggcaagtacttcaacgttaaaaccaataccatttttgataacactaaattagggttacagaaatggtttttggctatttatatagttacatctcacaagaaaggaatttcatccttgcagttagggaaagacttagatattactcaaaagtctgcttggttcatgttgcaacgaattagaaaatgtttcggcattgagaataataatgatttagataacgaagttgaagcagatgaaacttatattggtggaaagaataaaaatcgacacgcaaataaaaagattgatggatcacaagggcgaagtgcgaaagataaaattcctgtagttggaatggttgagcgtgatggaaaattgaacgcttataaagttgaagatgtaaaatcaagtactttaaccagagagataattaggaacgtaaaagagagcgccaaactttatactgacgaatggttaggctacaaaggtgtttctaaaatctatgatcatagtattgtaaaacataatcaatccgaatacgtaaacggtcgtattcatacaaatactattgagggcttctggtctttattaaaacgtggaatttatggaatatatcacgctacatcaaaaaaacatttgcaaatgtatgttgacgaatttgtattcaggtataacacaagaaaacatactgaacaaaacagatttaatttactacttttaaatttagaaaataaactaacatacaaaatattaatacatgacaaccaaattaattaa

SEQ ID NO: 313 - DNA, 219 bp, Chryseobacterium sp.
atgaaaaattacttattaatttctattacaattttatgcgctttaataaccggatttatatttggaagatatacttctaattctggacgatactcgtttagattctcaggagataattcatctttatttgatactaatacaggagatatatacaaaattgatgataagggtgtatataaaattaactataaagatagctttgataaccctaaaaaataa

SEQ ID NO: 314 - DNA, 282 bp, Chryseobacterium sp.
atgaaatcgacattatttataatcatatcattatcattatttacatcctgtgattatgcaaagcaacaaaaagagctaacacaattgaaattagaaaatatagaattaaataaaaaagtaaaaatttataaacttgattctttattcaaaagttcaaatgaaataaaagatccacataaattaaaagcattaagaatcattgatagtcttaaatttaatgatcctaaaacatttaaacatatacagatagaaattgaaaatgataatccgaattttgaataa

SEQ ID NO: 315 - DNA, 147 bp, Chryseobacterium sp.
atggaagaccaacaattagaatcagttatcaataggctagattctatagatgaaagattaatgatattatcagataaattaagtgaaattaaagaaagcatttcaaaattgacactatctcaggaagtgtgtaagttaaaaagttag

SEQ ID NO: 316 - DNA, 168 bp, Chryseobacterium sp.
atgtttaaactggatattaaaacatatgaaggcataaaattgccacagctgattgtacgttttacaggtatttctaacggatatacagataatagcggaaacaatactcataatatccaactgtcaaaagaccgtgctacagccgtattgaacttcagggatagataa

SEQ ID NO: 317 - DNA, 390 bp, Chryseobacterium sp.
atgaaaattgaacatttagctatttgggtagatgatttagaaaagatgcgagcgttctatctgaaatattttaataccacaagtaatgaaaagtacatgaatgaaaagaaaggcttttcttcctattttctttcattcggtgaaggcaacgcccgcctggaaattatgaatagaattgatatcaatgaagaatgtgagaaaaggggtttcagtaaaggtattgctcattttgcaatttcggtagggggaaaagaagctgtcaatgaattgactgaaaggttaagaaatgatcgttacacgattgaaagcgaaccacgaacaacgggtgatggctattacgaaagtgtagttttagatccggaaggaaattacgttgaaatatcagcttaa

SEQ ID NO: 318 - DNA, 153 bp, Chryseobacterium sp.
atgatgtggggagttttcgtttttattatcctttctgccacggacgggacaatgaataatctgatgatagacgcggataatgggattaatgcaagaagaggaatctcttgtattgagagctttttggtccgcaataagatgtttgttgagtaa

SEQ ID NO: 319 - DNA, 873 bp, Chryseobacterium sp.
atgaaaaaaaaattatcaattattttaataggtataagcggtttttattatgctcaggtaggaatcaacactgtaaatccgcaaggtatatttcatattgatggcggtaaggataacccaataactggcgctcccaatattgtccaacaatcaaatgacttctctgttattgcatcaccaagtttaggtacgggtactatagcagtggggattggtactacaactcctacccaaagtttggatatagctaatggtaacttaagaattagaaatataaataattctgtaggaatttccagcgacaaattattggtagctgacccaaatggattaataaaagtagcaggtggagattccttttctgcatcagatagcggaaatagagtattgagtgctgttgggggtattgatataaatgcatctgctgactggaacgataatgaattcaccacattgaaattagatgagctatatgatcctcaaaacgcatatgatgctacaacaggagtatatactgtaccaaaagatggattgtactttttatatggtgtttgcggatttactacacccggaagtggatccggtacttttgacggtacttcgggaagtgcttttaccgctttgtatgtagacacaggaagagtttcaacaacaaatgccataattcacagaggtgataaaaatccttcaataacaactcctccaaacgtcaatttatattttttgacaagtaatgctacgatttggttaaaagttgggcaaaaggtttcgttacagtttttaacgtatggaacaaataatatggtaggaaatcttagtgatttaaaaattaggagaaccatttctcgattaataattaataaactcctttaa

SEQ ID NO: 320 - DNA, 147 bp, Chryseobacterium sp.
atgaaaacacaaatattcacaaaccatcattatgttatttgtgaaaaaattagtgccattagtgttaaaaaaaatctaaacacaaatttcacaaatgaaagcacaaatgtccactaccataatggtgttatttgtgaaaaaagttag

SEQ ID NO: 321 - DNA, 867 bp, Chryseobacterium sp.
atgagggaatcttataaatttgcatcaacttatgtattttttgcattaagtagtgtattttcgcatttccttttgtatttgacacttggggaagcagcaccgtacatcattattcctgaaaacattattttcagagagcataagattgaaacagaaataaaaaactggaattttgaaaacgaaaatttttctcacctggtaaagatattattttcgctaggaagccttggtctctataagcttctcaatgatgacagcagggagaaaatttatttcctgggagaaaaagtaagaatcagaaaattatctttcaaagaaccccaggcagctattatcaccaacgaaagcattcttgagtctgacagaaaagggaaatcttatattcatataaaagccagccaatccgatgaacttctatataccggtgaattagattattatattgtagctcaggaagcatttgagcttttttataaagatctgcacactacagttccggtggaatatcatgacaataacctccctcaaagtaaaataatcaatacggaagtcccccatcattttactatttcaacagaaccttttacccccaaccagtgtaagggacattttgaaaattatcccattgtcccttttgcatttatagccaattgtattttaaaggagatattcaacttcctcaatagggaaatgtcctacgaaatagaaagccttgaaggatatgcctcgaatgcacttccaacagggattactttcctgaccgaagttttccaccaaaaatatttgaagaacctgatttacttcaaatgtgagataaaagatacttccggaaattcatatggagcgctaattttcagtattaaataa

SEQ ID NO: 322 - DNA, 243 bp, Chryseobacterium sp.
atgaaaataaaattatccaatgtagaagcaagtaaaattataattaaaaaaattgtcagtctgcaaaaaaaaaatttgaaaaaaatcaaagttgatagaaacggaaagtttattaatatattatttcagcgttttgaagatatacagaaaattgctattcaagattcagatttttttgaaaataattcccaatttgtaatcttcccctttttagtaacactcaaaagtagagttttatgttaa

SEQ ID NO: 323 - DNA, 141 bp, Chryseobacterium sp.
atggcaaaaaaaaatgaacaaacaagcaagaaagcaggaacagctgcttccaaaacattgaaagataaaaatgcttccaaagatgcgaaaagtgcagctggatctgctttaacacagcgcccagataaaaagaaaaaataa

SEQ ID NO: 324 - DNA, 216 bp, Chryseobacterium sp.
atgctgatcaaaatttatggaagtgccattcacgaagtggctgcccagataatagcaattgaagtgaatgtaaatactggtgaaataggataccatttgatcgggcctcccagaagtggagaaacgatactggctaaaagagttcccggtattttacctccatttacgttgatagaaatacaggaaacaagctgcttctttcttttaggtctatag

SEQ ID NO: 325 - DNA, 261 bp, Chryseobacterium sp.
atgaaaaagatatttttaagaatattattacttctttgtactgttttattttttgtaggattgtacttttatccgtttgaaactaataaacagtgtggagagctctcattatgctgggttaaatttggtgtatatgagtatgattatgactcagaggcaggtaaggcttattttggtaaagatatccagttttatagaaaggttggaggtttctgggagtatgtaggattgaaagaaatagattgtcataaaaagcactaa

SEQ ID NO: 326 - DNA, 594 bp, Chryseobacterium sp.
atgagtattcttgatatagcatattatattgtaattgctacaaattttgttgtttccgtagtctgtaaaaagctgcggaaacatttctattttctatatttctttgttaccatagtgatagagttacttacattatatcgtcatgactggcaaagaatgtataattttcttgatattttcagtatattatttttttattttctttttaaaaaagaaatagttaataggagatttttgacatcaataacaggtgttgtactcatattggctatatattatacctgtgtatgtaatacttcgtattctatatataccggacttattttctgtatatattccatatttgtttctttaaactggttttataatatgattgcatttcaaaatgatacagaatcaatactggaaagaggactattttggattagttgttccttactattttggtcagttttttaccttttcagaatgatgccgatgtattggatacaaagtagagatgagggatttttatacaccttgaaatatatttttcaagtagcaactattagctcatatcttttatttcttaaaggacttttaagtaaaaaatga

SEQ ID NO: 327 - DNA, 339 bp, Chryseobacterium sp.
atgaatctgcctgattatcaagcaatacgtttgaactatgctttattatttgatttgccgatggtcaccgggtatgatatttcgagccagagtatagcagtgacagaaacagtaaaaacctggaaacctgatgataaagtgtatgattccccctccgatttggaggttcgggaagttatgcagcatatcaccttacagatcaatcctcattatctgatctacaagaaagcagcggctgttccgtttattggaggaaaattatgggaaatacttgtggtgcgggcacctgtaattcaatattttaccttaaaatataaggttttcaaacaaaatcaataa

SEQ ID NO: 328 - DNA, 165 bp, Chryseobacterium sp.
atggcagaatataaaaatccttatttaaaagatttaagtgaaaaagaattagaaatctatgaaaaaataaagcccctactaaaaggagctagttataaaagtttttgtaaaatatttttatcattacaatctcattataaagaaacagcagttattttagcctag

SEQ ID NO: 329 - DNA, 2967 bp, Chryseobacterium sp.
atgatgaaaaaaaatacaatacaatggctgttatacttaacaggaatattgaatgggattgtattctccaatatgttaagagcccaatccccggaacttaattttgggaactttgcccatcctgttgcatcagtatcctctttagcagcttataacaataccccggcttcactagccagtggtacttcaaatatatctattcctttgcttgagcttcctacccgttccaagaatatttcattgccattggcactggcttataattctaagaatgtaaaaccgctggagcctgccggagaagctggtacaggctggtctcttcttgcgggaggagtcatctcgagagaaattataggctccttaaatgaggttcaatacagtgagaatcctttgagtaattcctctgaaatttttaatgatatttactattataatttaccgggagtttcagggaaattcaaatttaacaaaaatgcaactactggaactatcgatattcagagtctttcggccaataaggtaaaaatgacctatatcagggataccgcagcgctgatctattttacagtattaagttttaccattacagatgaaagcgggtatcagtatatttttaatgattatagtgagagtagtaatgtggatgctgttctgccgtacaggtcagccttctttttaagccagatcaaaatgccggataatacggttgttgcaagctttgaatatagaaaagacggcaagcatgctaccgcagagtcgacttctcctattgtctatcggagttgtaaactttcaaagataaatactgatggcttaggctcggtgagtatagattaccagtatgatacaacgaaggaaaatactatgaatgatccctacagtatttcacaaatttttttgaaagatgtctggggaagtttgatttcgggatataaattcgtttacagctggactcagctttatccatctactccttcagataataccgaggagaaaggaagaaggctgcttacaaaactgataaagattgacaaagaccagatagagtctgaaaaaacaagttttgtatacaacccttatcaggaggctcttaatgagaagtttatttatccttgttatcctgagcctgtttccacacccggtaatttcgaatattaccagatgccgggactattaaaaagaattatttatcctatgggtggagtcgtggaatatgcttatgaagctcatgattactttttcaatagaagtattccacagtatctggaaaatgtattgggttcaggaataataggtgatccatatgtccaggattgggagccggtagttccggtactcagtgtagataccaatcagagcttaacatatactttaacagtgacaggaactccgggagtaacaaaatcagtagcattacaatttcttgttagtgaatattatccaccgggaatctgggttccggatactcctgatcctaatgatcaatcagccccggggggtgatcctcaacccggaggacattatcattttgacttgacatatacactgaaaaaaaataatgaagtgatgagtacattttgtatttccaatcaagcatctatttatcaattattaccaggtacttatacgataagtgtttctgggacaggaggtaaagcgcagcttctaatgtctcagataaaactgaaaaatggtccttatcctaataagatcagtacttataagtatggtccgagactcaaaaacatcaaatattacagtagcattacggaaactattccggcaaaaacagaacagtataactatggttcattcagtgatccgattagctctagtggttatattttcagaaatgaaactgaaagtagtagtttttttcctggctatgtattgtataaaaatgtgactgtaagtgatggagaaaacggttttgtgcggtattatttcaaaaatccggatgattattcaaaaacttcatatacagtggatggaaaccctacgagcttttggcaatactatcctataacaaaatccggtgtattagaaaagaaagaggtatataatgcccaaaaccttttattatcctctttagaatacgagacagaatttgaaacacttcaaaatcttcctgatctgaaaataggtgcatatgatggtaatgcagaagtgtatactaaacctgcttacatcaagaatacaaaaaccactacaaaaaacttttcagggagtgtctttgccaagaccatcagtgaaacaagttttaattctgacaactttaaagcaggatttatgaaaggaatatcttctgacggcatcacaacagaaagctggatcagatatgcagcggataaaaacaaaacacagatgatgaatgccaatatcttttctgtaccactggaaacagagaccaagatagatggaaaagtagcagctaaaacagaaaatttctatactgattcgggaagatttgatccattatcattaaagataagtaatgcagataatggaagtagtaaaacagctataaaatatgaggtctatgatacctacgggaatatacgtcaatatatggtaaatgttgatgagaattcaggaaatggatttcctattgtcttaatctggggatataaccaaaccatgcctattgcaaaaatagagggtgctagactcacagatataggaactctggcagatgatattgttttaaaatccaatgctgacaaagatgttccatctgaaacagagcttgttaaagcattagatctgttcaggagtaatgctgttttgaaaaactttcagattacgacctatacttatgatcctttagtaggtgtgaccacgacaactcctcctaatggcattcgtgagatctatcaatatgacagaagtggaagactgaaaacagtggcagatgtaaatggaaatattctaaaggaatataagtacaacagcaagccacaaccttaa

SEQ ID NO: 330 - DNA, 1362 bp, Chryseobacterium sp.
atgtcagacgtgaatcagtatatccacaatccatccgacttcaataagaatctggtgaggttcaattatgattcccgtgaagatgtttttgacctggtaacctatcagaaagggggaggaattctcaatatgctgagaaactatcttggagatgatgccttctttgccggaatgaatgactatctgaaatccaatgaatatcagaacgcagaagcacatcagctgagactttcttttgaaaaagtttcggggaaagatttaaactggttcttttatcaatggtatttcggaagcggaaacccaaaaatcaattactcaactacatttgaacctgtgaaaaaacaggtggcggttactattaaccaaactcaggaaaaaccatttgagttccctctggcaatagatgtatatgacaatggaaagccaaaaagatataatgtatgggtaaatgcagaggcaaagaatacattcaactttgatgtttctaagactccggatctgataaacattaatgcagacggagttttattggcagatattacagacaccaaaaccccagaacagaacctgatgcagtttaccaattctaaggagtttaaaaataggtataatgctttagcgggaataaaagatcaggttggaaaaagccctgctgccgtaaaattacttgctgcagcattgaaagatccattctttagaataagaataaaagcattgggattaatagaccttaccaatcctgagcagatgaaagcattaggtgctgatgttgaaaaactggcttcgaatgatcctaaaaccttaactcaggctgccgctattgccgctttaggaaagacaaaagataagaaatacattcccttatttgaaaaaggagtcaatgctgtttcaaatgctgtgaaaggaagttctatgagtgccattctttcaatagatccgtcaagagctaataatctggctgataaaattgatatgaaaggagcttcggatgagctgcaggcacaattgcttccaattattgtgaagaataaaattacttctcaaatggaaaatattacaccgcttgcaacattttatccatttattaaattccagaatccggaattaggaaaagcagcagaagaaggattcaattggattatgacttcagataacctgaaagcaactgaaagtgtcacaaaaattgcgggatatgccaaaaaccaaatggcagataacccacaagcaaaaatgatgatggttcagattctgaaagacggcttaagcaaaaagatggagttactgaaacaaaatccacaaaatgcagcaagcatcaacaagcagattgatgtcatcaataaagcaattgaaaattataaataa

SEQ ID NO: 331 - DNA, 333 bp, Chryseobacterium sp.
atgaaaaagaagttattcaccttattagcttttggattatttgcaatagctattaatgctcaggaaactgtaaaacaggaagcaaaaaatgtaggcaatgccattcagaaaggcgcaaaggcaacgggaaaaggagtgaaagatggtgcagaatgggttggagataaaactcaaaaaggggcaaaagctacaaaaaaaggtgttaaaaacagcacaaaatgggttggaaaaacggctaccaaaggtgcaaagagtgttaagaatgttgctgtaaaaggagcagatgcagtttcagatggttataaagatgtaaaagcagatttaaaaaaataa

SEQ ID NO: 332 - DNA, 1206 bp, Chryseobacterium sp.
atgaaatttaaattattgaccgctgttctttttgccactataggaaatcatgctctctacagccaaaatagctggaatttaaaatacactttcacggaccactctcaaaactgggttgctgcatttattgatgaaaataaaggatttgtatctggatttactaatgatggcaaaggagccattaagtacacggcagacggaggaacaacctggaccgaaattttcaaacagaataatttaggatatgttcctggttttagctttcttgatgaaaataatatatgggctttccatgaccaaaatatctataaaacaaccaatggaggtatctcctggacagtatcaactgtaagtaactctatgggctatcttagaagtgtgaagtattcttcccttactgaaggaattatgaaaaccagcaaaggcaaatacaaaaccacagatggaggtcaaaactggacagtcgtaaaaatatattcttcaaatgattttgagcttaattccaatggtcaaagtataaacccaagtactggtgaaggatatggcattatcggcatgtatctctatcaaacctctaactatggagagacttggacacagattttaacaatgcctgattattctattgcccaatcccgtagatataccagtgtacattataaaggatatcttacaggagaatatttctatggtacattaggctacgatggcacaaccttccttaaatcgtcaaacaatctctggcagaaattacccaataacttcattagatatgctgttacagaagctttcccagatggaatgtttatgggatatgcagagcaaaaaatatacaatatgaaaactaaggatgtcatctatacacttccgggaaacgaatatatcagctatatgggaagcatcggaaatgtaggtcatgctgtgggaggtaacaaattttataaatactctaacacatctgcattggcaacccaagaaacaactgtaaactcatttaaagtttatactcaaaacaattcagtcgttgtacaatccccttcaacacgtgggaatatttctatttatgatatgtccggggccttaataaagtccggagttcctgtgaagaaaggagaaaccaaaactattgaacttaatcagggagtttacatcgttactattcatggtgaacaaaaagattattctcaaaaaatccagattaaatag

SEQ ID NO: 333 - DNA, 1023 bp, Chryseobacterium sp.
atgtataaatttgaaattattgatcagctagaacctaaatggaatgaaatcataaaatcttcaaatttatatgacttccaccatacatcattttatcatttaatagataataactttgttaataagctttttgtagcatatcataatgaagagtttatagctttaccacttgtaataagacctattgaaaattcaggattttttgattgtacatcagtatatggctatgcaggatctgttaccaacaagaacaatttcaattttgatccggaatttcatacttttttcaaagaatcatttgataaatattgttcagagaatttaattgtatctgttttttcgcggttacatcctttaattgataacagtatctttttcagtaactttggaaaagtagttgatattaataaaacaattgctattgatctgacaatctctcccgaagaacaaagaattcaatatagaaaatctaataaatctgaaatcaatcaattgaaaagaaaaggtttttctgttgttgaagctacctgtcaggaagatattgatgattttgtttccatttattatgaaacaatgaatcgggtaaatgcaaagccaggatattttttttcaaaagaatattttaaatctttcctaaataatgataattttgacagtaaacttcttctggcaaaatacgatggtagaataactgcaggtgcaatttttacgattacaaaaaaaataatgcagtatcatttagcaggaactaccgaacaatacataagggagacacccatgaaattgatattggatgaagcaaggttattgggaaatagacttggtatggaatcattacatttaggtggtggagtaggaggaagtgatgaagattctctttttaagtttaaatcaggtttttctgataaacaatgtgaatttaaagtatggcagtatataactgatattacaaaatataacgagctatcaaaagatatagctgataaaaatagtaattttttcccactatatcgaagtaaataa

SEQ ID NO: 334 - DNA, 1020 bp, Chryseobacterium sp.
atgaataaagaatttggttcggattttcattatatataccctgaaagaggagaagttggattcttggattcccaatataatttgactttgtttttttcaggaagagcagctatatataatctaattaagtttggagtgcaaaaatatggatggcaaaaggtgggatttcctagctattattgccatgaagtggtgacattttgtaaggacttggatattgagagtgttctatatgaatataaccctttaattgataatgatattagttgggatgatcaagaaggtacagtaattgttaatgttaatttttttgggatcaaaaaaccgaatgtaaattttcttaaaaaaacagttataatagaagatataactcatgatttgttaagtatcgataacggaactgcagattattattttggatccttacgtaaacaacttcctataggagctggtgggttttgcagccttaaagaaaatgaaaacttttcagaaaacctacaaattttattggatgctgaaaagacttatcagaaaaaagaagtagcaatgtttctcaaagccgaatatcttcaaaatagattggctgataataatttgtataggaaatattatcaggaagcagaaaaaatgtttgaaagtcagctaaccaattctttattaccaatacaagcgatataccaattacaaacatttccaatagtagatttaattgaaacgacaagaaaaaatcttttattgggaatagaagaaattaaactttcagaaaaatttcaaatcctaaataatcagaacggtttctgtttagttctttgttgcaaaaatgatgagattagaaatagtttaagagagtatttaattgaaaataaaatatttccagctattttatggccagatcaaattcttaaaaacgataaagatctacaaaataagatattgtgtatccatatggatttcagatattctattgatgaaattaaacatattgccaacatgataaatattttttttgaatatgtataa

SEQ ID NO: 335 - DNA, 1224 bp, Chryseobacterium sp.
ttggagaaagatataggaatgaatatattgtttctaaccttagctaaggtgaataccttgcaggaacgaggtatttatcaggatctgatgcgggagttttcagatcataatcatcacgtatacattgtgagcccagtagaaagaagagagaataaaaaaaccaacttgagaagagaagggaatgctgcttttcttaatgtgaaaacattaaatattcagaaaacaaatctgatagaaaaaggaatttctactctgaccattgaaaaaatatttttgaaggcagtaaaaaaatacttttctaatgtgaaatttgatgtggttatctattcaacacctcctattacatttacaggtcttattaaatatataaagaaaagagataatgctaagacatatctgcttttaaaagacatttttccgcagaatgctgtggatatgaaactgctgtcggataaaagtattttatacaagtattttagaaaaaaagaagaagaattatacaggatctcggatagaataggatgtatgtcagaagcaaatgtcaaatttgtattacagcataatccagatattcaaaaaaataaagttgaaatcaatccaaactccattcggctgcaacacaacagtaatatttctgaagagctgaaaaaaacaattaaagataagtatggtattcctttacaaaagaaaatctttatatatggaggtaatttaggaaaaccgcaaggaatagattttcttatagagacactagaagctaaagctgaagatgataaggttttttttgtaattataggatctggaacggaatatggtaaaataaaaatatggtttgatcgttttcaaccccaaaatacattactgctttcagctgttccgaagagtgattatgacttattggttcaagcttgtgacgtaggattgatctttttacataaggatttcaagattccgaattatccgtcaagacttctttcttatcttgaatataagatgcctgtacttgctgctactgataagaatacggatatcggtacagacattttgaaaaataaatgcggattggctgttttttcaggagacttaaacgaaatggttcaagcagttgatcaatttatagaaatggatgatgtgaaatttgaagaaatgaaacaaaatagctggacattccttgaaagagaatttcaggtatcaggttcttatcataaaataatacaatcttaa

SEQ ID NO: 336 - DNA, 1239 bp, Chryseobacterium sp.
gtgaacttgaaggctttgtcagataataattttgaaacatatttcttggttattacactgtttggatatattttttgttatgttgatctttacacttcagatgcagtacctcacttctttaatctattaattcgagggacggttttactgtcatcattatattttatcttccagaattttaagattataaaacaaagaagttggcccattgctatttttcttctgttttattttctatatcaaataaaagcagtctgtacttttaccaattcttatttcgttccggatggttttcaggttttaaagaatgatttctattattattgtttaatcatcatacctttgccggtaattgcgctgttaagtctcgattatgaaaaggtaaattttaaactattttataaaattattttttggtttctttttattattttaggagttaattttctgcatagtactctatttgtaaaactcaaaaatggtgggggaatatttagatcctattatattttaacaggacattacggattaagcttagtattgattggactttacaattttttgtttttaaaaactaaaaactatgtgtatttattggggatcttgcttgggttatttccaatgtttatgtcttccgcaagaagccctattttagcatttgtaattattcttttactatttattatactcaaaaatagcagacgatattggatgtatttttgtttaagtgtattgatatccattattggtctttttattatctataaaagtggatttaagaatgatatattattttttaagagactgaacgaagctgtttttgaaggcaaggcttcaggaagatcttattttctgaataaaggaattaaagagtttactaataatccttggttgggagggagaatcttatttgaagacggaatgtattcccacaatttattggttgatatattgatgtcaacaggactaataggattatttttgtttattggttattataaatttgtcacaaaggggtttgtgaaaattctaaaaaatattgccaaatacaaagaaagcggtataatagctttttttttcatgcagtattttgttttagcacaaacatcagggagcctttattcttcttttgaactttggtattttagtgcagtcataatagggttaagttatataaattttaagaatgaaaaaattaaaagtaatgacagtcgtgggaacgcgaccggaaattattag

SEQ ID NO: 337 - DNA, 963 bp, Chryseobacterium sp.
atgactacaaaattattcaccatacttattgcctcaattcttttactatgtactgggagtaaaaaatacaatgttgaattaccggaactggtaagtagtcaggataagccccaaatacttatttgctctgataataaatccaaaacttttgttgattttattactcgtgaaaatatcccgtttgttcactttgttaatgatggacagtttatggatagtaaaaatccttttacatttagtcaggatttacttttaaaagagttggaacgctcttatcctgatcctaaatcgtcaggtattgcttatatagatatagaatatccttatacagactatctcttaaaaggagatattacaagtacaaactacaagaaaagtgctaaattgtttttggatgtactgcgttttgtaaaacaacacagaccaaatgttaaatggggatattacggaattcctttcaccacctactgggaaagagacaaaaatttctatgatcagaataagaaagtagaccaaattattaaagaaagtgatgttctttttccatccatttatatattttataataatgtgagctttaatttggaaaataagacctacatccaggaaaacacagaggaaatgcttaagatagcagatcgatataataaaaaagtatatccatttataatgtcccgctatcacccatctaataaattaatcgggagtagcaaaataggtgaatctgattttagaacttacgtatcaacactattgcagactcaatataaaaagaagcacgtagatggtcttgttttgtggaatgccgacgggtatgcttacagagtgaatgatccggtgataaaaaaagaagttgaaaaaaataaaataagtaattttgatgttttttatgatcagtatattattggtttattaaatctcatgaaaaaagaagcaaaacaaaatgtttatggaatcaaatag

SEQ ID NO: 338 - DNA, 1185 bp, Chryseobacterium sp.
atgaaaaacacaagtaagaaaattgttatgctgcaggatttttttggtttagactacacttaccaggaaaatttgcttacaaaaaattatatggagttgggacatcaggttgttgtcattgcttctacttttgaaaatatttttgattatgcccatgagaaatatgattctgctaaaaagcaaaaaacagacgagtattatggggctaagattattagactgccttatagtatcaacattttaaataagttgagaagacataccggagtttatgagatcctcttgaaagagaaacctgatttaatatatgtacatgatatacatctgaatttaaaggaggctgtaaaatatcaaaaacaatttcccgagtgtcgaattatcttggattatcatgcagattttacgaactctgcgaataattggttatcattaaatatactgcataaggtaataagaaaatcagttttttataaatacaaaaagcatatcagtaaaatatttcctgttgttccaggaagtgcagattttcttcatgaagtatacggtgtaaaacatgaggaaatgacactattgccattgggatgtgattataataaatcgatagaagtcataaaaacaattaacaaaactcagaaaagacaagagtttggaattaaagaaaatgacatagtactgataaccggcggtaaaataaataagcttaaaaatacccatataattgttgatgcctttaagcaaataaataataagtatgtccatctaatcgtattcggacaagaggacagagaatcagagcagtattttaaagatattaaaaaaagtgcggaaggttacagtattcattttacaggttgggtggataatacgacaatatatgaattgcttgccatatcagatctggcagtatatccaagcagtcagtctgtcctatggcaacagtcaataggaatgcatcttcctttaattgttggagattttggaggacaggacatgtcttatctgaatcaaaataataatattataaaagttgataaagaagatttaaatcctgattattttgcctcgttattgaatagattaattgataatccttcggagcttagtgaaatgaaaaagggtgcagagaaaacagcaaaagagtatttagattataaaataatagcagaacaaacgctggaaaattaa

SEQ ID NO: 339 - DNA, 1179 bp, Chryseobacterium sp.
atggaggtggaaaaatctaataaactgcaagttttttttctcacgcttatgctatatggctatgagctaatatcttttttaccagatttattaaaaatagaatctagaccaatcagtattggtttgagagtcattgttatggctgcaggactattggtgatatttaagaataggatgaaattaaccaaggttcatttcctgctgttttttttctggtttttatacttattaaggctcctttacgatactgctattacttcgaaaaatatcatgtcgcctattaatgattattggtcattttcattgttaataatagtgtcgatgtttgcttgtgcaacaaaattttcagaaaaaactcttttagatgttaaaaactatgttctaattatattattcgtcgttaacatatgggggctatataataatattgtaaatcctcaaattgttcctgaggatattttagtaagggtggacggtaataccagccttaatactgtatcttttggaaagacatcctctgttttattttttttatgttttatttcattgatgaaatacaaaaaaaacgcgcttagcattatatacatcataggaatgattcttggattgtataatgtgtttatggccggatcaagaggtcctcttgttcaattgatagctgtacttgtattctttacagcacttaatatcaggcaggtgaaaataaaatatgtaattatttttttaattatcggggtaacacttttaagttttttcccaagctattttgaggtgtccaaacttgtttttcaaagattaggtgaaaccggatattctgcaaatgaaaatgatcagtacagagcaacacttttaagatcagcctgggaccagtttctggataatccgttctttggagactctattgagacaacgattggaaatacctacccgcacaatatagtttttgagtcctttatggctatgggaattataggaggtatattgtccattatattatatgtacttaatttgatctatggtataaagttacttaggttttttgtctatagcttattcggtgccattttgatcatggatacagttggatcggtatctgctggctctatcgtaaactttctattgatatggccagtcttttctttatccattaatttagctaaaaatgaaaaacacaagtaa

SEQ ID NO: 340 - DNA, 1284 bp, Chryseobacterium sp.
ttgagtattaaaagcatttttgccaatataaaatctaacccgtttttgcggaatgttgctattttatctagtggcactattattagccaattaattgtaattgctacttctccgtttcttacgcggctctattctgtagaggcttttggtcttctgtctgtgttcagcagctttgcggttttttttgctgtattgtctacgggacggtatgaacttgctttaggtcttcctgacgatagtagaaaagctgcaaaaatttttagacttattatttatattggaacctgtgtttcaatactatatcttatattgatttttttattaaaagatattattcatatacaggataagaccggttttctcaaaaataatcaggcttatcttgccccggtatatattttctttggtgccctctattctgcattgggatattggaaccagcgagacaaaagatataaaagaattactattgctaatgcatttcaggtaattgggacaagtgtttttagtatgcttttcggagttttgaaatttgaaaacggattgattctttctcttattcttggaattataatttcaagtatatttctgcttttcacagataaaaagctgcttgatgagttggcagattcaaacaaaggagttttggatgtaggaaaagaatacagttcatttccaagatacatgatattgtctgatctttctcttacagcgtgtcagcaatttataccaattttattttcagctttatataatactacaattgtaggatttttttcaatggccaatagaatgatacggcttccaaatattgtgataacctcttctgtaggcaatgtattcaggaatgatgctatagacgaaataaggaaggagggaaattgtgaaagactatataattccacttttaagaaattgttattaatgtcttttcctatatatttaattattttcacagtttctcctaaattattttcaattatatttggtgcaaaatgggaagtagcaggatatatggcaaggatattgtctgtggcattattttttgaatttatttcagcgccattaaatactttgttttacatttttgaaaaacaaaaaatattaatgaggcttcagatgacgaatgcagtttttatatttatatccatattcctgggctattatttaaagaatgattacttactatcactaaccttttatatgattgtatcagttttatcaagtttagtatttttatattttaccaacaatttatcaaaaaatggaggtggaaaaatctaa

SEQ ID NO: 341 - DNA, 306 bp, Chryseobacterium sp.
atgaaaaaaccagcaattttagtaggagcactagcgttaggagcttttacattaggaactaacacagcttttgcaagtgtaaaatcaattgaatcaaattctatagaagccacttgcggaggtaaagcagaaaaaaccagtgaagccaagtgtggagacaaaaaaacctctgaagcaaaatgcggagataagaaagcagaagcaaaggtaaaagaaggaaaatgcggagaaggaaaatgtggtggcaaaaaagcacaaaaagaaactaagaaagctaaaaaagcaaaaattgcaaaagcgaaatag

SEQ ID NO: 342 - DNA, 450 bp, Chryseobacterium sp.
atggtaggaattgggtacagaaaagaattttcaaaaacattcttaagcagtaatgatctacagccggattttgtagaagtagcaccggagaactggctgggaattggcggctactggaaacaggagttgaaaaaagtgttggaaaaatatccgctctattgtcatggtctttcactttcggtgggcagccctgaaggagtagatgtggattttgtgaaacaagtaaagcagtttttggaagatactcaagcggttctgtattccgagcatcttacattttcaaaggttgacaatgcacatatgtatgatttgttaccgattccgttcactcaggaagccatagacagagtttctcaaaatattttacaagttcaggatattctgaagaaaccattgattttggaaaacggaagttattatacggttttagaagctgagatgacagaataa

SEQ ID NO: 343 - DNA, 273 bp, Chryseobacterium sp.
atgccattggataaagtaaagtatattcatatggcaggacattatcaggttaatgataatctcattatcgacacccatggtgcagaggtaatagaccctgtttatgatttattccgatttactatagaacaaataggaaaagatacgcctgttctcttggaaagagattttaacatccctgaattggaaattttacaaaatgaaatcaatactttgaaagcgataaaaaatgaaattttaaaaccagtttatgaagtttcaggaacacaataa

SEQ ID NO: 344 - DNA, 762 bp, Chryseobacterium sp.
atgaagtttcaggaacacaataaaacattttctctgcaaacggacctcgctttgtattgcagaaccggactgaatgaaccgaaaaccagcattcaggaacatactttccattatagaagattggtttataatgtaataaaagacaccctgaaaaggggatttccaatggccaggaaactcattggtaaaagaagatggaaaaaaacagtggctcatttttttgaatatcataaatgccaaactccgcaggtttggagactcccacaagagttttctgaatactaccaaacagaaaagtttcccttcaaaaaagaatttccatttctaaaaaagctattgcaatatgaatggttggaaatagacgtatttatgatggaagatttaccaattgatgagttcagcacagaaaaaacttctgaagaagatgtcatcattcccaatccggaaattaagattttatcaacagaatttcccattcatctaaaaaatgtaaaagaaatcacacaggaagataaaggacagtattttgtttctattcatcgggattatcatactaaacaagtccatttcaatgacctttcttatccatttgtagaaattattttgaaagcaaatgaagaatattctacagaaaaagatttcatagaattactctcaaaatatgaaaaggatgctgaaaaagtgtttttgtattacaaagagtttgaaaaatttgtattggaaaaaactatttttttaggatttaaaagcccgcagccatag

SEQ ID NO: 345 - DNA, 438 bp, Chryseobacterium sp.
atgaaaaaagcacaaaacataatcaatcagtcctatcaactgaaaaacataattttattactattacgcttggttctggcttatggattttttaatccggctatgatgaagataaaagatatcagcagtattgcagaatggttcgagagtatcaatataccattaccaactctcaatgcgtatttagcaacaggaacggaagtttttggtgtcatcttattaactattggattatttacccgatggatttccattcctttgattgttacaatggttgtcgccattattactgtacatattgataatgggtttgaagcaggagaaaacgggtttgagattccgctatactatattttaatgcttttcacgcttttggtttttggagcagggaaatacagtgtagactatcttttaaaattagacagaaataacgaataa

SEQ ID NO: 346 - DNA, 291 bp, Chryseobacterium sp.
atggaaaaacaaaatacaggtaccccattggaatattctgattcaaaatattttgtttattttgaagtatatccttctgaaataagtaaactgagaaaaattattctgcaaattgagggtgagaacacatttatgctggaacaggaattcggaataacttgtaaaattaataatcaggcaattcccgaaattgttcgtaagctttctgttcataatattgctgtttatggagttttgtcgagcagtttattggaaagaagtaaaaactactcaatagacaatctatcttaa

SEQ ID NO: 347 - DNA, 3072 bp, Chryseobacterium sp.
atggcattgccattgatatcgaacgtttcgatatgggcacaaacattacaactacccaaaaatatacaatccccgaatgctgcttctttaggaaagtatggggatataccaatggatctctcttccggaagagccagtgtgaacatacctttatattctcttaatgaaaacggtattccattagatataagcgtaagctatgatacaggtggagtgagagtaggagatatcccgggatgggtaggacaaaactggacattcaatgcaggaggtgttattacaagagttgttaaaggaagttcttttgatgaaaaatttaccaatgacgttcctatgggttccagccaatggggaattgccagtggatactattattatactccggcccttaatggagctcagtggaatagtgttaataatatgacaacagtattaaaaaacggaggtataaccaatggtacttatccagcagcagatctggaacccgatatttttattttcaatttcatgggacatgttgggaagttctttttaggctctgatggagtatggaaagtatcttccaaagataatatgaaggtggagatcaatatgaatgataaggtgacacccatgaactttcctgctactaataattttaatcagagaccatttttaaaggtgcttggtaaaattaccatgattgatgagcaaggcaataaatatatatttggaggtatacaggataatatagaatataccattcctgatttctataatcaactggtgaatccagttattgccaatgcctggtatctatcggaagtatatgataaggaaggaacgaagatttattctttcgaatatgaaagaggtgactatttggcatccttctataatactaactcatttaatggttatagcaaacagtttgatggaaatatattcgttccaggagttggatgtagtggtggaagcagtgtaagcaatcaggttgttgctgccggacagcttatcattcctacctatttgaaatctattacgacaaaatcttcaacaactataaatttcttgtcatctattaatagttcattgaaatacagatataataatggagatcctaccttggatgctgctttctccaatatcttaagctatctggcgggtttagctctgccaggagattatgaaaatgctatgttttattatattaaaagattgcaaaacggagtaacccccaatcccaatgtcacatcggggcactttgactcttacctgaatgcattgaaatggagaaaattggatggctttgtagcaagagacagccagagcaatgtcttaaaacaagtttccttcagctataataacacttccactgaaagattgaagctggaaaagttaaccttagataatcaattcaatcatatctttgattacaataactttaatcagcttccaggtctgctttcaactaatgtagaccatttcggatattataaatccactccttttaccctggattataattcaccgaccattcatgaatcttctagggaaacagaccctacaaaagtatattttggaaccttatcaaaaattacatatcctttgaagggttataccatgtttgaatatgagccccatacgtattcaacatatctggattcaaacagcagtctggtttctggaagtggaattatcggaggagtaagaataaagaaaatgtcggatttcagcgatccgcaaaacaaaatcgtaaaagagtacagctatacccttgatgccaattcatctgtatcttcaggaacactgcttcaaaaaaatgtatattatataaagaattttcttatccctacagagaatgggattccttattaccaaactcagttcagcatcggttcagtaatacagctttccaatttgatgggaccgcagattgagtattcaacagtggttgaaaaaacagagaataacggatatatcgttaataattttaccaattattcggatttcccaaatttacccaatagtggaaagttaggccagaataattccatctttgatcctcatacggagttcggatataaaagaggtcttccgaaagaaaggaagtattataactcaggtaacaatctattaaaagaggagattttcacttataatgaaactactcctcaggcagcaagggggctcagtggcaaattttttcttgcttgccctggatctaacggacaaactcaagaatttgttattgcaggaactgcgtatgaattgtattattctgattttaatcttacgtcaaaaaaaatcagaacatatggaaatggaggacagttttttgagacatctgaaagtaacagttttattgattatgggaattttggggataatttcctgaagagtaaatcctacattgacactaatggaaaattaatatctgataattatctttattccttcgataaaaatggtagtgatccgtatactgctatggtgaatcgacgagaataccctgtagtagaagccagtaaacttgccaaccaggagctgttaagcaaaacaaagacagactatgcccctgtacctactgtggccgccaatggaactgccgtggcagcccgaatattcccacaaaaagtatcggaagctaaaggtaccaatgcttttgaagaaaagctgatcgtcgataaatatgatttagacggacatatcttaaaggctcatttatcaaatgggaactattcctactattattacggttacgataataaatacccgatattgaagatagaaggagcagaaattacagatgaaagtactgtattgggatatttggcaacacttaagactctgcttaatgtagtttcacctgattatacccagataatccagcagcaagcgaatatcataaacgccctgcctaaccatctttgtactctgtacacttataagagtgagttcggagttagcagtatcatgaatccatcaggtgtaattgaatactataactatgataatgtagggcgattgatgaatgttaaagatcagaatggaaaacttgtaaagagctatacttatgaaattaaaaactga

SEQ ID NO: 348 - DNA, 5064 bp, Chryseobacterium sp.
atgatcaaaactatacttggattagacttgggaactaactcaattggttgggcattagttgaaatagatcatgatcataaaattgtaaaaattttaggacttggttctcgaatccttacgatggatgctgctgaaattgcgaaatttgagagtggctctaaaacagagagtggtgcggccaaacgaacaacattacgttctccaagaaaacttaatgaaagatatttactaagaagggataggcttcatagtgttttgaatttattgaattctcttccagaacattataaactctccattgaatttgaaaatgaaaaaggtaaacgtagtggaaagtttaaaaaaggaactgaagagaaattggctttttataaagatgataatggtaaatctcaatttctttttaaggatgcctattatcttatggaaaatgattttaggaaaaaatatcctgaaatgttttatcctaaaaaaaatggaaatcagactaaaattccttatgactggacgttatattatttaagacataaagctgttacagatataaattttgaacttactaaagaacaattagcttggattactttaagttttaatcaaaaaagaggttatgaaaaagtaattggacaagatgagaaagttcaaaaagaaggagaattaattgactcttttgtaggcaaggtgaaagaagttaataagcttgaggaagatgcgtatcaaataattttagttgatagtaataatgaagaagtagaattgttcaaatataaagaagagacaaaaattgcaattacggaggttggagatttgaaagaggttaacattatttcaaagtataatgacgaaggttctattgattctaagaaaaccgaatatattattaatgaagttcgtgaatttctaataacagatgttaggaatacagggcgaaaaataaaagaaaattttattttcgaagtagagctggagacaggttggataaaagaacaccagagtaaatttactccaaaatggatatgtagtaagcgagattttattattaaaactaaatatgatgaaaatggtattagaatactaaaaggagcagataaaggcagaaatatcaatattccgaaagaagaagattggactttaatgaaattaaaaactgagacatccttaacatctttcaatacaaaaaataatacaaaaggtgttgcttcctacgtctattataatcttctgcaaaatccaacacaaaaaattaaggctgacttaatcactgtaatcgaaagagattactatcgtgaggagttggacgtaatttatgaaaatcaagaaagatttcatccggaattaggaaatagagatttgtatgaacaagcaattcaactgctttatcctaacaatcttaatcatcaaaagacaattaaacaattagattttaatcatctaattaaagaagatattcttttgtatcaaagagatttgaaatctaaaaaatcattgattgctaattgtatttatgaaaagcaaaactttgagcggacagatgaaaaaactggtaaaaaatataaaaatccattaaaagctattcataaatctaatcctctttatcaggaatttaggctgtggcaatttattaaaagactaaaaataattaagaaagaggaatttgtaaacgaagaaattaagttaaatgtagatgttacgcctcaattattgactaatgaattaaaagaagatttatatgcctttttgaatgataaggaaaatgtaacggagaaagatattcttgggtttttgaacaaaaaatataaagatttagatatttctacagaaaattacaaatggaattttacttctgaaaaagagccttgtaatccaacgagatataacttccttctccgaacaaaacgaattaaaggattcgattacaagacatttttgactccccaaattgaatacagtctttggcatttcttttattcggtaaagaaaaaagatgaatttaataaaggattaaataatctaatttttagattgttagataaaacaaatttgtctaaagagtttcaatcagaattggttaagaactttagctcttttggaggatatactaacgattatggaacctattctgaaaaggctataaagaaaatgttaccttttttgaggcttggaaaatattggaatccagatgatattgagaatattctttcaaaatcaaatcaagaaattaaacaaaaagttttagataaagaggaaatcaatggagagttaaaagattttcaaggactttgggtttctagtgtgtgttatctggtttatggtcgatactcagaagtgggagaagtgcagttttggcaatcgccttatgatattgaaaattacttgaagaatgaattcaagcaacattcattgaataatccaacagttgagaagattttggtagaaacgttgcacgttgttaaggatatttggaaatattacggtgaggaaataggaaaagatgaggaagggaaaattatttataataagttattcgataggattcacattgaactaggtcgagagatgaaaaaaaataacaaacaaaaagaaagagatgataaacaaaacaaagaaaatagaaaagctaatgaacggatagtggaacttttacgtgagctaaaacaaagtaattcttctcttcaggaaaaatcgtcattccaacaggagaagcttagaatactagaagaaagtcttctttcgtctattgaatacgataaagacaataccgaatataagctttccaatggaaaaataactaaaaaagaaatcaaagatataacatcaaaagaattttctaaaattagtagaagtgattttgaacgatataaactttggttagatcaacgatatcagtcaccatattcaggaaggtttattaaattatctgatttatttgaccgaaaaaaatatgagattgaacatatttttccacaagaacgtatcacgttaaatgcgctttataataaagtaatatgtgaaacggaaatcaacaaagagaaaaaagcttctacaggatatagttttatatctaacgcaaaatctaaaaaagttttttgctctgcacacgattcagaagttgaaataattgctataaaagattacgaagatttagtgaataataatttttccggaagaaaaagagaaatactattgagtaaagaaataccggaagaatttacaaatagccaattaaataacagtcaatatatctccaaaatggcgatgaaattgttgagtaatattgtacgagaaaaagacgaagatacattccgttctaagaatgttttggctacaaatggaactattaccacaaccttaaaaagacattggcaactgaatgatgcttggaatgaaattatttctccaagatttaaacggttgaatgcattaacaaatacaaatttattcggagattatagagaaattaatgggcataaagtttttataaataccgttcctgaggaaacaagcaaaaatttcgattctaaaagaatagatcatcgccatcacgctttagatgctttgataattgctttgactacggaaaatcacgtcaattatttaaataatatttcatcacaagaaagtagcgaagagaaattaaatacaagaaaagcaattaaatttcagttaactaattcaagaagaggttttaatgacgaaaaagaatggtatttcctgccacctgcacagataaaatcaaaagatgggattgatgaatttgaatatcagtttaaagattttaaaagcaaagtattcaaagatattgctcaaaatgcattagaaaatataatagctagttttaaacaaaagaatcgcgttattcgacagcgttggaacaaatatttgaaatctgaagatggaaagctcaatatcattaaacaggaaaacttagaacaagctgtaaattacaatgtaagaaaaagacttcacgaagatacattttacggtaaagtcaaattacaaaataagattactacacttagcttggagaaagcactaattgaaaaatatgatttagttgatgatgaattagtaaaagaaattgatgttttaaaaaataatgaagataaatctgtaaaagagattatagagttattaaataataaatatgctaaagtttctgtttatgaaaaatttgtagcaacaaggtttggaaacaatttagagtccttttcacagataccgtcggacaaaattattaaagtcattcaatcaattacagatacgggaatacagaaaattttagaaaaccatcttgataattacaaagaggttattaatgataaaccaaggtttgatactgaaaatgcgttttcatcagatggtgttaaagaattaaataaaaacattattgagttaaataatggcaagtttcatcatcctatttataaagtaaggacaagtgatgcaatgggaacgaagttctctgtatcggaagaagggcaaaagagtacaaaatttgttgtgacggcagctggaagtaattctttctgtggtttttatcaaaacggtacagagagaaaattctatattccaactttgcgagaatccgttgagagtttaaaacaaggatttgaaccttgtcctgcaatacatcctgaagattcagatttcaaattgatttttgtattaaatccaagtgattttgtgtttgttccaacggaagaagagaaagacagtcttactctaattgatttcaataatttgagcaaagagcagatgaataggatatacaaatttacggatggaagtggaacgactatgaattttgtgcctgctaatatcgctactccaattatagatattaaagcagaagaacataaaaaaataaaagataacttattattctgggaagaaataaatgaaacaaaaaaaggaattgtaaaaaaaataaaaccattatttaatgaagttggattaggttctgaaaataaaacaaaaagccaaaatacttacagtagagaacaaattaaatcaagttgctggaaattgaaagtggatagattaggaaacatctcaaaagcataa

SEQ ID NO: 349 - DNA, 672 bp, Chryseobacterium sp.
atgtttataggacatttcggtttatcatttgctgccaaaaaaatagcgccaaaggtttcattagttaccttatttgcagccactcagtttgtagacattctctggccttttatgctcatttttaatatagaaaaagtagcagttgttcctggatatactaaagtgaatgcatacgattttctttactttccatacacccacagccttttgatggggattatatggggtattcttgctgcattcatttattttttactaaaaaaagatatcaggagcgctgtggttattggtttatgtgttctcagccattggttctttgatttgatcgttcacacaagagatctgcccattaccccattcagcagttataaaatgggattcggactatggaatcatattgctgctactctcattattgaatttcttatcttttttggaggtttgtttgtctatacatctgcaaccactgcaaagaataagaaaggcaaatggggactttggggattgatcgtattgcttgttgctgtgacgctttccaatacatttggacctcctccacccgattctgtcaaaattttatttatatcttttgtgattctcatggcgcttattctctttcttgccggctgggttgataaaaacaggaaaataaaaccttccattgataagtaa

SEQ ID NO: 350 - DNA, 381 bp, Chryseobacterium sp.
atgataagtaagaaaagtttatttgtgattagtttacttgcatctttatcaatatttgcccaacaaataaatgagtataaatttctgacaaaagggcaatatgatagcaaaatatatgaaaagttagaaagaaaggatgggaataaagtttatgtatggcacaaaatagaagaaaccataaagaataatccgggaatagcatttactgagttttatgtacagatcaattgtactacaaaaatgagtgtattaaaaagctccattactcattggagagatggtactgttcaaaagtttgatgattcttcaaataaggaggttccaataacagacctcacatcttttcttgggctttcatataagaatcgttgtgtgaaataa

SEQ ID NO: 351 - DNA, 231 bp, Chryseobacterium sp.
atgtatgaagagcctatgttgcagaatagtcaggtaaatttaatttttggagaagaatatacaacatgtacggatactgatatagttcctactatcaatactaaggttacaataaagccagttgccagaagttattaccaagattatgcagtagcagaagttattactgatttatctactgtcctgggtctaaacttatctcaggtatttattagtggatatgatcgttag

SEQ ID NO: 352 - DNA, 867 bp, Chryseobacterium sp.
atggcctggaatgtttctatgggagtcacatggaatcatggagaaaatgagagtgggggaccgcggttaggtagaactttacaagctgcttttgatccttataatacaagtagtgagtttacaaatggaattgaacttagagaaatgaaaagacttgtaactggtgttaaatatttgattaataaaaaaacgaatcagacattaatggttaatagtaatggagatttagtgcaaatttcacagggtattcgcgtgtataataagtttaatgtaataacagatgagaatggatattataaatttaaatatacatcaagtaatcttatgataggaagtacaggagcgattaatggaagtaagctttctgctggacagaatgccacttatccaaatgataccaatcaaaggttccgtattatgccaaatggttcaggagatggtttttattttatccaagatgtgggatcaggtttaaaccttgcaatagaaagtttatccgatggtgcaaaaatcattttaggaaccaaattgggaagcgattctgaacaatgggctatagtagaagaacctacagggccgtttgctccgacggccaaaaatgcaggcactccaaagccagttaactcaatctcagtatatcctgttccagctgtagattacctgaatgtagaagtaccttcagataaaaaagtaaaagcagtatccgttgttaatacaatgggtagggaagtgtttagaagtgagcagatttctttagaaggacaaagtgtaaaaattgatgttcagaagcttatgaccggaaactatatggtaaatgttgtgtttaccgatggaagccaatcatcttctaagttccttaaagaatag

SEQ ID NO: 353 - DNA, 1650 bp, Chryseobacterium sp.
atgaaagagatagatagaatagtaattttaggggatagtatgtcggaccttggtataaagaaaaatactatgacaggtatgctggcaagagctatgggtaaaatgcgtgttaattctgtgggacgtttcagtgacacaaaaaactgggcagattttatgtgggaatggtcaggtggtgagagtttaatagatggtaaagacaagaaacaaacagatactttaacggagaagcatatgtccctaaaagagtcaactcatggaagccctggtaacaggttgtccttcgtaaactatgcggtaggcggtgctgtagttcgtgaaagtgaacaattagcaaaaaaaataggattgaccaccattgaagaacagaaagaaaaatatttcaaagaattagatagtgatacgtctaagtctaaaaatacattacatattgtttggattggtttaaatgatactgttactgatggtaaagaccctgcgttaatgaagtcaattgttgctcaggtcaaagagatgactgatcagattcgtgatcgtgtcgctaagaatggagggaaatcatattttatggtggtaaataatcctgctccggtagaagctgtacgttacgctcaaaaacaggatgatccaaaagtacttaaagctcaggaagctactttagagttcaacaaacatctaaaagcagcatttccggataaatatgatgatacgatgattgtggatatgtatgaggcacttaaaaccaatttatataatttacgtcttataaaagctgcacagcgccacggaagaaaagtagaatttggaaaaccggaaaacagtacagacacttcgcttgccaatacactaaaagaatttgaagccatatataaagatactaaaggaggtaaggaagtatttgctgaaattcagcccctattggataaagcccttaaaagtgataatgagattatgcttcataaggaagtgggtgatttaatcattaagaaaatggcagatccaaagacatcagctgaaaaacttcccagcataaaggctatcaaagatgcattaatggttaccgggacctatccaagccagatagattttgtagccaaatactatcaggaaataaaaccagaaaaacatcaggaagatattgccaaacttagggtagagcttgacaaagtatttgcaaacaatcttcctaaacaattggaggataatttaaatgtcgcaaatacagcgttatacgacgaggttgcttctttattgagagaaaataaaaaaggtcccgacaatagtacatttagaaaattactggataatataactgccagtaacttaggatttgtagcgacatctgatggtgcacatcccactcaggcagctcatagaattattgctttaacgatggcttcccatctcgttcaaggcttttcggtttctccaagtcctgattttgtacagaaagctaaagatgcacttgttgagactgaaatttctgcagaaaaagcaaagattcaatttgataaatcagcttatgttacaccaactgtgaaggcagatccaaaggcagcagccctctctgctgaagccctaagacaacagcaacaaaaaggtttaaaacaagaaaaacctattactaaggcgcaccatacaagcctttaa

SEQ ID NO: 354 - DNA, 1302 bp, Chryseobacterium sp.
atgttaaattacaaacaaaaatcgacaaccttctataaaaggttgcttcctattgtattatctgtgatgtgttcatgtgcaaatacagacgatgaattttcaaaaggcccggaatcttcaaaacaagctggcttaaatttgttcgaaggagatatcatatttgataagatgaatctatctgcttccattaatcctatgacaaaggtgtccaatattaatttcaatcctattaacaatcttgatacggatggggatggaattagtgattatgctgaagataggatacttgaattagataagaataacccagacgatgctaaaaaactagatgcttcttctaagataacaatccaaaaagatgatggcactatccttaaactccctttttatcaaacaagctattatcaaaattatttttgtaatattccagagcctacatttaataggaatcaactatcagaagcggaggtgagcctccttaaattgacctatgaaagatggttaaagatattacgtactgctgagttccaggattatatattaacaaagcctgcaggaagagaacaaggcctcaaatttattgaaaaagcaaaaaatcttactagaggtgttgagttcagaagtatcccaaataaccaaggagcagtagggctctcaaatagttggagttacattagtataagccactgggctatgactcctccttatacaaattatttagatggagttccacatgaatttattcatcatattggatatggacatgagtacgattatgcttatggaggtgggtataaagctcggaatatgctgaatgaaaaaaaggatgattatgaagtttatgacttagaacaaaaggctctttataccaatcctctagaatcactatggaatggttcaaacggatatgctgttttacattacgctgaatttacagattttccttatataataaacaattggaattggacaacaaattcagtatataaaaatgataaactaaatttcgttaagggaaaaatgtataatttaaaagttagtactctcaatcaacagtatgtttctatttggattgattttaacgatgatgctgaatttactgataatgagaaagtactttctaatggagtttgtaatggaagctgggctaattcgtctttatcttttactattccaaattcggcaaagctaggaaaacatttcatgagaataaattccagttatggtaatgaaccttcagcttatggacccaatcgctatggttcatctattaattttaataatataaatattgtgcagtaa

SEQ ID NO: 355 - DNA, 402 bp, Chryseobacterium sp.
atgtggagcagaaccacagataaaacggtgaaggaaacaagagaaagaaatgtaagaacttcagagtatcaattagtaagtttgaatacagatgaactgaaacatcaacttactatggcacctgacagaaacaggcttacttcagaaacaggtattcttatgaaattccctaatgatcaagggacattcgatacctatgaagtatttgaagcatccaccatgcacccggacctgcaggaaagatactctgaaataagattttatttgggaaagaaagtaggggatcctagtaccaatatcagatttacctacgatccgtactttggattgaatgcagtagtgagaggtattaaagggatgtattatatagattcctattctaatttttttgagttcaaatga

SEQ ID NO: 356 - DNA, 288 bp, Chryseobacterium sp.
atgatgagtaagctcactggtgcactcggggaatggaacttgcaagaaaatagagctttttattatagtgaagttgcaagaacaggagcagataaagctaaccaggcaatgagaaaagcagatcctgaggcatataaaggattggagattcatgagattcatcctgttaaatatggaggaagtgctacagatccaatgaataaaatagctataccaagggattatcatagaaaaatagttacaccttggtggaatgataatatgagatcaattaaaaaaataccttaa

SEQ ID NO: 357 - DNA, 123 bp, Chryseobacterium sp.
atgccagctatccaaatatcaattcaaatttctattcatattattaaaaatagagtattgaaaatcaatactctatttattatcaatgcttttgccgcattaaccaaagtcagtactttatag

SEQ ID NO: 358 - DNA, 873 bp, Chryseobacterium sp.
atgtttgatcctgatggcaggtattcaacagagaccatagtagatgctatgtggaaggctacccctgatggtacaaattcttattggttcagtgatggtggagggtttaccagctatgacggaggtcctaaaggaggaagcggaggcggaagtcttgcgtacagttctagcgtaagctatggaggtaatttcagtatgggagactggacgtatgcaatgcctcctgtagagctgtcaggtaataaatccggttgggcggcacaatttaggagtcatatggagaagtatgccagtaatgttcctgaaattaggcagtcttattataattttcacccttatcaaccagataatactctggaatggtatagctttggaggaagggcaaactggggattggcagcagcagcatcaagtttagaaaattttgcagggcaggcaagagtgacaactacaggctcaaccataaagttataccgcgttaatgctaacggaaatgtttttattaaaaatgcctacacaaagacaacaggattaaaaggtattggaacttggactggatatggtagtgcaggcattgggcttgccttagatacatacggtatgattgaatggtcaaaggacaggaattctccaaatgcagttcatccagcaaaagcaagtgttaatacttatgtaagtgcattaggaatttttggtggaccagcaggagctgcagtaagtatattttactatggtgtagattctttctatcctggaggatggggaggtgcaataaatgatactgctcaaagacagcagtcatttaataacttaaatcaaaatagtggtttaccacatcaatatgtatttccttatggagcacaaaagctttga

SEQ ID NO: 359 - DNA, 1575 bp, Chryseobacterium sp.
atgagcattccaatcagcgacgttgaatatctatacacgaatgatattctggtacaagacatccttaaaagaaccgatttaaaatcaggaattgatttaaattacagagaaaccactatatggcatgatgataatcccattcttcccacaaccgttttagatggtgtgatttatagaaaatttggcaacaaatactataaacttcaattttccggacctttagatgccagatggtttggacttcaggatcaaacagatgggtgggaagcccttacaaaaggagtagatatggcagcaaaactacatgttcctctatacataccagcgggaagatattccctttctaaaccactaatcctacctaataatgtggaaattataggggatggaactagtaaaacatggattgataatggttggactcctgtagaaggaggaattatgcttaaaacctcaaatccaagtcctgaatatatcaggttaagaaatatctcttttaatggagcaaaagtagatcaatggtttgatgtaggtggtgataattctcagggggcacaggctttttttgatcttgaaaacattgacgttcataatatcgcaaatgggaaaggatttgtatgtcatatcccttttcaaatcaatatctttaagaacgtaggtttttataatgtaggtactgctattgaattaacaggatggaccagtaattttaatgctttccataactgtaattttggtggcaaacgaacgattattattaaaaaccagagtgaggccaatactttttattcctgtagatcagaaggaggaggagtaatggcagattcaacccctactattgaggttgaaaatgcaaccaacctgaaattcatcggatgttattttgaatctaccggagcaaatcttttgaaagagatacaatcccgaaatggagttacgtttgatgactgtcattttacaggagctaaaggcaatccatgggctgattttcactttttatctgagggagttgtcaattttataaatccgtattttggagaagtagatggcattgtttctaaatttactttaacaggtggtgttcaaaccggagatacgaaaaaaacattaggacaaagttctactcagattctacaaaacagttctcaggtttcagaatttatcatcgggaacaaaaagcttacctccaatgctaataaagtagagattttcaaaattaagatccctgatgatggtgttgcagcacaaaattttaaacaaatcagcggaaaaataaaaattgattcctacacattcaccaatggaggtttcacattcagcgatgattatgaaatagatatcctgttgccttatcaaagtggctatcctattatgtttcataaaaatgtcagagagatattccataccttatttactgcagatgttgaagttgtaaccaataacaacattgtaagtgttttcgttaatatgaataacccaaatcagctggatattatcaattcagtatgcactataaaagtggaactttctaaaaatacttcaaaaggatttaaggactttgaaatcctgatctaa

SEQ ID NO: 360 - DNA, 1641 bp, Chryseobacterium sp.
atgaaaccacaaatcagattggcattgtttctttttacaatcctgaacaccggattttatttcggacaattgacgcagcaggataaaatccgaaaagcagattccatagtgagcagttattctaaatccaatacacccggaatggctgttggcattattaaagacggaaaagtaatctataaaaaaacatatggacttgcaaatcttgaagaccggactcccgtgaccgattctacggcttttaatatcgcttccgtttccaaacagtttacagcatttgtagcacttttggccgaagaagaagggcgattgtcttttgaagatgatatcagaacttatcttccggagctgaaacatttgcatcataaaatcaccatcaggcagcttgctaatcatacccatggactgccggattatacaactatcaaagatttgcaaggaattggaattgaagtgagggtgactagtgcggatgctgcaaaaacagttttggctattaaaagtatcaactttaagcctggtgatgaatacagatacaacaataccggttttctgttgcttgcagaaattctccacagaatttacaaaaaagattttgcacagatacttaaagaatatattttcaaaccattgcatatggatcatacaatggtagtggaggatgcggtgaatattactccgaatagagcagaatcttatcaggaagacagttccggttttgtaaaaacacctctggggcaaatggggaatggagcttccaatattttcactacactgaacgatttgtgtacatgggcaattaattttcagaaaccatccattggaagccgcgagatatataataagatgcaggaaaatacctttttaaataatggggaaaaagtagagtacggactaggtctgcaaaccgggaagtataaaggtctggatattgtctttcatggtggaggtacggccagctacagatcttatatcctgcatattcccgcctatcatctgtctattgttcttgccggaaataaaagggcctttgacggattgctgattgcctatagagtagtagatatatttcttaaagatcagcagattcttccgccactaccccaaaaagtaacgtacaccgttgccgagctgaaatcatttgaagggacttatgaaatcaatcctggaaattatctggacatcacaacagatggcagaaatatgtatcctaaagggagtaaaactccattggagacagtgggagataaccaatttaatatcccttctattccgacaggaagccttacatttcatccgggatcggtaacattcaggattggagattttacatttatctgtaaaaaagtaattttaaagcctttgaaagaagataaaatagatcttaccaagtttgtagggttttataggaatgaagaattcaataccatttatcagttggttatagaaaataataaactgattgccaggcatcctttgaatcctgatattccattgtatttcctaagcgattcagagctgtattcttctgtgtcattcttcggacggcttgatgttaaatatgacaaaaataaaacagtatctggattccttttatcaggaggaaatctctctaatattgagttcaaaagaataaaatag

SEQ ID NO: 361 - DNA, 2397 bp, Chryseobacterium sp.
atgacaaagaaatacttaataccgttattatcctttttaggaatgggcattcatcttaatgctcagagtatttccggtaaagtatctgatgaaaaggcaaaaaatatttcttatgtagaagtgatcctgttggcaggaaatgataaattctcaacgatcactgatgaaaatggacttttctccattaaacttccaaaagccgattcttataaaatggaatttttcctgaacggaagcaaagtatacgaaggaaatgaaaatattgaaggtgaaattacaagaagctatacgataaaagacagtcagcaagaaagccaggagattcaggcgatcagtctgacaaaaaagaaaaaactgattgaaagaaaaatagaccgtcttgttttcaatgtagaaaattcggttgcagcaacagggggaacggcattggatgctttgaaaaccactcctctggttcgtattcaggatgaaaaggtttctattgttggaaagggtgaagttctggtcatgattgacgaccgcattcagagaatgtccccggatgatttgtcaagcttactaaaatctattccatcagacaatatccagtctattgaagtgatcactaccccaccggctaagtatgatgcagaaggtgacagtgggctcatcaatatcaaattgaaaaaaggaaaggcaaattcctggaatgccaatatcggaggcaactatacccaaaaaatctatgcaggaggaggccttcagggagcatttaattacaaccgcaacaggctgtcattacaaatcaccgccaataccaattcccaaaggcttcgtagcacatctgacagtaagatttactatccggatgaactatggatcctgaatgtgaaaaataaatctgaagagaacaatcttggattgggatttgggattgattataaaatatcggataaatggacaacgggggcaaaatatttgggcagttttaccagaaatacctcatcaaacagtcctttcacctcaaggtttaatccttcaggagccgtgaactcatacattacgtctgatgtggatgccaacaataagcctaatatgaattctcttaactggtacaacacctttaaagtagattctgcaggaacaaaaattaccactgattttgactatttccactaccgaaaaagtgattacaacttttatgcaggaaatgagctggatcctcaaagaaatattcttcctggaaagtttttctcagccacgaataccaacgtgaaccgtattgaaaactattctggaaaagtggatgtggaaatgccgttgaaatgggcttctttaaccttcggggggaagtacacgtatacgaataccaacaatgaccttatggttttggatcataaaaccggaacgcctgttttaaatacagatcagtctaatatttttaattataaagagcataatgaagcgttgtacgtttctgcaagcaaaaagctgggtgaaaaatgggaaactcaggctggtttgagaatggaggctacacagacgaccggatattcacataatcttaatcaaaccaacaaaaatgattatatcaaattgttcccgacagcgtatgtgacctataatcctgatgataaaaattctttctcgctgaactatagcagaagaatccgcagaccgaatttcgattatctgaatccgtttgtggtacgcaccagcccttattattattcggaagggaacccgttcctgaagccgtcaataatagacaatattgagttttcatatgtaagaaatcaaaaatgggtatcctcagtgtattattctcaggtgtcagacttcagccaggatctagccattctggatcagaataccaatatcacaagaagcacgcctttgaattatgccaacacctatcagatcggggtttcaacgtattacaattttaataaatggtcgtggtggaacagttttacagggtttaatgtcaattatcagaaggtaaagtccaaaacagatttcatcagctcgatagacggatataatgcctatttctattcgaataatgacttcacactgaataagtctaaaacaatattcgtcagcgccaattatggactgcagcttccgggacgctatcagatctttcatatctcaacaatgaatattctggatgtttctatgaaattcctgctcctggataagaaactgacacttaccgttaccggtatggatcttttgaacggccagcgtcctgtgatcacttttgaatcgaatggtgtaaaaacagacttcagcagctatggtgacacaagaggggtaagagtctctttaagctacaggttcggaaacaagaatctaaaatctgaacaacagagaaacttcggaaacgaggacgaaagaaacagaattaattaa

SEQ ID NO: 362 - DNA, 177 bp, Chryseobacterium sp.
atgaaaaaattacaaaaaatgagtctgaatgttatgaagaataacatgagcagaaatgaaatgagggttattaaggccggttctggaccaggattatgtgcttgcaagtctgcattctgcatatcgaatggagatggaatggcttactgcggtacaacagtgtttgtatgttgctag

SEQ ID NO: 363 - DNA, 231 bp, Chryseobacterium sp.
atgaagatgattgataatgaagatgaaagcggatctgcacacaatacattaagctataaccacatcatcagttacaataatggagtcggaactgaatggactatatttaaatctaatttcgaatataattccagtgattatcctataaaagaaacccgaacaatttacgagaactacatgggatcaccaacagctactaatatcagtacttttgaatacaatcatttataa

SEQ ID NO: 364 - DNA, 402 bp, Chryseobacterium sp.
atgaaaattaaattagaagagattaaagaaaaatatgtctctcttggtattgcagaaaaaaacgttgattatgcattaaatgctgtaaagtcaggcacgaaaaaagactttatcatgaagaatttaacttcagatattagaaaagtagagcccgctatagcccataatatgttggatgaaatgtttgctgcaaatggcggggaatttaaatatgaaaacagaggaggatatctttattctaccttttacttaatagctattgttggtttaggtattgtaactttttattttagtaaagaaaatagaagtatgcaatttaaattcggtggtgctttattagtatttatagttttatttttcagaacatttatacctactataaaaggcaggtttagagaataa

SEQ ID NO: 365 - DNA, 1005 bp, Chryseobacterium sp.
atgcagaaaatagatcaaatacaaaataatctcgcaataatcaatatatataacaggcatacgttagagaaatttatgcttggaaaaaatgtaatcatttatgatgaaaaagaaaatgtaattgagaaaattaagattattgaacattatgctcctattacaaaggaaataagtgatgcatttcaaaaaagtggctttttatacgtccttacgtttaatatttttaatggaaaagcagatgcaaaagaagtaaggatcattaattatgttgattttattgataaaaaaaataactattccgaaattttactgacagacttcaaaaaagtattgagtttgattgaacaggatttagaggattatgttctagacaattctaaaactggtcctgataatataaaagatcttattaataataaaatactagcacagtattataattctataacactttttaagcaaaattatgggacttatgaaatggttaatagtatttttaaagatcctgttacttttttcattgatattgagaatatgaaaaagatgtctttattatttaataaagctattgcctcaactattgaaaaacataaaaaatacatagataagaattcagctttttataaaaagtacaaagaagaacataaatttatcctaaggagtgaaaagaaaaacaagaaaaagttcaaagagaaaaaacacgaagataatatcgaatggaaggatatatttaaagaaaagtctacctataaacaattcatcaaatatgcgaaaaagcatataataaataggtttatcgattattcttttattttccaaaaaatgaagcatcatgaaattattcataactatacccatttcaaatatattgattggttaagagataataattttattactgacaaagactatgaagagtttgtaaaaaatgcaggatttagaagcctttcaaagtcatcttctgaacagagggaaaataattttaacaatacttttaacctttaa

SEQ ID NO: 366 - DNA, 687 bp, Chryseobacterium sp.
atgaaaacaaattcaatcaatcaaacaactaaagaatccgttaaaaatgaatatgcaaaacttcttaaagaatggaataaacttaaaaaaactactgattttcctttctcccagtatacagatgaaatgtttaaagacgtcagaaaaagtttttctaataaaatcttgcttgaaattaaagctcctcaatatttaagagaaatcaaggaaatacatttaacaggtaagctggactataattttataaatgcttattctcccacatctcaaaaaatatattggtttgcgcaattccaacaactattttctgatagggaatattgggataatttagcttgtgcctatcttatgcaatcttatgatcctaatttacctcatgaaattttgttattgttattttcttctaagagagatgaaaaaaagtacttaatgcatgaagaagattgggcttcctttgaatctttgcctgataaggttaaagtctatagaggtatgagtgaaaaagaatttaaaagtggcaaatttagatttagctggactttagacaaaaatattgctgaacaattcatgataagaaataatcaatattacggacaaaaaacattcatacacgaactagagattgaaaaaagtaagattatagcttatatgggtaaaacagaggaagaagttattgtattattttaa

SEQ ID NO: 367 - DNA, 747 bp, Chryseobacterium sp.
atgatgaatggttttgaatttatacaagcaactgatgggaaacaatactatatggaatcgtttcttaaatcaattatttatggatataatagattagttgaaagtaaaatcacttatagccgttcagaaatacacaatacaataaaaaaaatacaaaactcagataaagcgcataatgagattgaggattacctttgtactgatttggtatcgaaatacataaaacctaatcttggtatttttggacttgggacaattgttgttgacaacggagtacgggaaacaaaaaacaatgttactgttggtcacttagatattaaatttcaagttccgagcctgagtgataattactattttgcatttgaagcaaaaagattagataaaaatcaaaagaagcaaaaatactatatcgatggaggaataaaaaggtttactgacagagtatactaccctgaaacaaatacagttctagctggaatgattggatttgttgaaatggatttaaatataaaaggaagtagagtgacattagataatataaagaactccttaaattctttaatcactaatcatgaaaatataagtaccattcaaccactaataaattattttttaaccgatgaaaatcacacttttataaataagtttaagacaatgtatctttctaaacatacaaggcaagatgataaagctgaactaaaaatttttcacgtatttctcgattattatgatttgttaaaaaattaa

SEQ ID NO: 368 - DNA, 3366 bp, Chryseobacterium sp.
gtgaatagaattgaacaattatttgtacaacttggatatactcgtgaaaacgggttgttttatcttgatgaatctgaaaattggttgaataagtttccttaccgaataagtaaggttcttaaagagattattcaaccctatgctttttatagtttacaccatcagggcaatgaaatgtctgaacatccagagcccataaataatccaattattctattctttaacaaacctgatgatgagacagtaaaaaacattcccaaatgggcgttttgctttggtcaagcacctgttgtcattataaataatgacgatcacaaaccacttgatatttatcacggttatcaatttgcgtcagaacagaattatacattaaagactttagatactgatgtaaatattttttccttaataaatcttacattagggaaaacatggaaatcactatttgataaacattttaagaatgtccctaaagttgacaaacatcttttaaacaatattattgatgcaaggaggatacttattgcatctgatgggttaggactttcgcctaaaatagctaatagattaattggtagattactttttattagatatttaattgatcgtagagttgaatttactgatcaaaattatttacaaggaaatgataaagctagtaaacaagctagcttgaatgagatgatacaatcaaaagagatattatataacttttttgaatatcttaattctaaatatagtggcgatttatttcctttacaagaaaattttgtcgatgaagatactggagaaattatcgctaaatatgaagagaaaatagaagtaaatgaggatcatttagatgtattgtacaatctattttcaggatcatctttctttaaaacagggtcatcttacagaggatatgtagttcaaaaatcattatttatggtatatgattttgaaattatacctgttgaacttcttagtaatatttatgaaaattttattggcaaagaagaagaaaatcacaatctgcgattagataatattaagaaaaaaccaaaacaatttgaaataaaagcatattacaccccacctttcatagttgactacattttatctcaaacagtagaaccttttttagaaaataaacagagttcagattgtaaagttttggatccttcatgtggttctgggatatttttagtagaaactcttagaaaaatcattgaaaaagaaataagttgttctggtaaaaagctaaccaacgaaagactttgggagcttgttaaaaataacatatttggaattgacattgatgaagatgcaattgaaattacaatcttttccatatatataactcttttagattataaatctccaaaggaaatagaaaattttaaatttgaaactttaaaacatgtaaacctatttggaggttctgggtatgatttctttaacgaagaagctatatttaataacaagtttaaagtcgatgtttctctagatttcataataggaaatccaccttggggagaagtaaagatgtcaagttatgaaaagtatattactactcgtaacatcattttctctaatgaagataatcaattatcaaaaacccttataaatgatgatttaaaattagaaatcggaaataaagaaatatcacaagcatttttagttagagttagtgattttgctattaatcctgatttaaaaattgccttagttgtaacagggaaaagtttatacaattcccaatcaactagtaaaaattggaggcaatattttttaagcaactttactgtaactcaagtattagaattatcaggagtaaataataaaattgttgggggtaatcagatatttgaaggagctaaaatggctcctgccatatttttttatcaaatagcaaaatcatcagaggaaattctgaacaatattgtaactcatattacggtaaaacccaatagatttttcaattattttagaacaatcgtgatagaaaaacatgatgttaagaagattttgcaaaaaaactttattacaaagtttgatggatatgattggctatggaaagttatgcttcatggaaatgttttggatttctattttatgcttcgacttagaaattatagatctataaaaaatttaatggatgaatataatttagattataaaggaggtttaaaaattaaagatggtgtaaaaaagaagagtacaactgaaataagtcatttcccatttctgaacgttgaagcaacaagagaattccaaccatataacttatctccatctatgacatggactgaaactgtaaaaaaattaattgataaacggaaaaggacaacttcacggaatataattgactcagatggaaatgttgggtatttacctgatccatattattttataggagaaaaacttctggttaaaaaaggacttcaagcaaaagaagattttaaagctgttgctgcatatactgataaaaacatttcttttacctcaactgtttgttccataaaaacaaaaaacggacatactccacataaaaatacttctttggctttacaaagccttgcgggagttataaattctcgttttttcacttattatttacttaatacaagttcttccgcaggtattgatcgtacaagagtagattttgacgaaattatttcagcgcctgcaatcgaaaatcaaagattagcagaatcagttttacaattacaaactaaatattcggaattaaattcatttacttttaaagataatcaccacgctaataaggaaaatgatattgaaatattaaaaaaatatgtagatgagttagtatatgagtcatttgaggttactgatgtagaaaaatcattgattaattattctactgaaatatctcttccaattttaaaaaggaccgaagaaacaggctacggaaataaagatatttttagatcgttatcaaaggacaaaaaaaatgacgtggattatttgacggattatgcaaatatatttattaatcactttcaacatagatttaattctgatcaacattttttttattcaaatatttttattgctgaagattttatcggttttcaatttgttgtagacgtaaaacctgatggaggacaaacaatattttttaaagaaaccaaagattctcaaatttttaatgatattggtggactgggaatacacactgtcaccagggatctttatatacagcaagatgttcgtggttttagtaaaaatactttttatattataaaaccgaatgaattcaaatgctggcatgaagccgtagctcaccatgatttgttagaatttattgatgcattggctaaagctgaagctggaatatcaaaaactgcaaatatatga

SEQ ID NO: 369 - DNA, 600 bp, Chryseobacterium sp.
atgaattttgaaattatcaaaatattaactccaattactaacattgttttaggagcattattaagtgcacctatattaagtttctttgaacaaataaaaaaaagaaaactcaaaaactacattgaatctcagcaattgattgacaagctggatgaagattttcagaatgattttattaaacctaatcttaaagaaatatatttttatttacaaacaggaatttctaccaatgaaaaaagtatcataaaatatattgatcttaaaaataaactaggtggcaactatacatggaaaaagataaaattggttcaacagtatataaacttaggaaataatacagaccctgtattaaaaataaataaaattgaagatattttttctagaattacaacatggataataattattttaattactagtagtgctataggaggaatattactaaacttttttagcaatgatttaccaattaaagattatttatatatattatttctcatacttattcctttagttagtggtatttttttaatgcgatcaattgaatcaattacaacagcaaaagcaatgatgaaaagattaaaccaacctgttacttaa

SEQ ID NO: 370 - DNA, 330 bp, Chryseobacterium sp.
atgccccagcatatcactgataccacccagctaaaatgtgataaaggagcctcaccaactccactcacagtaacaagtcagtcttttatgaagattgatgggaagttacaggctacagaagaagataaacaacccaataccaacattaaaccttttggaatatgtagtgttttaagatcatcctgtatgccctctcctgttaaatgggataatacctctgattttgaaattgagggtaaaaaagaactgttagatacctctacttgccagtgttctgttggtggtaaaatatctattgtacaatctgctcaaaattttgttgaagaataa

SEQ ID NO: 371 - DNA, 903 bp, Chryseobacterium sp.
atgaaaaagatctttatttccgtacttatgctaatcggaatttcttgtttttcccaaacagcaactaaaaagtataattctttccataatcgatatgaatattttgattctagcggaaatatgattggatatgaaaagtacaatagcctttcaaaacaatgggaatattatactacaggtactactgcacaatctcgacagccaacacaatatcgtgatccgcaacaactaagtatttcaggtttaggaaatgcaatgacagcaaagcaaaacagatacgacaataatgttcagcaagttcaaagtaccgtaaattcaatatctaaccaaatcaataatttagacgttacagacgaacaaagacaactcatacatgacactttccaaaaaagctgtattaatgaagtaaatcgaactaaagttaattactcatcagccaatgaaaccaaccgtgttatacaatggttgtacgattccattaacactataattaaaaacgttacagcgtctagttttaattccatgccagatagcaacaatcagtctagcaattatagtagtaatagtatagtaattgcgaactatggtaaaaaactatctgtatacaacatagccgtttttagccaaagcaataacagattaagggacgaaacgataatgagtgactcttatgttattataaatgaaaatcgaattgaattcaaaagagctgatggatttgtcacttatagagatttttatggaactaaggcttataatgagcaaaaaaaaggttatacatattcgtcaactacaggtgcagtatttatacatgatgatttaaaatatgttgaatttttcacaactaatttagcagaaggcgaaaaatatacatactttattacaccatctggaaataggtaa

SEQ ID NO: 372 - DNA, 1842 bp, Chryseobacterium sp.
atggaagatcagaatacttcagcgcatgatcagaaactttctgaaaaaagagccgaaaaacaaaaaaaatccacagaagattctccttcagaaaaaagagaaatggtcatacatggagccacgttgaagtgtccctatgcccaggcacccggagaactgaaagtgacctcaaacgaaataaaccttcaggataagatatttgccacaaagggggatggaaacaacatggtcaaccttcaattcaaaggaaactgcggacacccgaaatggcctgcaagaaatatgtctcccccaccctgtatgagcgtgataaaattaagtccatgggataatctgggaacctctaatatacaggaacaaacagctttagtaaaagagtcttttatcaattgtgaccctgagtttaatgctgctactgcaacaccgattcctaaagtggagaagattttaacaccagaagaaccaaaatctgaaattgattataagtttttggtcaatttcagaagaggaaattcttacaaaggagaatatggttttgattggttacgagaagaatatattgagccattggaaaaagttttgtataataatagcaatcctcccactccttttaaaactagacccaacggaaaagctgaagctacaaaaatacctctttgtgaaaattttgaagagctgaaatctcaatataaaccatttgttagatttcagaaagactactactgtacctggttatctatatttccaattgattatccgaattctcctcatataaatggtgttaaattggatatcgaagtatttgaagattttaaagaaaatgaaaaagtaaaaaaaccttctgaaatagaaattcactttgaatgcgaaaatgctgatgtgcaaatcactcctaaaattgcaaaaagtataaaagaagctaaaaaagggataataataaaatgtgaaaaagcattatcgaaagacacagaaattatagtaaaagcagttttaaaagatggagataaggaaaaaacgaatgaacaaataggaaaattctttatttatgctaacaatgaaattaaaaatatagatataacaattatagattgtttgatcaataatgatagttcaaaggctttaaaaagaaaaagaggaagcgatttggaaacatatctaaattcaaaagttttaaatcaagctctgattcaatgtaaagtaaaaacacctgaagattttgatttacgattatacaaagaaaatggaaaaacactagtagaaaaatatagtttggagaagacttcagtaatgaaagaattagagatctctcctaaaaaagcttctaccagaattgctgagaatgatatagaaaatttggaagttttcagagatgagttaatgagtttatatgaaaaaaatggaataaataaaaaccctgtaagaaacaaaaacgataaaaataaatttatgttttttgcaaatatttttgttcaaatgggacaaaaagaagaaagattttttataacaaaggacccggcaggaaatgaatcattttctattaaagtaataaatgtagatgcttttgcgtattttaaagcagcacaaccagttggaaatacggttgtttttttcacagaacagaccttagacaatcctacaattgctcacgaatttggacataatttaggattatggcatttatttgataatagtccatatagattttataaaggacatacagataattttatggattattcagaaagagtaagagtggatgtagaagattcaacagataaaaataggaatacaagattagcatactacaaatggcagtgggatgagatgagaaaaggaatataa

SEQ ID NO: 373 - DNA, 606 bp, Chryseobacterium sp.
atgaaaaaactactttttttaggactgatcattttctctgtgttttataatgctcaaagacattataatgttgatattttaggagaaggacatttttattatgatacaaaaactccctttaaagattttattcaaggctttagtaagaatgaatttataaaatcatcaaaaaataatattctggattcaacaaagataagtccagacaagctgaaaaattatcataaaatgattttagataatattcctaagaataacataaaccatatctgggtcatttttggatatcataaaggtaattattattctaaatattttttaggagaaaatttaattaaaaatgaaaataatttttttcttcaattaaattattttgtcaataaaaaaaataatctgattgatagcattggtatttgtattcctaaaaatggatgtagagaaataaaaaaatataagccagttaatcctgcaaaagtattccaatctatggaaatacaaaaaaataattttccagttgacaatagttatagtttaaaaaaatatgaagaagatagaaagaaattggaagctgataaaaaaactatttggacaattgatgaagaataa

SEQ ID NO: 374 - DNA, 804 bp, Chryseobacterium sp.
atgaaaaattacattttaatactaatactgttaatttcctgtgcgaaaaatcaatctaaaagaacctcaaacaaagaggaggtcaatatagcaaaaattgattctacggagattgatggtaaaatatctacgtcttccaagaagcaaagtattcaaaaatatttagatacattgggtattccttcgcaatatgtagtaacaatcccgttggaagttaataaaaaaaagatggacattcagttgcgactctcgaagtctgaagatttgtcaggacgaaaaaaatataccattattgaaatacaagaagacacaaatagctttttacctaagtctgcatacgaatgtatagaaggaaccatagaacttcaacattggcaagttataaataatagttcatactatgatacttatgattattataaaaataaagaatttaaagaaaatgattttgtaaataagaaaaaaataatttttcgcaatggagattataactttataacaataacagacatggataatgatggatatgaagaccttcttattctggatctttcaagctctatgagagacaatgatatgtatcaattttacaaatggtcaaaaaaagaaaacaagtttatatttatgccagattttttcgataaagcagctttctatggatgggacaaaacaggaaaatatttaataaccggagtgagtgataccaaagaaagaaagctttataaaaatacaattgttggaggccaactgaagacggttgatcaatgtacagaatatgcagtatcaaataaattttgttggtag

SEQ ID NO: 375 - DNA, 414 bp, Chryseobacterium sp.
atgaaaaaaaaggtattatcactaattatcttgggtattttgacagcgtgcacttctcccaaaaaagaaaatacagaagttacttcaaataaagcatcagatattaaagctgaacttgtaggaaaatgggtacaacctattccaggacaggaaaaggaaaagcaaggtattgagcttcgggacaatggtaccgcagcatcaataaatatgcacacgttgctgtatgaacaatggaaaatttctcatgataccctatttctatggagtcgtactgtaggagtagcacagccttccacctctagcgatattgacaccttacttattcaaaaacttgataatacatcgttaacggttgtatctttaattggagaccctaaaaataatgttgctcaaacttacagtaaagaaaaatag

SEQ ID NO: 376 - DNA, 777 bp, Chryseobacterium sp.
atgaaaatccttaataaaaataaagcactaattctatttgtgcttttctctttattattaatgacaaactgtacaaaacagccagccatttttgaatttacaacagaaaaggttgacagagatattgttaatgatttaaaaaaattaaaagccttatcccctcaggggctactttatagtgatacaacatatgaagtatggaaaacctgttcaggagaatggggaggaacggtctattttaaaaataaaaaatcaaaaaaaatatattacgcaaaagtaacctgcccggttgctgtaaataaaatcaaaaataaatattacatttccaattctatgtcacatggtactggcagttcggatattctagaaattacagatcctgaaaagatggaacaaaccgatacaatccctatttataatcctgacattattacaagaaaatatgagtctcattcttcaaaaggaacaaaagaaatggttgattccatcggagtagccctcatgactagctttgtatatgataaaaaactgtactcaattttatcaaattataaccaaacaaaaactaccatttcagaacttagaaacgataagtttcatactgtacaaacaattggcaatgaacttttctctgacaaccctttcattataaaaaaatcagagagccatcaaagtatttatcttcaacataaacatggcattctggaaattatggataataaagtcaagcttattttatatacaaacgtaaaaaatcaccctattaaaaataaatag

SEQ ID NO: 377 - DNA, 564 bp, Chryseobacterium sp.
atgttcatacatttggaattctattttatgatgaaaaaaattcaagttaactattcacaattattatttttgtatgcctatctcagactggttgatctctcacttgacagaaacagatggactacctgggatgaactgcaggattattttaaaaatattatatctccaaatcttgtttcgcaatatcttttcaataattttcatttgcctgaaacggattttaagaatttcaattttatacctcaagaaaagcccttacttaatagaataaaacctataatttttcacactttctctttaaagcaggatgaaattttatactgttgtaaaatcttatttgattttgacgaagcacttcgttcagatctcaggaaatatcatgttggaattgaaaaaataagaattgatattgcccaatactattccggatttttaggcagcctgatcttatggaaggatttggatcgacttatgaaaattgagcatttctggcaaagtgagaagattgatatttccaaattagatgagtttatccctaaggatttcccaggaaataaaatataa

SEQ ID NO: 378 - DNA, 135 bp, Chryseobacterium sp.
atgattgaaagaataaataaatattggaatgttattatgatggttattttgggttcctcaataatatatattctttatatttttatattcaatggtttagtaatagatcgaagtgtcggaaatatagatatttaa

SEQ ID NO: 379 - DNA, 339 bp, Chryseobacterium sp.
atgttaacagataaagaaatgttacaaattgcagaccgctttattagaaaaatagtagataaaagtattgaaccaatgatatatacagatgatattatcaaaaagtcttatggaaatatttatcgttttaattctaaaaaatatatcttaacaggtgattttaaatatgcattgatgggaggaggccaattccttgttgaaaaaaacggtggtagggttgtcaattttggaacctcaggtgaactggaagatcaactagaagcttataaaaataatgctttgggactatgcttaacaaactactggtatcccgatgaagatcggtttgattatcaataa

SEQ ID NO: 380 - DNA, 810 bp, Chryseobacterium sp.
atggaaacagcactttatccttttttttacctcacagccagagcagctgagccagcagaagaatacataagagattatcagttggtatttatcatagatggaaaggctaccttaaatgcggcaggagggagatgcgattttaaacaaggtgatatatttcttctgaaaaacaagcagtatatatcatatgtaaccgatactttaacaagaaaaggtagatttgaggccattaaactatcattaactcaagatctgctcaaagaattctttctgtattataaattggaaatacctgctcataaaattcatcagaaaggctattatattcaaaaatctcctttatttaaaagttatgtaaattcagtattatgttattttgcaccgggtatctccgtacaaaaagatattctgaaaatgaaggctattgaggccttgttgcttttgatacaaacagaccatgaaatggcatcgctgttgttcaattttccagaattgaataagcaggaattaaaagcgtttatggataaatattaccattgcaacgaaacactggaaaaatttgcattcttaactggtagaagcctaactgccttcaacaaagattttcgagttgtttatcaagaacctccgggtaaatggcttcaaaaaaagagattagatgtagcctatcaacaaattattgagggagaaaaacaagcttctgatatatacgctggtcttggttttgaaagtctttcccatttttctactgcattcaaaaaagagtttggttgcagtccggcacatacattttctctaaaacaaaagtga

SEQ ID NO: 381 - DNA, 789 bp, Chryseobacterium sp.
atggataaaatatgtaaaaactgtgatcataaactaaccggtaaattttgtgcatattgtggtcaggaagatattccaaaccctataaagtactgggatttcattaaggttttcctttcaaatgcctatctgacagaaaaaaagttctaccatacaatcaagaatttattcagacccggtttcctgactgttgagtttctcacaggtaagcaaataccctataagcacccaatgacaatgttctattcattgttaaccattggcattattgtttacctcaatctttatcagcctgtcagaagggattataccgaacatttagagcataagatcacctttacttcagtggaaaagaataaagatgaaatacctccattacaattagatcaatttatacagaatcagataaaactgggatatcttctgactctacctattacaagtcttttcattttccttttgtatggtcgtacacttattatctttgaaaagagtattatttttgccatcaactgggggtcaatcaatattcttacagatacattactatatctcgtagtatatatcttacattatttgatgaataaggatacaatcgcgattaccgaccaggttttgaacatcattgctgcagtctatagcttcatctattttatttatggggtaaaatttatatttgatagttcccttaagcaagccatagctaagtctatactgattttatgcgcaacattgactatcataattatcataattacaagtacatattggatattttatcaaaactag

SEQ ID NO: 382 - DNA, 735 bp, Chryseobacterium sp.
atgaaacaaaaaatagcattaattaccggcgtaagccgaagagaaggaataggatttgaaactgcaaaaaaacttggccagctgggttacactgtcgtaatcacggcccgtgatttaaataaagtaaaaatattagaactggagctaaaggatgaaggtattgaaactgctgtattaatactggatgtaacagatagcaacagcatcactaaagcgtttaatgagtttagtaatacctttaaccatcttgatgtactaatcaataatgcagcactggcacttttcaatgatccctcagtcaacgataaaaatttggatgatgtaacagcagagtttgatattaatgtaactggtgcctggagagtgagccagcaatttctccccctaatcagaaagagtgagcatggcagaatagttaacatatcgagtgcaatgggatccattacggaaccaggagttggaatgctggagtttaatcaggggcccgtatttaactattccattactaaacttgcattaaatggcttaaccataaaaatggctaaggaactaaaaaaagaccatatactggtcaatgccatatgccctggttttacagcaacccaaccaggtatggcagaaatgggtgccaggccagtagaggaaagcgtaccgggaataatctgggctgcaacgttgcctgatgaaggaccaacaggaaagttttttcaggataaaagagagcttgcctggtaa

SEQ ID NO: 383 - DNA, 567 bp, Chryseobacterium sp.
atgaaacggacaattttcatgactttaataacagcaactatttttataggaactgttgttaatgcacaaacaaatccggcagcaaaatcctctgcttccggcagtaccatattaaaggtaaccttgacggacgtgttgagtataatggttaaccaatcggttgtctcgcttaattttttgacaccagctgactaccagaatggcgtttcgactattatgaataaccatcttactgtcaccagtaatcaagcttatgatctaaatgtaaaatctgatttatcatccttgaaaggtgaaaaagcaggaaactcggccagtttggatgctaagattatcacaattgaattggacaatgcaagtggtcagggattgggggggacaccttcagttgttactgctctttctactacagatcagtttcttctgaaaaatgccatcccggtaaccaataaaagtattaatatcaaatatgcgataccaggttctatttcttctacagatgctgttttaggaaaacctgcagatacctacagtaccttggttacttatactatctcccagatctaa

SEQ ID NO: 384 - DNA, 849 bp, Chryseobacterium sp.
atggataccttatcaaatggctattgttatttttacattaaagcaaaagctttacttattggcatagctttacttttctcattctcttcccaggcgcaggagcttggagtagcaccatcccgcatattttttagcggtacagcagggcaaacagtaatacagcaggtagaactatctaaccatggtacagcagctatggcgtttactgcttctctgaaagattgggagagagatagtctgggaaataaaatatatcgggaagcaggaaccttggctaaatctaatgcagcctggatagaagtcgtgcccaactctttagaactggagccgggaacaagtaagaagctaaccatatcaatgcatattccttctgatatcactaaattaaatcatgtcagtaattcaatgttgttacttggccaggttacgaagcaggtgccaaatactactgatggttctggaaggcttaggggggttggcattaatgtgaagctggaggttggaattcatgtctattataccccaccaggtgctgtcaataaaaatatagaccttattgcatttaacgatcagaaaatgccggatgcttctcatcgcttaggtcttaaattacaaagtaagggtgatatggtaacagacggagcaattcgctttgaggttacaaacaaagcaacaggtgaagaaatgtcttttcctccaagagctttttcaatgatgcccggaactgagcagatggtatatctctatttgccagccactttaaaaggacgttttttagtcgttgctatacaggatagtggtttggaaactaaccttaaggtagctgaaaaagaagtcttatacaattaa

SEQ ID NO: 385 - DNA, 2775 bp, Chryseobacterium sp.
atggattcttacccatacgtaaacatgagactgattcttttaaccatattacagctgttaactgtctctttagtatatagccaggaattatctggtccccattgtcattttcttaccgatacacttactatcaattatggtcagaccttttctaataagcttgccatgttcaacgatagtaaagaagagtatttacttgtaaaagaaccttccaatatggcagctgggttgatcgtattacctgataccattaaaattgagcccggagaaaaaaaagtatttcccttaaagtacatggcttcctcaaaacttattcatcatccaatccaggcctttactataagatataaagtgatccaaggccgagggggtatactcgatgctactttttatacccgcttacaagagcctgagcgggtctctctgactcctctggaaccagttgtatatcaggatccgcaaaccagccttactccaataagggtgcgctgtataaatacggggtatactgaaatttccctcaaaatacttacgcagatctaccctgagggattagaatttacagagcgctctcaactgcttgagctgaaacctggtgcaagccagattatactactcaacgcacgtaatatgatgcaggtgaaagattttaaggcaccagatttcacgattaatgtaattgcagaaaatatcacggggaccattctggctactacaaccttacgtgttgttagtctgaaaagttataaaagattgcagattggtaataatctatacaatgatcagcggaataataccgctgaaattaactatatatatcagaatcaaggagattcctacttgcggggcagagcaaatggccggtttttcccttcagggaatagtaagttggagtataacttaaatggaaactactataaccagtccggaggattggatgtatatgatacctgggctcgttttagcaataaaaaatttagttttaaaataggaaatatttatgaaaacactgaatttccactatatgggaggggactggaagcatctgcctttattgataaagagaacagtgtaagtctattctatattaataattcctatcttttattttccactctgaatcaggctgagcataagaacgctaatgtagtggccgggatttataatttccgaaggtcggatcgactaaatggaaagatgacgctcgtgcacggctatgatcctttattcaaaacatctactaatttggcagccggagaattgcaaatttctttaaccgagaaacaaagccttaatattcaggctggttatagtgttgaaaatagcagggaaacaggtaaatctatgccggggtatggcgggggtatgatatatacaaatcatgagggtaaatggagaattaacctgaataactatgtgagtagttcttactatagtggcttgcgaagaggggtcttacaattaaataatcaggtatcttatcaggctacaaaagcgacaagcttttctgtacactacaatcagcagcataataccccaaaatttctttcgtcagcattggaagatcagtatgtttcaaatgatatgcagcaatatgaaatcggagtaaatacccgtattcgggatctgactttatcattacgaccttactatttacatcaatatcagggacaatattttattggtggggaggaactgcgctcttcgtctttgcgtataatgcttgaattgtggtatacattacatgaaaaaacattatcgctttctgtagactatggctttacgaatagcaataatctcctggcctatggaggtcgttacaagacaatacgaatcaatgccaacttcagggccaatcattgggggctaaatgcacatattcaaaaggggccctattatcttcaggaagagcctgtggaatccgggcaatcggattttaaagtttattcctttggacctagtgctggattcgatatgttccaccagaaattaaatatcagtcttaccaattatcttaactataatggctacgtcggacactggaataatttactcaatgcccagttaaaatataaggcaggaaatacctggcaagtatctgctcagattttttacaatgtatttactcaaaaaggctccgttagtaattttcagggtcaaatcggcatacagaaacattttattgatgccaatgctccgggattgaaaagactggagcttactttttttggcgatcataatgccaatggcgtacaggatgcgaatgaaaatactattcctgatgttatagttgatgtatccggagaaattacgaaaagcaacaaacatggtaaagtcaattatacgaatctcactaagggggaaaaggtaataactattcaagatggaaagggctggcacttgctacagccacagcatttttttttaaataaccatacgaagatgattatcgcacttgttaaaagtggccaattgagaggaaggctggttcctgtggagcagaaatacctcactgagaagccggtgcttgaaggaatcaggatcaatgccattgatcaggatcaaaagttgatcagtacactcactgatgaggagggacgctttcatttttcacttcctctaaaaaactatacaatttatatagaaacagctggtcattcctttttagtggatcctgtcagacaggatgttacgataagcgaaggcaaggtggaagaattgatattccgttttgagaataaagaacggaaagtagaaataaaaaaattcaaataa

SEQ ID NO: 386 - DNA, 1431 bp, Chryseobacterium sp.
atgaagaaaaaaaatagaaatatagtgcccgggctgatcataggtttactctttggctttttagtccctacgtttaaggcacaatcttctctgactatggaaattgatgaaaagaatattggttcagacattattaagtcttatgttgcttttaatatcggagctgactgctggcgtattcaggaatgttttgttcaagcgatgggaggaggaaattttagagatacagagaataccgggatttccggcccggctgtttctataatcaaattaaaaataaaaacacttgatggtaaaagctatagttctgattatactcctgaggttattttatcttcccgaaatgagcagcctttagcggtgcggagaattctttttcctgctggtgccggagaaattcaggctcgcatccctgcagcagaactttccgggtatagatgggaagctggaaattatgaaactgatttatcgtatagggctaatgctatgaattccagaaattgcatttttaaccaaagtgcgattagtaaacttagactgatagtaaggccatatttgtcgattgatccggttagtaatgttattattcggctagatcggttggatgattttcgttcagatgccagtgctattcaggtattcaactgcagacattcagtacccgttaatatacaagcaaaggctgcccaaagtccctttatctatgctcatgttcctgctaatattctcttgtcaccaagagtggagtcagaagtgattcagattcaaggagaagatgggggtaaggtgacagacctttcgttcagcacaaaacaagatattttcagtaagggtataccagtgggacctggtaataaaacaactaaaaatattcgattcttcataaaatctgaagttatcagacgaaaatttgcagcagcaggaaattatcggctgagggttctttatgatacctatgatgcccgcgggagtggcgtccgaaaagtgcccggggcaacatcctcttttaatttagaggttgctgtagcagatctgggagagttaaagataaacgatgcaacagtaaacctgcaactgaattcggcagctgattacagaaatggtaccgctatagatttacccaatcacctgcgactgagtaaaaccactccttatgatgtatatgtgagatcagtaacatccagtttaagcaatggggatcagcagatacctgtaagcgcaatacaaattgggccgtctgccggagaaagcggtgtctcaatggtaacattgtcagcgagtccccagaaaatcatttctggtaatgtaccggtaatcgacagaaacataggtattcaatacagcatttctccggccagtgctcaacaattatcaggaaaacagcgtggctcatacaccacaaccataatctataattttactgcactgtaa

SEQ ID NO: 387 - DNA, 810 bp, Chryseobacterium sp.
atgcacaactttaaaattctcattacagccctttgccttttaatggtctctgtattatttgcacaatcatcaagaatgaaaaaaactaaaaacactattgtcttagttcatggagcatatggagctgccagtaattttgataatgtagttcctggtttacagaatcttggctataaagtaatcactctggatctgcctggtcatggagatgataagactgatctggccaacatatccttagaaggatatagagataaggtgattcaatctatcggacaagaaaaaaacatcatcttggtaggccatagtcttggtggtgcagttatctctgtggtagcggaaaaaattcctgctcagatcagtaaattaatctatctgacggcttttcttccacaaaatggagaaacaatattgggccttactaaattagataaacaaagtatctttggcaagaacctggtattctctgaggatcacgagtccgcaacacttaagcctgatggtatggtcaatcttctttgtcaggactgtccgaaaatggaaaaacaaaaattgttagcaggaaacattccagaatcactgaaaccgtttgctacaccaattgtccttactgatgcgaattttggtagaatacctaaatattacatatacgcaaaaaatgatcatgccattggccccgatttgcaaatgctgatgtctggcagaactgctatcgtaaaatcttacacgattaattctgggcactttccacaattctctcaaccaactaaagtagtagaatacatttctaagattgctgcaggaaaataa

SEQ ID NO: 388 - DNA, 414 bp, Chryseobacterium sp.
atgtcagaatccttaaatatggcggctatccgccgcgtgtatgatgatccaggtaatccattggtttttcaggaaatactgtctgaaaatgctacctggactttggtagaaggttttccatatagtggaacctatactggagtgaatagtattcttgaagatttttttggaagactgttgactaatgtacttgagagtattattccatacgcagaatttttttatgaaaccaatgaacacattattgtgcttggtatttataaaggaaaaactaaggcaaagaatattccttttacagctcgtttcacgcatacttataaggtaaaagaaggtaaagtaattagttttcatcaatgtgccgatacgatacagattgcgcgtgcactggatagtttcaatatgcctgtaaaataa

SEQ ID NO: 389 - DNA, 489 bp, Chryseobacterium sp.
atgatctatcgcgatgcatttgcttcagattttgaggatatagagaactttgtttttagttctatttatcctgcttttgaccatcctgatctttctcatcaacagagattagaaaatgaatggatcataaaaatatcaagagaatcgtgtatggaagctctggttaatgagcggaaaaaaatcgttgtagcgattgatcaggataggatagctggctttgtaatcgcacataaaacttcagaagattattctgagattgattggctgatggttactgtagcatatcatggaaaaggagttggcgatgagttgatgacacatgctttgtgctggatgggagatcaagcggatgttaaactaggggtgatttattataatgagcgagccattaggttttatgaaaaatttggctttaaagacacagggaaaatagtaggtaatcataaaattccgaggaaactattaattaagccaggacaccagacctga

SEQ ID NO: 390 - DNA, 180 bp, Chryseobacterium sp.
atgaacaaaatgaaattatctaaaggattacagatcaacaaagaacaaatcagcaaacttcaggaagagcaaatgaatggtcttaaaggaggagttaacagccttcaggcagcggctcaatcttgcgggcagtgttcttgcggtggaaatacagtagtacaaacaagagctgctaagtaa

SEQ ID NO: 391 - DNA, 179 bp, Chryseobacterium sp.
atgcacaaaattaaattaactaaaggtcttcaaatcaacaaagagcaaatcagtaagcttcaggaggagcaaatgaacagccttaaaggaggggttaacagccttcaggcggcagcacaatcttgcggacagtgttcttgcggtggaaacacaatcgtaaaaacaagagcagctcaata

SEQ ID NO: 392 - DNA, 174 bp, Chryseobacterium sp.
atgaacaaaatgaaattaactaagggtcttcaaatcaacaaagagcaaatcagcaaacttcaggaagagcaaatgaatagcctaaaaggaggtgttaacagtcttcaggctgcagctcagtcttgtggacaatgttcttgtggtggaaacactgtggtacaaacaagaaagtaa

SEQ ID NO: 393 - DNA, 1173 bp, Chryseobacterium sp.
atgcaaaaagaaaaactaatcatctcagaaatagaagaatgtatccgcaaaaaagatacttcccttaccggaatcggtcttaataacgggattctaagtgcttcaatgttctattattatcattatctaatgaccaaagagtcggaatctttagaactggtaacccattacattgagaagtctctgtctgttttaacagaggattataaaagtcttcattttaatgacgaaataagagagctaggattatatcttatgttcctgaaacaggaagaagttttagacagtgaaattgattctttactggagaatatagatgaaattctggaagaaatactgatccagcaaacagagaaaggagatcttgacttaacaagcggttttccgagttttgccaagtatttcgtactgagaaatcttgaaggcaaaaaacatctgatagacgaaacgctgaataaaatcattgagcttgctcatcctcatgaaagcggaagctactggaaatttgatcttcgggataaagaaaatccttatgtagaactaggtttaggacatggaaccacaggagtgatcaactatttgttattcctttataaaaataacatctacaaccaggaatctctggaactcattcacaaaggattatcattcatatggaactgcaaagaaagcaacacggacaatatcacacttttcccgttcaatgcctttgaagatgtctacatagattatcacaatctcgcttacggtgaaataggaattggctatactttttacaacgccggaattctcttagaacataaagactattgcgacaaaggattacaaatattgatcaacactacaaaatttaaagatactgatcagtctgccattctggagccgggactcatttatggttccgcaggattatccgccttgtacaaaaaaatctatcatcttaccgaacaggatgtctttttggaagctaaagaatactggcacgagcatcttcttcaatcaaaaaataatgaaagtgaaaaatgggcaggatttaaagcctattacaatgcagagtttgacaacatcaatatggccctgggccaaggcatagcaggaatcgggattaccctgatgaacaatgtcattaaaaccaatcacaactacgtctcattctataattacgatctataa

SEQ ID NO: 394 - DNA, 1158 bp, Chryseobacterium sp.
atggaaactctacaatctcaaaatatcacgaccattcttcatgaatacgatcaaaaacttcttgattttgattatggaaatttacctgatggattgctttatggaaaactgggactgctgctctatttcttaacacaatatcaaatctccggaaatgatatctatgtaaacaaggtaggagctatccttgaagacgtctttgagaatggcaatctgcaaaaagaaagcaacgtatatacactcccgaatctatccaaaggaatgaccggattgggtattatcctggatttattaaaaaaagacggattaatacaagatgactttgatgagcagattactgacatcggagaactaatcttccagcaatccgttaccatgctgaaggaagacaattatactttttttgatggaccgataggaaatcttcattacttcaacaccatcagaaatgaacagtacagcagcgaaattgtagatcttctttatgatgaatgcatttcccaccccatcccatttgaaaataagctgaatgacagctatgcagatggtattaacttaggattcaactatggctatctttctattgttaataatcttttgagccttccggtaatgacggaaaaagcaaggcatattattaacacctgtctggatttcattatttccaattttgatgtccacgaagtagaaaacgccagaatatataaaccatacaattacaaaatagcagaaaacctgttgaagcctttccacaacaacagactttgctggtgcaacagtgacctctccttctcttatcttctttataaaacaggagaaacactgcaggaaacaagatacagagatatggcccatgaactgggtttagaaacgacaaaaagaagagtaatggccaatacaggcgtagaatttatccagtattgccacggaacttctggacttgtacagctctatgacgagatcaataaaaaagatgcccatccggagtataaacaagccaaaaacttctgggtgaaaagatcactggaaatcctggaaaacgaattggatcaaccccttactgagcaggacggctctttgctctttgggaaaaccggagcattgattaccctcaatgataaaatcgacaaaactaaatacctaaaatttttactgtaa

SEQ ID NO: 395 - DNA, 948 bp, Chryseobacterium sp.
atgaaaacaaaaagcataggattactagaactaggatacagaagcggcaaagattcaatcacagctcttaacgatgtagttgattatgcccttcatgcagagagattaggatacagcagattctggctggcagagcatcattattctcacctcaagaatcttgcattttcaaatccggatattgtgattgccatgatcgccggaatgacagaaaagataagagtaggatcagcaggaacttcagttcccagttattctccttatgctgtcgctaccaattataaactgatcaacaatatattcaacggaagaatagaccttggtttatcaaaaggaattcctgaaagcacatacaccaaaaaccttttgaatccggatatccttgaaagaggcaccggagtggttttcaaagaaaatgcccacgaaattcacgaattgttttattctgaagccgaaaagaacgaaaaagaaggaattttaatccctccgtacggcgggctgatccccgatctctggtatctttcttcttctctgaacaatctggatgacgccatcagtttacactcaaactattgtgtatcagcatttcacggaagcggaaaattccttgaagatcttgaagataaaaaagaagagatcaacagatacagagactcatttgtacagaaaaacagatttgttcctaaaatatcgctggcactggccatcaatctttcagaagtcaacgaaataaaatccgatgccgatgaatccgaatcattcaaaattctcaatctcaactttgaagagctttttgaactgattgaaaaactggatgaaaaactgtccgtcgatgaattcattttatatgatacagaacccgacagtgacaagaaaatagaaaacgctgaaacgataagcaatcactacaacttacaatctattcaacatgaaaacgcagttagataa

SEQ ID NO: 396 - DNA, 3102 bp, Chryseobacterium sp.
atgaaaacgcagttagataacatcaatattggctttatgaggaactctttgtactcattcaaacaatataataatataccgaaaaatacagcagatcttgatcatttcgtcctggaattgtggaatgatgaagttttcagagaatctatctttttagcctcttatgagctgtataacgaatgggcaagattgtgccagaacgacccttctttatccctggtaaagagaaatagaatcaataattctattctaaaatattacatcaggattactaccagatctactccgttcggaacatttgcttcccattctgcttttgaactcaattcagaaaacaaaaatattgaagcaggaaatatgaattctatccatcggtatactaccctggatctgtctttcctttttcaggttataacattaatcaacagagactttccggaagttcacgaatatgaacttaatgactcgatctataagttaggtgattattaccgatatatcgaaactacaatacaaaatgaaaaaagagtctacactttaagctcattggaaaaagatgaacttctggattttctggttgataccatagctgaccaatcttattcttttgataaactggttgccttggttgcagaaaatgtggaaggagtttctgaagaagatgccaaatattacattttcagcctgattgatgcccagttctttaaaagcggctttgacatctgcttaaatgagcactctcctttgtgccagatcattgaatatttaagttcaaaaaaagggatccattctgaactcgacacctatctggaaaccctcatcaaaatggatggctatatggaattgctgaactcaggaatagggcaagctcaggaatattacaacgagatattcgcacttgctaaccagttttcgattttgtatgacagaaaatatctgatcaactcatccttaaaaagaaatcttgacttttcacctgttaccagagaagatctttccaaaatcaaaaagggaatcaataccctaacctgcttttgggacaaaggaagtgaaacagtgaatgaaaatctagaaaaatttaaatctgctttttacacaagatatgaagaaagcttagtccctttggttgaagtattggataatgaaagcggcatcggatacattcaggagcaaaacaatgaaaatgatttttcttccctgttggatactctaagctggcctaattctaataatgattcattttctatcacttacaataaaaaaattcatgaattctggcgaagactcatcaacaaagccaatatcaatggagatactgcgatagaccttagccagcacgatatcgacagccttcagaatgcggaagaagtaaaccttgcaagatctctgtccgtaatgattgaaaaggtttctgataaaatcgcaatctcatctgtaggcggaacaagcgggactaatctaatcgccagattttccaatgaagatgaagaaatcctggctccaatgaacagaattatcaaagaagaacagaatgatgatcattttatctacgccgaactgcttcatttaccggacaacagagtaggaaatatcttactgagacaggtgaaaagaggaaatcagctttcctttcttacaaaatcttcagcttcggaaaatacaatagccctgacggatctttatattaaaatgattgataaaagagttgtattattccacaaaggaatgaataaagaggttaaaatcttccattctaccgcccacaattttgattataattcgcttccggtctatcaatttttatgtgaccttcagcaccaggatgtctcctctgcattggttttaaacattggagataccaactatctgatgtatgattatattccacgtatcacgtatggcgaagatatcatctttactccggcattatggagattataccagaatgaagtatcaggagtaaagactaaaaacaataccgaaagcattaaaacgataaaagaatatctttcagataaaaaggtcaaccgacatttctttatttctcagggagataataagttactgatcgactcggaaaatgaaaaccttttattattcctgattgatgagctaagatccaaggaaatggtaacccttacagaatgtctttacgatcttgagaccgacgaattcaacaacgagattgtcatcccaatgatcaacagaaattataaagcatttaaaacagagcttgaccatcatcttttcaatatcaatatttctgataataagtttattcccggaaacaagtggctgtactataaaatctattgcggcaacaagttctcagacaaaatattacaggacgtctttccagatcttttgcctcagctcagtgaggaagaactgatcaaaaaatggttctacatcagatacagcgaccctgataatcacatcagactgagactggaaatcaatgacagtaaactcaccaataccgctcagatcattaccactttcaacgattattttgataaatatatcagcgaaggaatcattaataaagtggaaatgggaacctatgacagagaatatgaaagatatgaaggtgaatttattgatgctgcagaacatatcttccattatgacagcaaattgaccgttaatctactgaaaaacatacccaataacgatgacctttggctgtacaccatcaaaagtattgatacctacttcaatgtcttcaacctggatctggataagcgatatgaagtcatcaacaaactttatactcagtttcagcgggagtttaatgtagacagcaaccttaagaagcaactcgatttgaaatacagaaacaacctgaacatcatcagcgagattgtagaaacagacaacagtccttatttctcagaatttgtcagttccatcacagaaaactgcagagaaatagagaatctgaagaccattcaaaaagaaagattagtcagcagttttattcatatgcatatcaacaggctgatcagatccagacacagaatgcacgaactgatcatctacggaattgtagagaagtattataaaatgaaaatcggcaaaagaaaatatctagtatcatga

SEQ ID NO: 397 - DNA, 1317 bp, Chryseobacterium sp.
atgagaaaaattatgatttcaatggcctttgcagccactctgtttgtttcatgtcataatgaaagccttgaaaccggttcttctgctgatagtagtattctaaccaataatggcagtatgtacaaaatttcagaacttccgttaataccagaatttgcaaaacctattgaaaaagaaggagaagtaagaaagttcacgcttatcaaaaatgatggcagccaactgaatttcgaattaacaagtaacaaagctactctatttggtaaaatgagaacatttattggaacggtaaatactgatgacaaaacaaaagaaaaagccatcatgattgttggagaaaatgggtttgatctattttacgaagagaacaatcagaattttagactaaaagggaaaaatgaattaaatgttggctacaaaccagtagaatttaatccacaaggtaaacttaaatcagaatttttagcttatactcaaaaaaaggggatcgatggacagcaattgctaaatcaagttaacagaaaaatgatcaatgacaataaccgttatagtatggctgttgagaattcaaatcattatactctgttaaatgaaactgccagtatgcaaaaaagaaagtcagcagaagggcaaggaaaatgtggtacagaccaccttacttcaagtcaacctgaactaaacaataaagtagaatatactacaaaaaataccaaagtggtaagcccttacaatatagaacttataggcatgataggaggagatgtggatttcgatggtcaatatgcagccttagtcacctcattaacggatatatttccaaacatacaaatcaactggtggcaatatcagttcactaactctccatttaatccagacgataccattaattacaattattttgatgaaatgacagaatggacaaatacattatcaaaagtggccgatggcaacgaacagctccaaaagttagaggattttacccaaaaaaatccttttaaaaaacctataaaacgtataagaattgcattatttgaagatggctggaataattctgttcaaggtctagctaacctagattattataaaactagtaatgtaagcacttatcgcaataaacgatctagtgcaataatatctgatgattataattctacaatggctcatgaatgtggtcataatttaggagctgatcatgttgacgataaaaatgatgttatgtataagagtacaactggcttctggggaaccgcactcaacagttatactcatcatgatgcaaccaatatctctaaaataaaaacatcactaataaattaa

SEQ ID NO: 398 - DNA, 219 bp, Chryseobacterium sp.
atgctcattgcaaaaggttttcaatcaatccaaagactaccgaagtatagagcggaaccttcatttataggactacaaagaaaaaccagacaacttttaaacggccaggaagctatcaaaaagcgcagacaacgttcggttgaagtggaaccaatgtttgctcaccttaaacattgtaacgattttatgaggtctacccttaaagatttgaaaaagtag

SEQ ID NO: 399 - DNA, 639 bp, Chryseobacterium sp.
atgatgaataagaaattccgtgtttatatgacaagcttaattttgatagtaagctgcactaaaaataaaaaagagagtacaggagaaacgtttttaggttctgttgatgcttttacagacttgaataaatataaaataaatgagagagttattaatgattcaatagtaaggatagaaggaactaaccggaattctactatagaagggaattttaataagagaagtaataaaaaaattgattggtggcaaattgtagatagaaaagactctactaataagctaaaaattcaatatttattatttgaagggaaaaatattgttaatcaaataaaatcatataaaaagggaaaaatagacaccttaaatagtaagttttatttagtaaaaaagattgatgatagtttaaaatattccttttatttacccttaagagaaaacaaaattatttcttctaaattttattatcaaatagaagcaaaagaatatatccaagtttgtaataaaagattcaatcattatgaatgctttgttaataagcctcatgacgataagcctgttttgggtgtttttagtgaagcgatggaaaacagtaaacataaaaatgatatagatataagtgaaatttatattgaacaataa

SEQ ID NO: 400 - DNA, 441 bp, Chryseobacterium sp.
atgtcgctgggaggaacttggtcaacctgggaagcacaggagtttcctcagattacctataacggaggtatggcaagaacagattttgatgcaagtacacatgataaaaagtttggtaatgataaaaccttcaacttagattggggaagttttgttgctccaagcacttttcctaatcctggaaaaggaggtagtgcttatgctttatcttgggctgtagatagattagcggatgtctttaatttaaataaaggaagtgacacagatacaattaatcatacaatgggagtttttgattataatgcaggtaagtttaaagatacaacagtcacacttcaatattcacctaaagtagatttttcaacatctaatgcacaaaagactggaaaagttgattctgctagtctgtccaatttacgaagatattttaatagacattag

SEQ ID NO: 401 - DNA, 579 bp, Chryseobacterium sp.
gtggtttttgctccttcatcatcaaaactttatatttatcaatacaaaggccaccttgggaatacccgtgtgagctttgccaaagacagcgcaggagctcttgaagttacagatactaataattactatgcttttggaatgaatcatgtaggaggaattaaaagtttattaggtggttatttgaactataagtacaatggaaaagaactacaggaaagtgggatgtacgattatggggcaagattttatatggcagatattggaagatggggtgttgttgatcctttagcagaaattaatagaaggtttacaccttataattatgctatcaataatcctattacgtttattgatcctgatggtagatcagaatcagactggatcaggaaagatggaaaatggcaatatgatgctaatgtaacgacagtagaacaggctcaaaaaatgtctggtgtagatggtttcgctaagaatggaactgtactttctgatgcaaaaataggacctgatggagaggctggatatgtgagattaagtgaagggggaaagcgagttatgaacctacatacggagcaataa

SEQ ID NO: 402 - DNA, 573 bp, Chryseobacterium sp.
atgaatattaaaaaatacatatatatactagttatcttggagatattagttggttgtaaaacaaaaaaccaatgtgatcaatatgtcaatagtattaataagtctattgaactagaatatcatcaaaacttaaagacgaatcatgaattatttttaaaagaaaatacatatattgattccttagaaaattacacaaattttaatagctgtaaaagaaaatatattttattcacttttcctaaggatacagttattgttttagatagaattagacatgatgattatgcaggtacaaatattaatttaacaggaatttataaggatgatgaattattatcttttaataattttagtaaaggatttaaaaagataaaaattgacaatgattatatttttaataatagtcattatcaatatattattaaattaaaaaaaggggatttttcaaaaagaaaaatttctgaattttctgatgatgctttaaaagatattacatttattactctaattatagaccaaaaaataaaaaatatataccgtgtatattctaacgaacttgtaagaataaaatga

SEQ ID NO: 403 - DNA, 834 bp, Chryseobacterium sp.
ttgaattataagtacaatggaaaggaacttcaggaaagtgggatgtatgattatggcgcgaggttctacatggcagatttaggaagatggggagtggtggatccgctagcagagaagatgacaagacatagcccttataattatgcttttaataatccattgaggtttattgatccggatgggaaacaaggtgaagatataattttatccatgggtcgtgacaaatggggagcagaaataaaagcaagatatgaaggaggaaaattatattcttatgtcaatggaaaaagatcaaatactgaatatagtggcgatacatcaaaagtgagtggaattatttccgatcttaataaactcagtgcaaattcagctggaaaatccgatcttatcgatttcttttctcaagaaggaaatgatgtaacgatcagatcgaatgttgatagtgaaaatcattatggctacgggactggaggaattgtggtaaatggtgaaaaagttcctctacctacaactgaagggatgcaagatgctgaaacttatattgtattggggcacgcaatgggacatgctaagtcagacttgaaaaaggaaaagaatgcaatggatgactggtataaaactaatagcggaaaatcaataactattgatgaaataaatgccacacatatagagaataaaattagaaaagcagcaggtcttcctttaagaacactctataacccatacaggaatgatacttcgttgttgacaaaagataataaaaagagtttgtacattgataaaaaagaaaattatcccactaaagaaaaagttaaagagaattatgaatattaa

SEQ ID NO: 404 - DNA, 585 bp, Chryseobacterium sp.
atgaaaaacttattaccatgttcatttttagtactatctatgttactaataaattcttgtaatggtacagacctacaagacaataatgaaaatgtagcattaacaaaatctaagagtgcaaattttcaatcaaagactactttaaatgatgagaattatgttctacctatcatttttgcagatcaaaatggttacaatcatgataactcaccatgctcctcttataagctatatacaacttcggatgttttatctgtaaatgatagagtattaaatgtcataattatcagtaatggaacaattttggaagggaaaatatttacaatcccagccggacaatatgtttcacagaccgtagatattttaaaaaatgctaaaaaaaattatggaaatgttgaaataaaagttaatagtgttaaggaaaatggaacaattacaaatgaatatgaattaaaatcaataaatactcaggttaacaattgttataaaaatactccaacattaccaggtcctctagatccttctgattgtgataaggatactaataataatggctatcctgattgttatgaatctcaaaaatag

SEQ ID NO: 405 - DNA, 489 bp, Chryseobacterium sp.
atgaaaaagtatttaattttattgataggttttgcgatggcattctctcttacatcatgtaagaagccttctggtgctgaattagaaaaagagctggcagtatcccatacaaagctggagtctgatcatcagactttagaagctgagcatgcattaatggaaaaagaacatgaagaatttaacaaggcacataatgcaatgaatgagcctgctacaagtaagcataatatgatagaatctgctcataaagcgattttggaacaacattctgcccttgttgccaagcattctgaaatcattaaaaagcatgaagagctagaaaaggaacatgcagtagaaaatactgatgtggaaaaattaaagacagatcatgatcagatgatgaaagatgatgatcaggtaatggctgatcacaagaaattaacagaagatcataagaaacttatgacagaagatgagaagatcaaaaaagaagataaactaaaataa

SEQ ID NO: 406 - DNA, 3528 bp, Chryseobacterium sp.
atgagaaaactatcattattcttttttttgttatgtggactccatgggttttcacaattaattccagctcctgtgaattcggttacctcttcgcaaccagcacaaccagggactgaagttacccagttgattgatggcaataatgctaccatttatcatactaattggtcggtgaacggtattccggatgagttgaaattttattttaatcctaatgtcaccaatattaaaaaactgatttacaccccaagacaagcttcaggtacaaacgggatttggactaatgtaagtatttcctacagtacacagacggctcccgatactttcatcccggtaagcaataatttaatttgggctctcagtgatgcggataaggaatttattttccctaccgctattcaaaacccttatatcattaagataaccgtaaatgcaggctctggaaacttctccagtggtgcagaaatgaaattcttttctgaactacagctcgttccggcttctgtgaattcggttacctcttcgcaaccagcacaaccagggactgaagttaccaagttgattgatggcaataatgctaccatttatcatactaattggtcggtgaacggtattccggatgagttgaaattttattttaatcctaatgttcccaatatcagaaaactgatttacaccccaagacaagcttcaggtacaaacggaatttggactaatgtaagtatttcctacagtacacaggcggaacccaatactttcatcccggtaagcaataatttaatttgggctctcagtgatgcggataaggaatttattttccctagctctatccaagacccatatatcattaagataaccgtaaatgcaggctctggaaatttctcaagcggtgcagaggtgagattcttttctcaacaacaacctgcgattgttgacggtatagactgccccatcaatacatccgaactaagtataagcgggagcaatgatgtgatggccaccatcaccccttcaggaacgactgcgtcatcttatcagcctggagaagatatagataaatcttatgataataatgtgagtacgatttatcattctgcatatggcagtactgtttttccggtggtgttaaattacagattagatggtgttactcctatcgattatctaaaatatacgcctaggcccagtggagacaacgggctgcttggaagcgtgagtatcagttataatacgagcacaaacagcacatatgttccgttaatgacatttgattttcagtattctacttctcctgtgaaggtttactttccaaatcagattacccctttgaatgtaagaattacagtaaacaatgggaagaacagttttgcaagctgtgctgaaatgggcttttataaatcaggcgcttcagtggttaataatccttacagcaatatttttacagacaatctttattcagcattgaagtcttctgttactcaggcggatataaataatatgacatcgccattctataaagggttagcgcaatgtctatttaacggaacttatgtaaaaaaatacagggttcagaattatagtgtttaccctcctgtttctgttactacaggtaatttaaaggtgggaagtggctatagcacttttgagaatcctacaggtattgtgtttgcacagggggaaaaagtagctttgtttgctcagaatatcccagcaggagcaattgtttctctgaaggtgaaagatttttctacctctttatatggcactgactcctattatgagattcataatggtttaaatgtatttcctgtaaccaacagtggcttgggatatatcaattattataataccaatgcggcattacctgatatcaaaatcaatattgtttccggtaaggttaatggtctttatcattatcaaaaatctacacaaagtgattgggaggcagatcttacgaattcggcttataatatgattgatgttgtgggacagcatgtccatatggtttataaaaaaagcacgctgaaagcatatgctcttcataatcaggtagcccttgtttcaaaactcgatcttatggtaaaaaatgagtggcttgtgatgggcttgtataaatataatttagttcccaaaaaccgtatgttcggctatagtaatgacggcggaggctggcatgcaggcgggctgggtattaatatggatgctaacggaaatgataactatgttgctgatattaatcaattgtctgtatggggatttgcacatgaatttgggcatattaatcagataagcccggatcttaaatggattggcactacagaagttaccaataatatatacagtgcatgggtggattataatatgagtacagaacaagatggactgaccagtgtggaaagatttgatgaatcaccagcagcaggaatggccagcgtggcaggaggaagaataaatggaggtattctgaatacaaccgtcaataagcaacctttacaagatagtgtaaattcggataattttaaagtattaatccctttctggcagcttgagctgtattatcagctggccggagcttcacgaaatgcgccggttctttcctttaattatccaactaactatacaggagtagattatgcgcactggtttgcaacggttgccaacaaggcaagaaacaccaattcttccggggtctcaaatggtgatttgcttctgaattttgtgaaaaatacctgtgatgcagtgcaggaagatttaacagaattctttacaataaccggatttttaaggccgataaacaggaatattgatgattacggttttggtcagcttaccattacgcaggctcagattgatgctacgattgcatccataaagtctaagaactatcagaaaccggtttctcctgtaatgaattatatttcagcacgtagcgttgcagctttccgtgaccttcttccggtgagcggacaaacaggccagggagttactttaaataataattatcttactgtacagcacagtgtttggagaaatgcagttgcctatgaaacattcgatgccaataataaattgatttatgtatctgttatggggactggtgatgttagtaacaatactacaaaagtgtattacccttccagtgctagagctgtttatgcagtgggttacaatggacagaaaattttggtttatcctgtttcaactactttagcaggcaaagggaaaaaaaataattcagaattaaaagataatgtagaattaagaaataattcagaattcattgtgtaccctaatcctgtggagcaaaacggattaattcatattaaattagaaaatgcatcaggaaattacagtgtaaatatttttagtgcagatggaagaatgcttttcagttcaacaggaaatattgaagccattgaaacgaaaataaatacagagtttgttaaatatccttcgggaacttactcactttctttgaaagatgaaaaagggaatgcctttaaaagcgttaaggttattaaaaaataa

SEQ ID NO: 407 - DNA, 699 bp, Chryseobacterium sp.
ttgggatcattagccgaaaaacaaccacgtgaagggttttggaaaagttatggtagacttagaaataaaggagttgtggtaaatcatataaaactttataggatctataaaagtataggactggcaatgagaagaaaatataaaaagagacttcctaaaagagaaaagagggcactagtgatcccctcaaaatttactcaatcatggagtatagactttactagtgatgtcttggagaatggtcctaaattcagaagtttcaatgtaatagacgactataacagagaagtattctttattgaagtagattacagcttaaaaagcagccgagttgtttgggtgcttaatcatctggtagacagttatggaaagcctcaaagtattcggatggagaatggtccagagcttattgcaggattgatgactcattggagtaaggccagcagtattacatttcaatatatagggcctggcaaaccaatgcaaaatggatatatagaaagatttaacaggacttatagggagaatgctcttgattcatatatatttgaatcattagaagatgttcgagagataactgataaatttgttcaagattacaatgaagagagacctcataaatcattagcgggattgtctcctgtaaaatacagagaaatgaaacaaaaaattgctgttttaaaggtagtgtttcactaa

SEQ ID NO: 408 - DNA, 171 bp, Chryseobacterium sp.
atgagaaaaaacaagggggggggatttttaaacataatgaactttgactttaaagaaattaacattggcagattgatagaacaacgtgttatggaaacgggagtttctatggataagatcataggatttctaaaatgcggtgaagaggaagtgaaagaaatgcagcattga

SEQ ID NO: 409 - DNA, 168 bp, Chryseobacterium sp.
atggaaacatcactttatccttttttttacctcacagccagggcagctgagtcagcagaagaatacataacagatgatcagttggtatttatcataaatggaaaggctaccttaaatatggtaggagggagatccgattttaaacaaggtgatatgtatttcttctga

SEQ ID NO: 410 - DNA, 588 bp, Chryseobacterium sp.
atgaaaaagaaaattattttcgtttttgcgttagcaattgggctgacaagtttacaagcacagcgttgggaacccgtatccccaaaaatcactccgataaggaaagaagttaatgttatttacgcttacaaatttgatctcaattcactgagagaacttttaagaaatgctccggaagcaggaaaaggaagcccggtagtagtctctttacctactactgatggaagagttgaaagattctctgtgtacagctcgcctgttgttgagaaatcaatggcagagagatatcaattgggagcttattctggtgtaggtctggataatcccagcaaacaggtaagattcagtacagcaccaaatgatttccaatcgatgctttttgacaccaaaaccggtcaatatgaattcatagagcctattaataaagaaaaagatgtattcggggttttctttaaatccaacaaaacatcagacggtaatccttttgaatgtaaagtatctgaaaccgagcagtcaaaaaagcagatgaaaaagctgctcaattcaaaaagcactttggaaaaagccggaagtcaaaaaaaaaagtaa

SEQ ID NO: 411 - DNA, 120 bp, Chryseobacterium sp.
atgaaaaagatttttatcagttggatgcttttggcagggatcagctcgtttgcccaggaagcaggaaaaacaggagaattaataaactactccggggcagagcccggagtagtttattaa

SEQ ID NO: 412 - DNA, 987 bp, Chryseobacterium sp.
atgaaaatatcttaccttcttttgctgttaggagtactttttaaagcacaggagaagcttcctttcaataaagatcttttagaacatatgattcttcctgattatgggaatgacagtatctttcctacttatagaaacgaagcttttgaatatatcaatataaagaccgggaaaatacttttcaacaaaaaatttaaagaagcctatccttttgcaggaaaatccgcattgattttcgatactgaaactcaatcctataatgcaattgacagaaatgggaattttttgctgcaacagaaaaatatcaatcaggtatttcctttgcttaattgctctgaagcccatgtaaaatttaattatacaaccaataaaaattatacagagtctttgttcttttacttttatgaaggcattatgaaaggatgtacaccgaaactccctccaaaggtacccggtgaacctatccgttttcccttcccttttgaaaaaaacgataagaacacttatattctgaaaaataatggtaccagaaaagaaaaatttgataaggtcagagttctttccgaaaatacttttctggcaatgaaaaataataagattggaatcattgataatgaagggaaatttattgtgccgctagaatttgatgaatctacagtagagttctccgaaaacagaaatggatacaattctataattccattgaaaaaagatggaatatggtattactatggtcataaaggacagtttattttaaaaagtgctcaactttgtatttctcatatttccccttattacaatagtaaaggagaaaaatttggagtttataaaagcggagaaaaatataatatcctttaccaagacggagggtctttagaacatgattatgactggatatcagaaaacggtattctggcaagcattggtaataatttttattttataaagcaggatagaactgcttttccttattatgtaagggaataa

SEQ ID NO: 413 - DNA, 453 bp, Chryseobacterium sp.
atgaaaaatacatttactttcattctactgataactctaagtttcttttataaaatgaatgcacaggaaaaagtatcctcaaagcaaactatagggagatttgaggttaaaaaaaataattatatcggaaaaaaagttaaggacctattaaaagacttaaaattggatattcaactggttacttttggaggaggttcacctgaagccaataactttatcacaataaggtttattgatgatatcagaaattctgataaaaatgcaaaatcggccaaaataacacttttcattaaggaacatgatagtaccactaacaagttattccaaagtacttccggcctcaaaaaaagaattaagagagacaatgtaaaatataagaccaatgaagatattttaaaaagatatgaaaatcttactataatagaaatttatgctaattctgataaaaactaa

SEQ ID NO: 414 - DNA, 948 bp, Chryseobacterium sp.
atggcttttactattggcgaaaaaattctggtacagggtgaacattgtatagaatgtactatgtgcgttccggagtgtccggaacaggctatagatgatactgaaatgtatttggatgtaggtggatatgtatctcttaagggggtaacaatatcaataaatgtagaaaaatgtaccggttgtggcgactgtattccagtctgtcccacttcagttttttcttacttaaatcaacctaatcctgattctggaggcaataataatggaggaggtactgttggtggtggtaatcaacccggagaggatggacaagataaagatacttgcttacaagcttccaaatccgctgctcacgcaacacaattatctcaaactaatgcatttaataatgcattcaacacaatcggaggaatgaatgatggaaaagagcacggttatgtactcggaagtcaaaatggagtgattgtttctaccgacatacagcatggaggtccgaataacatgactttgaatcataattttgaaaatccagtggggagcatacatatccatccggccaacgattcacctccctcagtaggagacgtatattctctgatcaatgcttacaacggcaataatacttatagcacctattatgtaatgaatcccgatggtacggtttatgctctggcagtaactgatcctgctgctatgagccaatttctacagaaccatccttatacacaaatcccaggatatgcacctaattttccaccaccattatttgatgaatggaatgattttgatggaagctgggaaatgtcattgtctcatattctggataaatatgatgcaggaatggctttattaaaaagagataatcaggggaattttaaaaaaataaagattgataccaaaaaaaatcctgacggaactattactaacactcaaacaacctgcccttaa

SEQ ID NO: 415 - DNA, 459 bp, Chryseobacterium sp.
atgaacagaaaaacatttattcaaaaatcttttcatggatttttatatgccggattaggtaccactttactctcttgcatacaggataattttaatgatgaggtcaataggttcaacaatgatgatcaattaaaaaagagattcaagccgatttacataattaatgagggttctgatatcaaaggaagaaaatcaaaatcagtaaattttgacagaagaaaagttatccttatggaatttgtaagtcttggatatattaccttaaatgagtctatcagtgaaactaataaaaccaataagaatttaaaaataatgaagttgaatgatgagttttcatgtgtccttttcaaggaacctatccaaataagcctacccaatacatttacaaaacttaagtttcaatatatacattacagtgagcttagcgaaaactttacaaaaaaagaaataatattttaa

SEQ ID NO: 416 - DNA, 186 bp, Chryseobacterium sp.
atgaaaaatttaaaaaaattatctcgtgaacaattaaaatttgtttccggaaagggttcttgtgccacaacatgttctaatggatcttttatatatgttagttcatgtacatcgtgcattgattattcaggtggagcagcctgttataattcacatgaacaaagtatatatgttgaaacatgttaa

SEQ ID NO: 417 - DNA, 189 bp, Chryseobacterium sp.
atgtatgaaaatgttttcgtttacctttataattctgtcatacgacaggatctcatcaatacaataaacaacagtattacccttataaataaccgaaattgtaaaatacataggatgggagtagatgatcatagtaagataaaaactctatgcgctggatgccccatcgatatgttaaaaataaaataa

SEQ ID NO: 418 - DNA, 570 bp, Chryseobacterium sp.
atgaaaaaaatattcaatctgtcagttattatagctggcctctcagtagtattattcttttcttgcaaagaaaaaaaacaaaacgaaaatttggctgaatctaatgttaaaaaccagcctgctgcttccaaaactaaaatctataaaagtaggttcacaactattatggatgtgataggaactggaacgtttacttttgatttgaatgaaaaaggggatggtggagcatttaaaagttctgtagtttatcctgaagggagtacatatgaaggtaagaaattagagaatataaataatacaggtttttttacggtgaagaaatttgaaaaatatggaacggtttatgttttaaataatagtgaatcgtttgaaaatgcttttcaagtttcggataagaatttaaacgagctatggttatgggaaaatggggatattattccgacaggttgtgtttattatcttgtaaatgatgcaaatgtaaatgtacctatttcggagaccagagaagcaacacctcttcctaaagagcaaaaagcagagaacgaagatctaaagaacaaatttaaataa

SEQ ID NO: 419 - DNA, 576 bp, Chryseobacterium sp.
atgaagtcattaataaagcccaaaccaggtgatatgttttatattccttccatcagccaatcgaatgaaaatggatttgttattgcccgctatattgaatttattaaacccaatttaggtcatcttattgaggtttttgaccatttttacaccgagcctccaaaaaatatttctgatgtagatacaagcaaaagattattccagcctatattttgcagtatgcgcttcgcagcaggtatcccaagatggaaaatactgttcagtaatcctgaatatgataaatctgagtcaaattatagggacattactttcgtatttgatagaagtctctggatcggtggtgaaacgaaaggaatagaaactgatgaaatgcaaaacatggagccttctatttgctggcgtatggaccatattatatttagagtattaaaccatttaaaaggattcctgtctaacgatgaagttatgggctatgacaagatacctatggaatacagacaagataatgagatagctcagaaaagagtaaacgagattgcagaaataatgcatgacaagtttcaatcctggaaataa

SEQ ID NO: 420 - DNA, 312 bp, Chryseobacterium sp.
ttgcagaaaaggttgatagataaagatttttcaagtgcttttgtgtttgggaatcaaaaggcagatcaaactttgacctttgttaccaatcctttttgcaaacattgtaaagaattttatcctgtttttctaaagctggttaaaaagcattctgacgaactgagaatcaatatattctttgatgtagatcttagcagagaggatttggataatagaacggttcacttaaatcttaccaatatttatatgaacagcgaaaacaaagtagaatttttagaagctctaagtaattggtatgacgttcaggggtaa

SEQ ID NO: 421 - DNA, 168 bp, Chryseobacterium sp.
atggaaacagtactttatcctttttttcacctcacaaccagggcagctgagtcagcagaggaatacataacagattatcaatcggtatttatcatagatggaaagactaccttaaatgtggcaggagggagatacgattttaaacaaattactcaatattgcctttaa

SEQ ID NO: 422 - DNA, 147 bp, Chryseobacterium sp.
atgtggcaggagggagatacgattttaaacaaattactcaatattgcctttaataaaagaaatgaaaatatctctgacagggatgttatttttgatgaaaaattgcacaaaagaaactttgttattgagcgtatgaatgcatggtga

SEQ ID NO: 423 - DNA, 918 bp, Chryseobacterium sp.
atgcttattgatgaaggttttaagacaaaatatttaaactataaaccaaaggagattgttccttttcttaaaaagcttacaccaaaagataaaaaagaagttgttgctcttttaaaaagacatactaatagaaaagggggccgcaatacgatctctgtgtgggctgctttggttgactgcaaagcgggaaatgagtacaaaagacgacgatccggatattattcaatactggctgatgttgtcgacccactctttgaaatgtatgttccggtatggatagggaagtttggaagccataaagacgttcctgaaaatacttattttttagactatttattcaattcttatcaaggtgtttatcataataacctggtcaggattttatatagagcaccatatttttcagaccatgtttttgcgaaaaagcatgaaaatatattttttaacattgattttcagtgtgatatgaaatatgtagatgtctggatgaaaaccaatataccttttcaacctgtacattatttatttctgttttcaagactgtttaataaataccaaaccctctgtggtacggcttttgaagtcataataagcaaggtagtttcctatgatttaaagatacagaccctggaaacaataatcgataaaaagatcagttttcaatggacacctgtaaagagatgtacagatcgtctttggaatcttatcaatttgattgtcaataataaccttggtttcaaaaagcggctgatgcccattctatcagctgttgagaagtcggtttttaatcttaaaaggctcttggagcccgatcatgaactgttaaatcaaaatcagtccaaaccggacaaaacagttcttggactgtttatagaatggaaaaaagaaaataacctgaaaactatattatcaaattaa

SEQ ID NO: 424 - DNA, 141 bp, Chryseobacterium sp.
atgcagtttacacttaaaatcaccgattttttatttttaaatgttgaatcaattttatcgatgtcaattgacaattttgcttcacaagtaaatgatcaatgtcttttggaatataaaaaaatgacaagcaaagcggattga

SEQ ID NO: 425 - DNA, 231 bp, Chryseobacterium sp.
atgaggaaatattttttcagcctgcttttcggatctttatttattcctgtttctgcttgcttcaatgacgatcatatggtacttgccaagcggcatatgctatactatgatgcagaaactgaagtcctatacggacaacacttcgggagtaaagaaagactggaggcatttgtgtgggcaggcagtatggctttcgtacttataaataaaatacttctcaccctgaaataa

SEQ ID NO: 426 - DNA, 567 bp, Chryseobacterium sp.
atgaatattgatcaaaattcgactcctaaaaaaagtaaaggaggatgtctcaaatgggttgctttactttttggtttagcctttttatttacagttgttagcgtctggagagttaccaaaacattagaatctgataataaaaaaatagaacagacaaaaaaagatagtattgtcaggaatcaaaaattccaaaatggttggaagtcattagacattaaagataagaaagaagaaatcaataaactaattaatagtaatgaaaaattctactctgaaaagagatttctaataaatgaaaatatattggcattaataaaggtaggtgtcaagtacccagaaactttggaatataaatctatttcaaaggattttgttaaaaatccaaatggatatacaacagtttctcctgaagatttttcaaatataaattacgataacggttcttttacggtttctaaagaatttaaaagtgaaaataaattaggaatgaaggttaggggtataatattttgtgattttactttcaatggtttaaaatatacaataaaagacataaaatttgaataa

SEQ ID NO: 427 - DNA, 120 bp, Chryseobacterium sp.
atgctgaaagaaatcctgaataataataaaccgctaggccagaaggagggtgttgataaattaaagataatgaattatggatataatatatatactttcatactgaatagaacgacttga

SEQ ID NO: 428 - DNA, 285 bp, Chryseobacterium sp.
atgaaagagtcggaagtattaaacttcaatacattaaatgaggccaagatatacagagctttaaactaccaatcagatcctttatctaattattttataatatttgatcagcaacacggtcaaaatataaagaaagctgtaatatttgtacctcaggatttagaagcaaatagacaattttggaaattcttgtcacctaattttaataattatcatgatgatctgtacaagggattcactgactctgagttatgccaaataaatttttatagtattcgtgaatag

SEQ ID NO: 429 - DNA, 414 bp, Chryseobacterium sp.
atggaaaacactattcaacttcagtatcatggattacaagttatagaaactaacttaaaagtactaagttacgataagcatgttgcagattctttagaaactgaattaaatcttacaagtggtttcagtgatgaagaaaaacgcaagtttgcaataatatttcatttaacattaaaaagtgatgattctaacttcttattaaaagttgaagcacataaccattttgctcttaatcaagatataactgaagaatttaagaactctattttcgtaaatgttaacgctccagcaattgcatttccatatattagagctttcatttcgaattttacattaaatgctggatatgaccctgttattttaccatcatataattttgttaaattgtatcaagatagaaaagaagaaaaataa

SEQ ID NO: 430 - DNA, 240 bp, Chryseobacterium sp.
atgttagattataaaaaattaaaagaacagttccaagctatcatgtctgaatttgatgatgataaattagatgcttggattgagtttgacgaaagaagactaaaagaagaagttttttttagtggcgttcctgtaactgttactataaaaagaacatctaaaatcacttttaaaaatgtagatactaatataatagtgtcaaatctttgctctgaaaacgatataagtttagcggcctaa

SEQ ID NO: 431 - DNA, 528 bp, Chryseobacterium sp.
atgataactggataccatacacaagagttcagatgtgatcaagatgaactggatttgccgataatttgtaatgctgctaatgcatggctgggtaaagggtattatttttggaccgaggaagaatatgcgagatactggggaaaagattataaaatcttttatattaagtcccctggatattattccatatataaagctgatattaatcgtgaaaaatttattgatacagtttttaatgaggaagggtataatttttttattgagtgtttaaacgatgcttttaacaatttaaaaaaaagaaagcaagatataacattattgaatgtcaatagatttttagctgataatgtatggaagcaaatcggtgtaaacggcataatatatgatgataaacctaacaatagagaagataaaggaagaatttcaagcttggttcctcctttatattataagaaacgaatacaagttgtatgttttgatattaaattaattaataactttgcacttcatttagatatgcaatcataa

SEQ ID NO: 432 - DNA, 225 bp, Chryseobacterium sp.
atggaaaaagaatttactgaagaaacatgggtgcttgaaaatggaggcatctatagaatcgaatatcaaactgaaactaatcaaaaaatgttaattcaagtttttagaataattgaaggcattgatatttctgctagcgatcgagaagtaataattatgcgcaatagtaactttatcacattatcaacacgtaatccattcactggatatgtaatagcaaagtag

SEQ ID NO: 433 - DNA, 180 bp, Chryseobacterium sp.
atgagtaaccttaaatttaaaaagggtgatatggtctatgtaaataccaacccaaaagttaaaatgaatgttataggcattacatcaaatggagaaatttcagttatgtattttaaaccaggatttgttcgagcatcttctagtttcatacctgaaatattaacattagtcaaaaaataa

SEQ ID NO: 434 - DNA, 978 bp, Chryseobacterium sp.
atgaacaaattgtgttttataattgtaatttttcttatttcaatcggacaaacccttcatgcgcaaacagacagtatccagaactatgtagtgaaagctcttgatattatgaagactaaatctgtgaataaaaaccgtgttaaatgggattctttatataccgacagccaccgcaaagcaaaggacctgaaggatatcaagtctacctatcccatcatcaaagatgcactaagcgccctgaaagatgctcattccaatttctatcctccggaattggttaaggcttatgttcttggatacagagccaccggtcaggagtttcctgttattgaatcaaaaatgaccagcggaaagattgcctacattaaagttccccctatcgcctgttataatttcaaagaatgggacgaatttgtaaatacattttatacaaaaattgaaaagctagcccttcaaaatcctaaaggctggatccttgatctcagagacaactatggcggaatgctttatcccatgctcgcatctatatctcctatgctgaatcagagcaatgtgataggaactgtagatgctgcaggaagccgcttttttttcaattataaagacggaaagttctcggaaggaaaaatagttacccaccagtttaccgtcaaaaaagcacccaaacccatcacccagcctattgttgtaatggtcaataaaaaaacggcaagctccggagaattctgtgcgattgcttttgtaggacagaaaaatgcaacaattatcggggagaaaacccagggattaacatctggaaatcaggaatacaaactttcggacggagcttttatcgcactcactattggcaatacgattgaccgggataaaaaagaatatgataaagtaggagaaggtctgaaaccccagatcattcttgaagatacctcagattccggatatatggaaatggccgacaaaatagtaactaaaaagtaa

SEQ ID NO: 435 - DNA, 567 bp, Chryseobacterium sp.
atgaagatatctgagcttaaagaaaaaagaattattcacagacctacccgacattttgatgaattgggaaacaggatctataacgaattcgaatatgagttgccttatgttcctactcataaaggaaatgaaacggaacgccttttttccaaggtgattgatatgattccttttttcatcatattcgtattgatatttcatctgcctgtctttttcggtatcgtcctttcgattccttgtgtgattatatcgggaacattttgtgaatggtattttggaaccactttaggcaagaaaatttttaagcttaaaatccttgatgattatggtaatcagccaggtcttataaaatcattgttaagaaatattttgtgcatggccaacttttgcccgattttaacagattacacgcctccgcctagtcatacctgggaaacacaaggcactcaaatgaacttcagcatgcatttgaataacaagatctgcaaaactcatattgtgaaagaaaataagataaaagaaataagagaactgcttcgtcaggaatacaaaaaggctgccctctaa

SEQ ID NO: 436 - DNA, 654 bp, Chryseobacterium sp.
atgaaagtcattattacaggagctacaggattagtaggcgagggtgttgtactggtttgtctggaaaacccggaaattgcggaagttgtaatcgttagtagaaaaccactcaaccgccagcacaataaactgaaagaattgattgtaaaagatttttcagaaataaaaaatcatacggctgaacttaatgcatattacgcatgctttttttgtgctggggtcagttctttaggggaaactgaagaaacttttaccagaaaaacctatgattttgtagttccgttcgcagaaacgttgtcccaaatcaactccgggatgacttttatctatgtttccggaagccgtactgacagtacagaacagggtaaggtaatgtgggcaagagtaaaaggaagaactgaaaacgctttgctcaaacttccttttaaagcaatatataatttccgtcccggattcatgaggcccgtaaaaggtcagaaaaatgttcgctttatttaccgtatttttgatacactttcaccattatggtacttggtttttcccaattggatctgcaggatgaatgaagtaggattagctatgattcactgtgtttccaaaggatatccccaatctgtcttggaagtgaaagacattaaaatatcagcccgatga

SEQ ID NO: 437 - DNA, 1131 bp, Chryseobacterium sp.
atgaaaatattcttaaaactgcttaaaagaactctaattgctttattgtgtctcattctcatgatgatctttataggttggttttatatgaagaagccacaatttggagcgttaccggaaggagaaagattagaacaggtcaaaaaatcaattcattataaagaaggaaaattcaggaatctggaagagaaaccgacaattaccgaaggatacagcatgttaggtgaaatatggagatcgctggccaaagaatatcctcatacagaacccatagatgccataccttccataaaaacggatctgaaatcaatccctgcaaacgaaaatgtgatcgtatggttcggacactcttctttctttttacagctggatggagttaagattttagtagatcctgtttttagtggtaaggcatcaccattaccatggggagtaacagcttacaaaggaagcgatatttacacagcagatgatatgcctgagatcgattatatgctgctttcacacgatcattacgatcatctggactatgaaacggtacaagctttacaacacaaagtaaaacatgtgatttgtggactgggtgcaggcgcacattatgaaagatggggctatacaaaacagcagattattgaaaaagattggggcgataaagtacaggtaaagccgaattttgccatttttactgaaagtactcatcatgatggagggagaggctttaaaagttcacaagctttatggctctcattttttatccagtcacccgctatgaatgtttattacagtggagatggaggctatagcagccgttttaagaagattgctgaaaaatatccttccatcgactgggctatcatggaatgcggacaatataataaagcatggcagtcggtgcatgagcttcctgaagaagtagcactggctgccacagaattgaaagcaaaaaatatgcttcccgttcaccattccaaatttacactcgcaagacatccatggaatgaacctttagagcgtatttctgcactctcacagtcaaaatcttaccgccttgccactcctatgattggcgaaaaagtaaagctgaatgacagtacacagcaatttaagcaatggtggaaaaatataaaataa

SEQ ID NO: 438 - DNA, 132 bp, Chryseobacterium sp.
atgtatatctcaattgtactcttttttaagaatgcagcgagaaatctatctttcaaaggatattgtatattttattctcttgcagatttttatttattattggctgaaacaataaatgatttttctctttaa

SEQ ID NO: 439 - DNA, 666 bp, Chryseobacterium sp.
atgtatagtaaaaacattgacaatttcgtccagaaaaatctttcaaattttcaacttaatggaaaaggttggcatgatttgattaagaaaatgctttttgaattttgtattgctggttgggatatcaataatgatgtttatggaaaagaaaaatatggtggtttacgttgctatattcttctggataataaagacttggaacaaacaatcaaaagaatagtgcaaacctacactattttatctgcaaaaacgtgtgaaaagtgtggagcaaatggaaaagaaagagatatcaatggatggacatctactttatgtaaaagctgctatttaggagatacgaatactataaatactaagaaacaaagtaatcttcaggagtgtaaaatttgtggatatttttcttgtgaagaagggaaatgcaaattttgcagaaatgatgattataatatagattatgaattttacagtccaaaaaaatattttgatactgaaattgcatacattaaagaaaaacaaattaaagttttcctcgatgaagatgacgaaatagagcttagcaaaagaaccaagatgtattcaaaatctgaaacccatcaaattctctttactcatgaagaacttgatatttatagaaaattgaatcatgacgaattggatgacgaataa

SEQ ID NO: 440 - DNA, 219 bp, Chryseobacterium sp.
atgggaaacatagaagagctagaagcgaaaattctagagaaagtaaaagaagatcataaagtaaatggtggatctaacgggacagatataaatgaactggataaaataataaatttatcaattcccgaaaggaataaactatttgaaaaaatggtagctgagaaaaagattgcctatcttgatccgctaaatgcccgtagaattaccctaccaaaataa

SEQ ID NO: 441 - DNA, 138 bp, Chryseobacterium sp.
atggtaaaacaaactctaaacggtattacttataatatcatagaaaacagtgaagatctactaatagcatctgcagaaaaggataatttaattgtaatagctaaatataataagactattgtagagagcgtggaataa

SEQ ID NO: 442 - DNA, 294 bp, Chryseobacterium sp.
atgagtaacaaaaccatgatctcacaagatgttgtagataaatgggacctaattccacacgaaaataacattttttacatacattatacgtttagtgatttaaattgtcttgctgcgcatagagaaaatccacaagacgactttataacacttagatactgcaaagaccctgaaaaaggaataggtttaatttctacacaaataccccttgatgagattagaaaaggtgaatttgaccaatatcaatggtgtgaggctcttaaaattgaattaaaaaatcaaacaggattataa

SEQ ID NO: 443 - DNA, 303 bp, Chryseobacterium sp.
atgggaaatacattcgatttttctacagaagaaaaaataattattttagcggttgctaaacacgaaaaaggaaagctactcgaatataataatgatccaatgacaatgggagattatgatcaagaagtaaaagaagttattgagatagaagaagagatcaaaaaagacaatgtcctattatctcgaaatcaacttattgatattactgtttatcttggtgagcttgtagagacgaaaaaattcgactcatcagatatttatgagttggatgctaaattgaacgaaataattgatctgccataa

SEQ ID NO: 444 - DNA, 228 bp, Chryseobacterium sp.
atggtaagacattttgaagagaaagagtggataaaagtatccgatggatttaaatttgaaattgataatatagattttaaagggaagccaataattcaaatttataaaacagatgggaatacttctagacacatgccggtccctacaattatcattgataatactattagactagaggttaatcagccattcaatggttatgttgtaattatttttgataaagaataa

SEQ ID NO: 445 - DNA, 525 bp, Chryseobacterium sp.
atgggaaattttaataagacattaatattattgaaaaaaaatgagaatgctaaaaaatttttagttgattttcatgaaaaacttttaaaaataaatatttctttgaagaaagatttgggagcagttatttttaatgataaaagaaacgaagaagaaaaagaacatattgaattagaaggattcaagtcagatgaggagataattgattttttatgttcttgggaaggactaggccttttgtcatataaacatattgatattaaattcccttttcatataaactatatatcttgggatgatgaatatttacaaggtatagagatttcatatttatcatcagcagagaattatagtaatagaaacaatattaagaataatgttattttaaaaatcattgaacttgttgattttaaattgttagtaggaagtattggagatagtgaagatgattttagaacggacttagatttagaatataatctgaaatatatagaaaataaaaaatttgatattgatattagataa

SEQ ID NO: 446 - DNA, 927 bp, Chryseobacterium sp.
atggcagcagcaaaatgtgatgtttcattcaaaatagaatatgaatcttcattgccactcaaagaggctactgtgacttacctaaatcctcagggacctacacatgatataacgcaatgggttgcaattggtgaaaaagtaaagcttaatgagattcaagaggatatacagactctgggtacatacgagatggaggtgaaattgaaagcaggtgagattgttaccagtaaagtatttcctttaaaagttgaggggtgttccacttcttcttcttgttatgtcccgaagatctatgaaataaaagtgttggaatatggacagatcgtaatgaactactgggttgatgatactagcaatcttgcgactctggaatatcagatcgcaagagactctggctttacagacattgtttactcaaaggtgggttttagtgatactagttacactcaatttgaagatattgacatgaaaaatggaaaaattgatgataatactctattgtatataagaataagaaagtattgttcatctccaagtgggatttcagattggtcgaatgtcgttgattttcaatccggagtgtggaaagagtctttaactacttatctttttaatgttggttgtgtaccaaataagtttaataacccaatagatctgcaagaaagtatctgtaaaacaggaggtatgtggactagaatggtaagattgaatacatatgctccgcaggttggtagtctaatttattcgagtgatgggatgacgcctgcggttccaggaaaattagacgaattagatggtaataatccagttggatttaatgagtatgggatcgggtggataaggttcccggattataatccaaatgtaatttatgatgtgtctccggaggtaggtagaataaaaggtgtttcaaaatatttttgttaa

SEQ ID NO: 447 - DNA, 309 bp, Chryseobacterium sp.
atgaattataaagaagtaaatacgaaaaaagaatacaataatttactaaatgaattaagtattgaatcaaaaattttggcggataaatatcctgaaatttcaatctataaatcaatatataaccaaattattgatatccaaagtatgatacagaataatattaagttatctaaaaatgatatatataagaagtattcaataggtgctatagctgtaaaaaactttgattgcgagaaggatatttttggaagaaaattacaagatttatttggtgctctgtttgaatattgggatatgcctgaatcttag

SEQ ID NO: 448 - DNA, 198 bp, Chryseobacterium sp.
atgaataaaaaaacagattctgaaacctcagcaattacgacagaggttttccattcagaaaacttccatgaattgtgcaattatttagctgaccgggatcctgatttaaaattaattgtagatactcacggatacccaccaatgtggacaagggaaaacacttttgagatgcttttctggaacagcaggcttctttag

SEQ ID NO: 449 - DNA, 1413 bp, Chryseobacterium sp.
atgaaacacacaaacaataaatggctggaactgatcattgttctggccgctcctttactttccgttattgatgtatttattatcaatatcgcaatacccacgattaaaaaaggaattcatgccaccgatggcgaaatgcagttcgtgattgccggatatcttctcgggtatgctgcttttctgattacaggaggaagggctggagaccacttcggaaggaaaaaagttttcttttggggaatgtttgcctttaccgtagcatcctgtttatgtggactgtcacaatcagcattccaattgaacgttaccagattttttcagggattaagcgcttcatttatggttccgcagacgatagcatttattcaggtgctttttacagataccaaagaacgggcaaaagcatttggattatatggaattactttgggaacagcctcagcaatagggcaggtgttgggtggctatttatcagatacgcattggatgatagaaggctggagactggttttttttatcaatcttccgataggaatcattacactttgggccacacacaaatacgttaccgaaaccccgagacatgaaagcacaaaatttgattataccggaatactcattctgacattggctctgttttcccttatctatcctttgattcaggggcgggaggaaggatggccgttgtggagtttcggactgttgggactttcttttattctgtttattattttcatttataatcaaagaatgaagctaagcagaaacggaaaccctttgattgacgtcagattatttaaaataaaagattttaatatcggattaacggccgttttatttcactttatgctgcataccgcttatttattattaagtgcggtctatctccagaatggacttggcatttcagcccttgattccgggttatattttatcgctcccgggattttatttgttgtttcttctgtaatggcttcccgtctgattataagatatggaaagagagtattgcaggtaggcgtccttattctgtttattgcattttatcttcagatgaccctttggaaaccgggaatcagtaacggattggtaataggattaatggcagcatggggatttggaaatggtcttgtgctcccttcattattgaatattgcacttaaaaatgttccgtctcaatatgcgggaggtgcagcaggaatttattccacttttcagcagaccgcttctgcattaggagtaagtgttattggtggcgtatttttctatttttcaaaagaaagctggcagactgcttaccacttcggaattatttgtatattgatttgtctggttatggtaggcgtaatgctgcaagtattaccaggctcagaatctgtaagtgaacgcagtaaaaaaattataaaaacataa

SEQ ID NO: 450 - DNA, 564 bp, Chryseobacterium sp.
atgaaacagagaggacaggttgtcattgacaaaattttagataccgcagaaaaactattctacgagcaagggtatagtaatacaggtattaatcagatcatcagtgaatctgatattgcaaaagcgtctttgtataaacattttgaaacaaaggcggatctgttggtcgcctatatccagcgtatgcatcagctttggtttagcaggcttgaagcaagcgtcagcgaagtgagcgatccgaaggaaaaactgctggctatttttgatcaccataccaaacgacaggagatcaggcagtatggaggttgcccgtttatcaaagccaatgatgaagcgggaacaagcgatcccagggttttagcagaaattcaggctacaaaagttcacagcaaagattttatcaggactcttgtgatgaactccggtcataaaaagattcttacagatgaagaattgacagaaacaatgtatgtcatgctggaaggttccattgtcaccgcttctgtttttaaaaagccggatgaaatacaatttgcaaaaaaaattattcaaaaactgatttaa

SEQ ID NO: 451 - DNA, 216 bp, Chryseobacterium sp.
atgctatacgttgtggcagtgatctgggtatacccagcccttagtgaaccattgacggcgagggtactgttaggagttaatgtattaatgcctacttatgcagacaaaggcaaaactccaaataaaaggattgagatgtattttttcatatttataaaattggtttctaacaaaaatataaaaaatatgatgcaaaattcatctcataaagaataa

SEQ ID NO: 452 - DNA, 474 bp, Chryseobacterium sp.
atgtctcaaataacctcatactggcagcagtttataagcagttttgatactgattctttagctttacctgaactcgaaggttcttttcactttggaggaaaggaagatgctgactcgattgctgagctcgtcttatcaggaactaaaacagccacaggttcgttgttgtgggtatacgaatatgaaagcagatcgattcctttgatcggagaatacaatattattacagattctgatgatcagccggtttgtatcattataacgaccggattatcggttattccttttgataaagtcgaagatcagtttgcttttgattgtggagaaggtgatagaacattagagagctggagagcaatgtacatggaatacattcaatcagaatgtgagcgcattggaagaatacctatagcggaaattccgatggtttgcgaatatttcaaagtagtgtacaaggaacccctgaacggataa

SEQ ID NO: 453 - DNA, 2625 bp, Chryseobacterium sp.
atggataatcttcgaaaatctatacgtctattttttacagattattgttctgattttattataaaaaagaaagattcgggtgaatatataaatttaaatagttttatagaaaaaggttttagaactttttcaaactattccgtagatgaaattcaaaatgtttactataaacttgagtcagattggtttcatgatgttcaccaggaaaagaataaaaactatttccatattcttaatcattttacgtcaaaggttttagtagagcaagatttggaaccattcgtggtatatgagcatttgctaaaatggagagatttatcttattatgttggagaagatatacttaccacttctttttacgcttgtttagatgatcgatctagaagaaaaagagatttttttgcttggcgacctactgtattttcggacaataaaagactacatcagcttttaaaaaaaggattagcagaaaatcattttcatttaaaaggctcgggacctgtttttgatttaagttggattaatataatgaaccgtccaacctcttttgaaaaagcatttgaagatctaaagaaagaaataagtttattaacaaaaacttccaacgcatctcaaagttctaaaaaagaattaaaaatacttgtttataaagcagcttatataagatatgagttgtttagactggtaaataaaatagacgaaaataaagaatttgctattgatatctctaaagaaagcaattcatcagcatcttttgatctgttgatgaatatgcatgagctttcaaaaaatattgaagtgttaagatatgatttgggacatcaatttgaatataagggcaatgtagaaataatagattacaccattcctaaaaatattcatattcaaaatcttgaaaaatcttatgtattttatggggagcgaaagctattatatgagtgttttaagctaatttattcaggtgataaagagtttcaatcatctatttatttattccatgcttatttattgattaaagctcagtttagggcagagcttattcaggtgaatgataaagttggttttggtaatttttcaatgtatcaggatagaaaagaactttttctgcctgatgattctatttatcatacagcatttatgaacttggctgtacatgatacaaaatcacatagcgaaattaaatcttttgaattaagagttgctccaaaggataatgtgttaaaattaaaatcaagcttagaaggctataacaaagccttagatgatcaagcaatattatcaaaacaattaagccgttcattatctgataataatagatttgatttaaaagagcataatatattttatacaatacattatattaaaataagagagactagaaaatattctgatttatcacaagaaatattgtgcagacatcatgatttaaggatagaaataaagaaacaatcaatagccataagtcagctgagagaagggtattctgaaatttcagatttaattaggggaatagatgctgcatctagtgaattcaatgcaagcccggaggtttttgcacaaggatttcgttatttgaaaaatcataagataaaagggtactttaatcatttaaaagacaaattggaagaacctaaaatatatgcaacctatcacgcaggagaagacttttatgatttggtagatggtttgcgtgccatagatgaaagtgtcaggtttttaaatcttacacaaggagataggattgggcatgcattagcattaggaattgatgttaaagaatactacgatttcaagcagtttaaattgatgctgcctaaacaaatggtcttggataatattgtttggttattagctaaagttagaaaatttggtatcggaattcaccgaaatgaagtgaatcgacttgaaaagttgtatgagaatttattttatgaattatatacagctaattttgataaaggaagcctgttagaacaaaaatatattcatcatacaacatattttgatgcctggaaacttcggggagatgatccttatttatatctgtcagatctaagtgaagatatttatacaaaacccaatttgacttattgggaaagatgccgaattaatgaagaatatccaaaaaataaaaatattagaaataacgtagacattaaatgtctttatcaacaatatcattttaatgtaaaaattaaaaaagctggcgcccagattaagcaatttgaaatatctcatgcttatatggaattggttgaagctgttcagtttaaaatgatgcatgaactgaagaataaaaatattgccattgaaactaaccctacttcaaactatcttattggaacttttagaagatatgcaaaacatccaattactaaattttttaatttaggactagagctagatcacgaaaagataaggaattgtccgcaactttcagtatctataaatactgatgaccaaggaattttttctacctctttagaaaatgagtttgcattgatggcgattgctttagaaaaagaaaaagatgagaatggagatttgaaatataactcttctatgatttatgaatggctggaaagagtgagattaatgggtataggccagagtttcaatacttag

SEQ ID NO: 454 - DNA, 2427 bp, Chryseobacterium sp.
atgagtgataaagctattttagaaattaatttaaatgaagaatacaaaataaaaattgaaaaaggaaatgtatttaaggaatcaatctttaaagatgtttataaggaggcattaaaaaatgttattgaaatagttagacattgtgatattaataaaaattctaaatatgatgattttaataatataatttcatttactggagaaagaggaaaaggaaaatcttcttcaatgatttcatttagggatgctttgatatataaagatactaatgatcatagagagttttttagcgtacctataaaagaaaaagatagtttttctttttatagagattatgagaattattctaatgagtttattgattacgaattcttgaaaaataaatcatttgccggcttagatataattgatccttccttatttagaggcgaaagtctatttgaaatgattttggcaaaaatgtttcaaaaattccaaattgatgttaagaaaagtgattctgatataaataatgaagataaaagaaatttgataaaacattttcaaaatgtctttcaaaatttacaaataattaattctgatcgaaaagatttgtataagaaagaatctattgaagttttaagtaaattagcaacaagcagcaatctaagagatgggtttaaagatttagtgaaaatatatcttgatatatttgagaataaaaagaattttttagtagtaacaatagatgattttgatttaagtttttctaatgcatattcaatgctagaagatattagacaatatctcattcaacctaatataattgttcttttatcattaaataaaaatcagctgtttgatggtatttataatgaatttatcaaagaagttcataataaagtatttgacttagatattttaaagagcagagcaggcaaatatatagaaaaacttctacctatcagtagaacaattgaattaccaagctttactgtaaaaaatgatcgaaataatataacatcagttttaattaaaaaatatggtaacgagacgcgtgagtatgaattaaaagatttcagcaacttacacgattttctaattctttatttgaattataaactgggtttattttttactatttataagtttagacagaatttggtaatacccaaaacattaagagaaattaaagaacttatacaaaatgctgaggaatccgattccaataaatttaagaaatacattttattaaaaagctataatgaattagataaagactattcgaaactttttcttggaatagaaacaaacgagaatacagcattattaattattgaacagtttataataaataactttaaaaatcttgatcttaagctggttaatttaattaaaacaactaatcctgataatttatcaataggagatttgatatcattatttgaaaatttagagaagcaagtagatataaatgatgtaaaagtgttaaagtttattgactataccaaaattttcatttcattattaatatctgacaataatttattaaaaaacgcaaatagatttttatataatgggtatgaattgaaatttcctagagaatataatataagaagagattgggttagatttaacattgaaaacaaactatcgggatttagagacgatgactcgatttttttagtgtattcactgatccatatctatggagatccagataataattacagaaattcaagtgtgaattatttctttaggttttttgaaaactttaatcaaggcgtcatgaacccattttcaatttttacaaactatttacaaattagagattacttcttatcggaaaatggtaatgaaggacagttttataatcagattttagagtatgattcagttttcttagataaattagatgaccctttatttgcccaagaatttattgaaggtataagtaattatgcttttaattttaaagaaaaactacctgatgattatttttcagtaatatatgtttatctctatagaggaggtcttcaaactttggaaattttacaaagtaaatatcgattttttattgatgaagaaactataaactcatttgttaactttccactttttaaaatatgggaaaaagaaatgaagaaatcaaatagtatagctagaagacttgtaaatgaaatgtatgaatcatccaagctagataaaaataaaatgaataataatgatttaaataaggtggtcactaattatttgaaaaaagacttactaaataaaacagttctaacaaactttaagacccggataaaggcaatagattctgaatcatttataataaaagaaatagatagtttttatgcaaaactaaagacgcatatgagtcttgaagatacagcaaaagctcataatgattttagattatatcttaatgattttataaatggataa

SEQ ID NO: 455 - DNA, 228 bp, Chryseobacterium sp.
atgataggacagataagaaaaaatgcattgggagaatgggtgagtatttcaacagaaatccgtccaagtgcattaaaaaatgcagatggaagtctgaaacctttttatttgaaaagatcatttacatttcttactgaagataaatttgaactggaaattattaattatgccgatgcttacggagaaatacctttggctaaaattgctcttaaaggacatgtagaatga

SEQ ID NO: 456 - DNA, 153 bp, Chryseobacterium sp.
atgtataaaatgggactatctcttaagatggtcctttttttattgattttgcagacctatatcttgttcgattttagaatctttattgttttgcctattataatgcacaacatagtgaaaaataataattcacaaaactttgatttttgttaa

SEQ ID NO: 457 - DNA, 162 bp, Chryseobacterium sp.
atgaaaaatctaaaaaaattagacagaagaagtcttaaaaatgtaaacggaggcagtggtatatgtaacttaaactgcgaaatacatgaaacctgtggttcaggatgcaatggagaattgatctgtgtaccaagaggaatgtatattcccgataactgttaa

SEQ ID NO: 458 - DNA, 474 bp, Chryseobacterium sp.
atgaaaaaattattgtttttattagtaatctcaatttcttacacattaaatgcccaatcaaaggcagagctatttaataacttaagctactttatcatagaagaaaatatgttagaaaagatagagggaggttttctgtataatgaaagtttaaatcttgttaaatacacacataagcaaatactagctaatggaacagtgaactttcaatctttagaatttaatcctgatgatgttattcaaattaatgcaaatgatggatctgaaggatttattatggcggatattatgatgaataaacaagttccggttgatatttattataaagaagcaggagtcatagtacctgataataaacatacatatattttcactgtggttttttctcataccaataaagataaagccaataatatattccgtataatgaaaaacattttcccaaatagcagaataacaacagacttaaaataa

SEQ ID NO: 459 - DNA, 2964 bp, Chryseobacterium sp.
atgaaaaaaataaagctaagtatccttttattaggggtatgtttgggaacaaatattatagcacaaaatagacctgaagaaagtttgtctttgataaacaaaataaatactaataatgatttatataatggcgctgttaatgtaaccatacctttattcaaaattcctgtaggaaatttgatactatctaacgagatatctaatactccaacaggttttataccgagagtggatgaaagtatttatggattacattggtatggtaatcaaataggaagcattacccgagaagtaaatggagatttcttaatgaccaatttttttgtagcagaccatactaataatgtttatggcataattgcatccgatgaacgcaaggcaagagctacaactgactgcattattcagcagcaaagttttaattctggtactgatccttctaaaaaacaaattttagaaaacccgaatgctaatgtaaaagcagatttcaaaccagagaaattttattttgactttttcggatataaaggatactttatatttgataacaaaggtgttcctatggtattttgtgagaatgcaaaattacaagtattgggacctggttcttttgcttcaaaatgttattctgtaacaagtcctatctcatttggtaatacaaatatcaaccaaataagaataattgatgataaaggaaatacattttattttgggggttcttatgatgctttagaggttaattattcccaatataataattcgggatctattaattggaatggttataatcaaagctattacactgcaaccagagctaattatatagtttcatggtttctaaagaaagtagagttaagtaatggtgatatcattatggcaaactataagcaaggtaattcaaatatatttaacccatttttagaaaaaaccttaacaaatggggcttttttcacaaccgacgttcccactcaatcccaattagatttatcaaatgtcacagtaacaaagtcaactgatgtaattatgtcaagcgctgaaaattacattactatagtaaataatactaaaagagctatgcttgaaaacattgaggtagttgggaaaaatataaatattaattatacttattctaaagatagtaataacctcatacatctaaatggtttaaatttaaattattttggaaaatcagaaagtatagcttttaaccaaactcctttaggggggcaatattaccgatactttttaacttcaataaacaagaataatgaaacgtattcttttgattattataaaacagataaccttcctaataaatctaaccgtagaacaacgaatatatttggattttggaatggatcaagcttattagacccatcagccccaaataacacaataaatcctaataattttatagatgcaaccctattgaaaaaggtagtttatcccaataaaggatatacaatttttaattatgaaaaaagtgattatgctaaacacaatcaagctccacttactccaccatatacaaaccagttagttgattctaattcaaatcctattggataccttaatagaatcgcttccaagatagatttcgatggagaaaaagaatacagaacagattatatatataaacttggtaatgatgtaagttctggaatattatcgggtagaactattaaatatagccagataaaagaaaaaattaataataaaggttatactgaatatttttttagcgatttaattacaaaccctgatattaattcaattagaagatataatataggtgtgggctatattggttatggtagtaatagggaagctgaaagaggaaaattacttaaaaagaagatttataattctaataacataccactccaagagcatcaatatgaatatcaaaactttttaagacctgaaagtgaactggttgatgtagcccttagcaattgtactacatgtaagatttctgatgaaaactattacgtttacactgaggttgatgaaagttatgtacagaatggcgtacctacaagaagttatacaatgtatactcctattattccatatctattgaagaaggaaaaagtaattgattatcttaacgataaacaggtttcagtagaaacaaacacaaagtacagggaatctaacatattctggcatccttatccagagcagattgagagtacaacatctacaggaacaagcatcaaaaagtatgtatatccatatgaattgaagggtggatgtccaggtcttagaggttgctctgatgataataccattgtaggaggaaaattcgctgattattcgacaatgattaattctaatatctgggttcctattatagaaattgtaaaaaatgagaacaacaagtattctcttcaggaaaatctatttcatacctggccaattgtacctaaaaagattagaagctctaagcttaatgctgatctggattttacaaactataagatcagtctagacaaaactatagatcaggtaaactatgatgtaatagataatagaggtaattatattcaaacaacggataaattgggtattccaacagtaacaatttacggatataagcaaagcttacctattttaaagataacagggattacttatgtacagcttatgcaaacattgggacagccaaactcttctactgattatttaaatcttagtatcgtaacaaaatctgatgtagatataaatacagcttcagaacaaagcttacttaatgaattgaatgcagtaagaaacaatccttctttaaagagttatccaattacaacctatacttatgatcctttaatcggagtaacaagtattacccctccttcaggagttagagagaattatatctatgattccgtaggaagacttcagaaaatagtagatacaaatggtcaggttgtaaaggaaatgaagtataactataaaaactaa

SEQ ID NO: 460 - DNA, 153 bp, Chryseobacterium sp.
atggcatcattcataaaagaacttttaaaaatatcgaaaggatgcaatttatcttttgatgaggttttcttaattgcttataactacggtttagtagattcattgggcaatatagcatcagaatttttctatgaaaaaaaagggagtatttga

SEQ ID NO: 461 - DNA, 768 bp, Chryseobacterium sp.
atgaatttgcaactttttgacttaaggcagagatttgataaatcactttcaagcaattatgaatgggtgacgttgatcaatgctatgtgtataattagtaatgaaaataatctttctaatgggtttttactatttgaagaatgtgttgataaacttgcgataataagaactaatatgtttggcagcgcctatatcatagataatataagaattgatgctaacttatttttgtccgaaacggaaattttaaaatttaataaatacatgaaggattgtgttgaactaagacgagaaaatttagatatcttattcaataactttgaattagcatacaattcagatagcacaagcccgctaaagtatcctacgttattagagaaaattttttttaaaaatcattattttggaatctgtcaccttccaattattaatagtgaacccaatgaaaattttcctaaagacttagcacatgcagttaaaagtatatttttagattttgaaatacaagtaaatgaatttttaattgatgaaaatcaagatgcttctgcaaaatttaccattcctcaaaagattaaaatccttcatgaattaaacattattggaatgatgggggacaaaggatttacaaattttcaaacgatacaattattggctgatatttttgagcgttctgaaaaaactatcagaaatacttttgataataatattcataaaagtactgctgaaaaatatatttctgatcttgaaggtttacaagcaaaacgctaa

SEQ ID NO: 462 - DNA, 1236 bp, Chryseobacterium sp.
atggtaaaatatctatttgtttttttattgggtttctcgattaatatcttttcacaaaatactacagagaaagtattgtttattgggaatagtatgacctattttaataatatgccggatattttttccgggattgcccaatcaaaaggaaggaccattcagactgttcagcataccccagggggaacaggctttgtagatcatgtaagcaacagcacattatatgatattatcagaagcaatatttttgacaaagtagtcatgcagccgggtacgggtgaatccggaggagctagttttccggtcagtattacagcacaaagaggaaaccgtataaaagattctatcaaaaaatacagtccgtgtgcgcagatctttttatatgaaataagcaatggaatagcttctgccaatgcttatccaaactattatattactcagcaaaagatcagagattctatacacaagatgtccggattgatgcagattccgatgattcctgccggggaagctgctaagaagcattatcagagtactcaggatcttcgtttacattctagttatggagatgtacatccaaatttgaatggcagctacttaattgcttctgctatatatgcttcaatttatcaggaaaatatatctcaaagttcttatcttgccggagtttcacaggctgatgccggatattttcagggaattgctgatgatgttgttcttaatcatatcaacgactggaacctttcaagttttaatcttttttcaaattttaattataatatgaatggtctgaatgtgaattttcagaaccaatctgtaaactttacgaatgttttatggaattttggagatggtacaacttctgtacaacagaatccagttcaccagtttgcagtacctggtacttataatgtcagcctatctgcttttagtgggaactgccagataactaaaatcaaacaaattttaacatctcaattatctgttagtgaagtgaatagtaaaaagctgaaaatatatccaaatccagcaaaagaattttttaaaattgagagtgcagaacttatttcagccatagaaatttatacagcttcaggaaatatggtaatgaaaaagaaaaatatcagatcgaaagtctatcaggaagaagtttcctcatacagttctggaatttattttattaaaatccttttggagaattcaggctgggtgcattataaactcatcaaggagtaa

SEQ ID NO: 463 - DNA, 1320 bp, Chryseobacterium sp.
atgaaagcaaaactgatatttgtatgctgttttatttttctgaaatctttttctcagatgaataataaagtgaagctagagaatttagacattcctacgaccccggctgtcgtattattagatcagaatgtcacttcaattgaagccccaaaaacagtaaaagaatttggactttcaattattaattcttttaaagataatgggctccctcaaaattatggggtagaatttaatccctattggatttttaaaagaaatacgactgtgaaaaaatattttgaagatgagatgcattcaggatttgttcacaatcagtctatatcaatggcctttgtgaagaatgatagtgtccaaaacctgtcagtaggttatcgaaccaatttattcagagtaatgaataaaaaatataaagaagatgttaatttaatagataagaaagtaaaaggtcttaataaaattaatgacactgaatatgataggcttactaatgaggctgcaaaagaaagttctacaatcagcaaaaattttataaacgtaacaagcaatacaaagtatgatgattttaacgataattataccagtattaaattacagattaaaggatcttcattagagaaagaagctctaaacgatctcatcaaggatatggatggtttagcaaaagatgaagaaagtttcaatattaataaatctaatattcgtgatttatataatgtcattagagtaaaggttagtaaatctttatttgatcagaaaaaatttagtgaaattaatatcaccaagatgaaggaattccaaaaattcgtaaataatttgtcagaatctaagcctgtattttctattgacttcgcgggtgcatataatcatttttttgataaagagagattttcttcaggaagcttcgggcggtttggaacatggctcacgatgaattggaatattaatttagatcgtcctgacaaagaagagcaaaagaattatcttaaactgtatattcttaataggtttcttgtcgataggatgatttataataaaaaggctgatgcttatgataaaaattctttttatgatcttggtggtaaagtgaattttgaatttaatagattaagtgtagcctacgaatatatccacaggtttggtgattttgaagattatagaagtgtaggaagtatcatgtataaaataaatgataacgtaagtcttatcggaggttttggaaaaaactttgaaaatcagaatgatttggttactacacttgggttacgttgggggctcaacttcaataatgatcttgagaaaggtactgggaaaagcgagtaa

SEQ ID NO: 464 - DNA, 378 bp, Chryseobacterium sp.
atggcaacatttcagacacaacaagcgcaaaatacttttttgtatttaaaagtaagcgtaagagcaaactcactaatatactcaagaacgtatgttacggtgcatcccggaggggtgattattgtacaatcgtctcctaaggcgagtaatggttctattcctcctgataaatatagctggtataaattaggcaggacgatcaatttcgtaggaaaacagcttaatatagatactttgctttcagacacaaataatgttgacattatatgtgcactggtagaagatgacgatatcaacaccccatttgttaatggttcaaattatcattcgactaatattgtaaataatattgccagattaactattgacataatttag

SEQ ID NO: 465 - DNA, 1773 bp, Chryseobacterium sp.
atgaaaattagtagaatcattattaataactatagagccttctacaacgaaaggaaagaatctcgttctaaatatgttatcaaccttaatgagggaaaaaatctgctgatttatggtgaaaacggaagtgggaaaagttccttttacaaagcattaaatgatttgtttagatcttcagttgaggtaggttttcacttcactgaaaatgtcttctcgagagagctagaattggatgaacaaccatttatagaagttgattttaaaaaaaataaacaagaaaaaactttttccttttctaaggatttacatcgtacaagtgtaaatgacgaattgcttaggtctgtagcccgtagcagaagttttatgacgtatcgggaattattacgtgttcattttattcaagatcctcaagtaaatctatttgattttttatttggattggatggaattttagcagatcttactactccagtttattcaagacctgaaactaatctgaaaatgaatgcactcttcgaaatcgtcaagataaatccagatgacatcaatctcaaggattttatgcaaggtgcaaatcagatactgagcgatctgaatgagacattgaattatttgcttcgctattttgatcactcgatgacagtctctttttctcaacttacagaagagtctttgagtggaggacagccggagataaagataaacgtatcatattttgggatagacttaaatcatcaaagagaacaatatcaccattttctgaatgaagcacgtctgtctgcgttagcggtttgtatatttttgtctgcacatctttccgtaccttcacctgaatacaaagttctttttcttgatgatatatttacaggacttgataattccaacagaattcctttactggatatactaacagatcacaccattcatggaacgacatcaaaaacctttactgattatcagatatttctgactacttatgacaggcaatggtatgaactggcgaaaaatcatctcggtaatagtaaatggaactttcaagagatgtatatagaccgccattctaaagggtttgatcaccctgtcatattgcctggagaagatgattttgaaaaagctatgtactattttaaaatgaaacaatatcctgcctgcgccaattatcagagaaaaatttgtgaaagccttataaaacaattcttaccagataataaaaagtatgatgctttacctaatggagatattgttcctataaataagttagatacatttatcacaaaattacggatttatctaaaagaaaatgatttaagttttactccttttattaaattgaaaaactgcttaaaagttgttatgaaccctttatcccacgatgattttgatagtccggtttatagaagggaacttttgctggtttttgaaatcattgacgaacttagaaaattaaagaatacaatagttctagattcaggaaaggaaatagtaatgaaaaaagtaaaccctgaaactggattgataagagaatatgtttgtcaattgaccacaccaatccgcaggattgagcatggcaatgaagtacgattcacgaagttcaatattttgccaataacccaaaaagaaggtgatcagaaaaaagtaaaaataagctttggaggaagatttgaagaagtttatgaaaggttatgttattctttagctgtcgaaaaatctgaaaatccatttagtgattttgaattaaaaaacggaacttcaatgaatcaattattcatttaa

SEQ ID NO: 466 - DNA, 324 bp, Chryseobacterium sp.
atgaagaaccctccatggaatagagaagaactcatacttgctcttgatttgtatttcaaaatagattacgggcagatgcatggaacacatccgaaagtcaaagcactaagtaatctgttgagcctgatgaatgaagatagtgaattctcacgaagtgcgagtagtgtttctttgaaacttgctaatttcaaaagaattgatcctgattttgaaggaaaagacttgattgtattatgtgcaaactgtcacagaatggtacacagaaaaagaggaattacacttacaatggaagaactgaagcaaaaaataaaaactgtatcataa

SEQ ID NO: 467 - DNA, 1056 bp, Chryseobacterium sp.
atgaaatatatagaattgttttccggaatcggaggttttagaagagctgcagaattgatatccgaagatacagatgttagtcttgactgtattgctttttctgaaatagacaattatgctttgaaaacttatgaaagtaactatcatttgaacggagagacacgtatgaataatattgttgaatttgcttccgaaaaggataagattgaacaattggatgatttcggattgcttctgggaggattcccttgtcaagcgttcagtcttttgggaaaacaactaggcctggaggatgaaagagggaaaatattatttagtattcatgaactacttgcaggtaaaaatcccgagttcatcgtattagaaaatgtaagaaacattcttacacatgacaagggagaaacactgactaaaatacttgacttcttcaaaagccatgggtataaatatgttaatcatgttcttctcgatacgcagaattttggattaccacaaaaaagaacaagagtattttttgtgtgtagtaaaaagcatctgaacattgatctgagtgaagatgccattatcaacaattttaattcgattaaaaaacactctttaaatatttataaagatgtcctggaaatacttgacaaaaaggtagacaaaaagtattacctgtcggaaaagattaagcatacaattctggcagatggttctaaaaactttaaaagcaattctcagatagacttgactattgccagaacactcacagctacaatggtaaaaatgcatagagcttgtcaagataattactattctgatgatttcatagtaaagaatcattcccataaaaatacttcaaaagaagttctttataagaaacctgtcagaaaacttacaccatgggaagcgctgaagttacaaggctttgataaggagttttataacaatgcaataaattcaaaagtaagcgaacatcagctttataagcaggcaggaaatgcattgagtgttaatacgggatatgcattactgcattatctttttgtaaaatgtaaaatacaggatatataa

SEQ ID NO: 468 - DNA, 1431 bp, Chryseobacterium sp.
atgttagaattctactataaatatcatcagaaaaatttcaggaagaaatctaagaatctttttgatgaacttcataaaatacttaaagaagaaaaaattcctataagagagactgaaaatgtttcaatatctgaagaatacagggaacttttagaaccggatttatttaaaaatcttaacaatgtatactatactcttcgtaaaaataaggcacaaaatcatccgttactcaagaaatatctccctgaattaaaaaaggaacctgctgcagggatgctttttgcagattttttcagtggtgcgggtggattaagccaggggttgattaatgcaggttttacaccggcttttgttaatgataattatatagacgctcttgaaacatattattttaatcatgatctcacattagatagattttatcacggagatatagccgatctgattaataatattgatgattatagacatttttttaaaggcataaagcttatagccggggggcctccgtgccagggcttctcaaccgctaaccggcaaaattttgaaattgatacagaaagtaaagaaaaacggtttattgaagatgatagaaatatattatataagcatttcgtcagtctgctgggaataattaagcctgatttcttcataatggaaaatgtcagaggaatgaaaaaggttgagcgccagattgaagaagatattaataatgtaacagccgaagaatatttttttaatcctttgattttagatgcgcagtattttggcattcctcagagtcgtataaggtatattcttataggaggaaaaaattttttgaatattgaacagatccgggtcagacttatagcaaagcaggataaagagaataggtataagcttgaagatgcactatttggacttcctgctataggtacaaatccgataaaactaaataccagctacgaaagtgaacaaaatggatataatttaagcaaaaagttacttcagcagaatgattttttacatacgataaataaaggccgtacaataagttatttatggaatcacagatctcgttataacaatgaaaatgatctggagatttttagtcgccttccagaaggcgaaaattctctacatgaaagtattcaggatattcttgtatataagaatagaaagcatatatttaaagataaatattataaattaaaaaaaagcgaggtgtcaaagacgattacctcacacatgaagtatgattgtcatatgtatattcatcctgatcagccacgtggattaagccctagagaagcggcgagaattcagacatttccggatgattatgtctttagaggaagtttaaatagctggtataaacagattggtaatgcagtccctgtaaagttggctgaaattatagccagtgaaataaaatattacatagaatga

SEQ ID NO: 469 - DNA, 357 bp, Chryseobacterium sp.
gtggctgatgcaggatatggctcagaagagaactatatttttctccaaaagagaaaagtcaaagcctatatcaagtataattattttgataaagatcagaaaaccaaaattataacatcttcgccttctaacccaaaactttcgaagctccggcataaggttcataagcttctcaatacaaaacggggcataatgctcagaaaacaaagaggccacgatgtagaacctgtgtttgctcaaatcaaacataacaaaggatttaaaagattttttctcagaggacaaaataaagtcgaaatagaaaccggcttgattgctattgcgcataatcttagaaaattggctctggcagggtaa

SEQ ID NO: 470 - DNA, 957 bp, Chryseobacterium sp.
atgtattttttcttatcacttttcccgaatcaggacgtcatttttcgggaattacaccccgtagtacttttttgcttcccttcctctttctatcttttgaaaaaactgattcatcatattatgcatatctatttagtttcacttattgacaaaaaagttcaggaggctatggtaaaattttccaagcttcctatccagacatcggttttaacgataagaccgctcgaagagcttttgtatcatagtggaactatattaaaaacttatatagaactccttaagacactgcatatcttaccagactatgatcattattatcgaagaccattacttataaaacatactttaaacactgtaattatagaaaatagccaggtaattaataaagattatcttcaggcaatccaaaatatggtattatcctatttacagaatgagagttctgatcagcctgacatcattccgatccatatacattttactactatgaaagaaactttcctattttccggaatctgtataagtaaaagagaaaaggctcttgcatacagcctgctccatgaaacagctatgcctaattctcaaatccatggatacagtattccaggatatttagaagaactatgggatatttacctgcaaaacccctctatctctcttcgtgctttgtgttctgggcatcataaaagctattcggtttttcaaaaagacagcaaacgttatttgggaactaccttttatcgtttctatcagcaatacaaaatgctggaagttctggatgatcttatgcttacggatttaagtatcaaagaaattgcttacaagcacgagtttacagattatagccagctttataagctttttcacaggcagtataggttcccttttaaggatattccgaggcttgttatagaaaatgttatgctgcgcggagtactatttgccatatttttgtaa

SEQ ID NO: 471 - DNA, 3225 bp, Chryseobacterium sp.
atgaaaaaactcttattacccgtactattatgctgctctgtgccccttatggcgcagcatagcctttcgggttatgttaccactgaagaaaacgctttacccttaaagggtgcaagtgttgccatacaaaataaaaacacaaaatccatagttattaccgatcagaaaggcttttttgagttaaaaaccaaagaagaaaagcttaccattagtatttcccatgcaggctatactaccaaaacccttgaagtagagctaccacttcatgagcctttaaaaatcgcattatcccataaggtcaccaatatagagggcgtaaacatttccacaggataccagaaaatccccaaagaaagagtcaccggatcatttacctttacgggaaataaactattaaaccagcaggttaccaccaatattctggacaggctggcaaacgccagtggaggggttatccttgaaagaggaacgtcgggagaacccaagcttatggtacggggtatcagcaccattaacggacccaaatcccctttaattgttgtagataacttcccctatgaaggggatatcagtaatatcaaccctaatctagtggaaagtattaccgtgcttaaagatgcctcggcagccagtatctggggcgcaagagctgccaatggggtaattgtaatcactaccaaaacaggaaggctcaatcaaccgttaagtgtagagttcacatggaataccagcttgagccccaagcctgatttcagctatcttaaaaccatttcatcatcggattttattgatgttgaaaagaagctttttgagcagggcttctatgatagtgatatcagttccccctcacatcctgttttatctcctgtggtggatttgctcaataaagaaaaaaacggacttatcacttctgatgaaacgaaccatcagattcagctacttaggaatattgatgcaaaagaacagttccgacgctacatgtaccagccttcagaaaaaagacagtattttcttaacctatcaggcggtgcgccacagttctcatggagctcatcattaggctatgatgataatacaggaaatttgggtgaaaaatatacccgcatgaaccttcgcttccagaatgtatggaaaccttttaaacagctctctgtaagcagcagtgtttactatacagaaagtgataccaaaagcggtcgcaccggctacggcggaatcatcatgggcagaaattcctttgtcccttatatgcagcttgcggatgataaaggtaatccattagccgtttttaaaagctatgaccaaaactataaagacagctttgaagtgggaaaacttttggactggaattattatcctttaaatgactggaagcatgaccagataaaaacgaaaggcacagaagtaatgattaatgtgggaatcaactataaaattattaagggtcttgaagccgatattaaataccagtaccaacgccagcatgatacctcagacaatcttcatggagcacaaagctattttgcccgaaattatgttaacatgttcgctcaggaaaataataatggaggcagcggtggtactaatgatagttatacttttattgtccccaaagaaggcattttggataaatccggagccctaactgtgattaacaataccagaggacagcttagttattccggtaaatggaacaaacacagtttgtcggtaatagccggaggtgaaagccgtgatgccgtaagaacctatgattctaaccgctattatggattcaatgaggatcgtatggcttccggcagtgtagattatacccatcagtatcctttacttcctaccggcagcatggaattcatacaaagactacagtctcagggaaaacgtaccacccgcttcgtttccctctttgccaatgctgcctatacctatgataacaaatacactctatcgggaagcttcagaagggatgccagtaacctcttcgggcttaccaccaatgatcagtggaatcctttctggtcagtaggtgctttatgggaaatttccaaagaaaacttttacaaagtaaattggcttccttatttgaaactaaggggttcctatggctttaacgggaatatagaccccggaatggtagcggtgagcacgattgcttacgatatagacccttcccgttatatcggaacttctatggcaaggtttgataattattacaatcccaagctccgctgggagacttcacgaataatcaacgtagccttggattttacttctcgtaatagccggatcagtggctcggtggaatattttaccaaaaagggaaccaatctctttggtcctgcacaaatggattataccacagggatcgattatatgctgtccaatgtagcagagataaaaggagatggcattgatgtggaactaaaaacccttaacattgataaagcttttaaatggaatactatttttaatttcagtacctaccgtgatcaggtgacccaatattacttatcagacccactagccagtcagtttatcgggaatggctcttctgtaccgatctcaggaatcgaaggaaagcctgtgtattccatctttgcgtataagtgggcaggattagaccccaaaacaggagatccgatgggttatcttaatggacaggtcagtaaggattactctgcccttaccggggtaggaacctcagtaggagatttagaattcttcggctcggcaatacctacggtttacggttctttcattaattcctttagttataaaaatatcagtatggatgttgggattacctataaaatgggatattactttagaagaagctctattaactacacgagtttatttagcagctggacaggacacagtgattatgccaacaggtggcagaaaccgggggatgaagcctttacgaatgttccatccaatacttttcagagtgatgcgaataggaatgctttttataatggttccagcgtgctggtggagaaaggagatcatatccgattgcaatatattaacattacctaccaatttgataaaaacctttttacatccaaaatttttgaaaacctcagtgtatttgtgaatctaagcaatcttggcttattatggaaggctaacaaaagcggaatagatccggattttaatctgggaggtaatggattaaaacctcctgcggtgtataccattgggctgagagctaagttttaa

SEQ ID NO: 472 - DNA, 327 bp, Chryseobacterium sp.
atggaatattatagaaaagtttttcgatataaagtagctgtaggtatagttaataagaggttgagggagaacatttctatcaatggaaagcctatgactcaagaatatttgaataatgatatttatgacaaatataatatagtatggaatagcggtagagaagaatcattacctaatactacaattcaaaatatttaccttctttgcgattactttgaaattgatgttactgtttattttcaacttataaaagaaattactaatcaggaaatcgatagtagcattgagtcaaagagaaagcttactagattatatgctaaattttag

SEQ ID NO: 473 - DNA, 411 bp, Chryseobacterium sp.
atgcctcacattgagaactttgaacatctctataataaacctccaaaggagatagtgactgatgcaggatatggctcagaagagaactatatctttcttcaaaagagaaaaattaaagcctatatcaagtataattactttgataaagatcagaaatccaaaacaataacttcttcacccgcaaatccaaaactttcaaaacttcgacataaagtccatcagcttcttaattcaaaacgtggagtaaagctcagaaaacaaagatgccacgatgtagaacctgtttttgcccaaattaaacataataaaggatttaaaagattcatgcttcgaggacaagacaaggtcgaggtagaaacaggattgcttgccattgcacacaatctgaggaaaatagcaaaagtagcctga

SEQ ID NO: 474 - DNA, 1449 bp, Chryseobacterium sp.
atgcttccgtttgaacacatcatcaacattgataaagaaagtaaaattgcagtttacagacagatcgctgtttctattattacggccataagaaacggtgtgctaaaaccacgctatcatcttcccggaaccagggaactttcaaaaacattgggagtacatcgtaaaacaatcattgcagcctatgatgaattacatgcgcagggctggattacgatcattccaagaaaatacacttccgtatccgaccgtattccattattgaagccccaacgatggaatgaagaagatgtaattccctcttacgaaaacagtttcagtcttccgttcagacagattgatgaaggaatagaagaatcacgttctggattgcttcctgaaatcattattgacgacggacatccggatgtaagactttctccaattgatgagcttttgaaaacctatcgttcttacacatccaaaagacacactatcaaaaatgccaataccgggacagaacaaggcacttcaaggctccggggcgagctggtccattatctttctgaaacaagaggtctgaatataggtccagaaaacatactgatcactcatggtgcacagatgagcatctatctgactgcgcagcttattcttggacccgataccaatgtaattgtaggatcgcccaattatccggctgccaatgctgcatttgagcagaccggggcaaagctcacagaagtacctgtggatgaaaacggcataaacaccgaagctgttgaactcatctgtaaaaagaaaaagattagtgcggtttacgttattccccatcatcattatcctaccacagtcacgctcagcgctgccaggagaatgaaactgcaggaactggcggctacctattctttcgcaattattgaagatgattatgactatgactaccattatacttcttcaccgtatcttcctctggcaggaagcaaccacaatggaaatattatttatatcggatctttctccaaaatcctagatccttctctcagactcggttttatggtcgctccaaaaaactttattgaccaatgcacggcattacgaaaaatcatcgacgtgggtggtgacggctatatgcaaaatgcactggcttttctgatcagggaaggtgaacttaaacggcatcttaaaaaggcaaaaaagatttaccatcaacgcagagactttctggataccctattaaaaaacagattaagcccatatatttcctacgttttgccatctggtggaatggctttctggatcagattgtcacctgaatattctgtacgtcatataatagaaactccacacttaaaaattttacgcactgacgaaaaactgaatgctttcaggtttggttttgcttcaatggatgagagggaattagaaacagcagtagattttttaaaaacagctttggatcgtttctga

SEQ ID NO: 475 - DNA, 279 bp, Chryseobacterium sp.
atggataaggatattgatattcaagagatcattaatcttttagcattatatctaccagaacaatcaactttaagaaattctttagaaacagttggaaatggtcattgggaaagcaaagcttatttcagaattgtagattctaccaattccaataaacgaggagcagaatggcaattcaaagaaaatgtaatcttcgaacaccccaaattaggaacaattgttcttgacattcttaaagataatcaacttggtggaattgaatttgtaaaattgatatag

SEQ ID NO: 476 - DNA, 627 bp, Chryseobacterium sp.
atggcagataatatatggctgggcagatggaacgagagatacagcagtgaagaattcgcttacggaacggagcctaataattatttaaaagaacagttaacgaagctagagcccggttctattctatttcctgcagaaggcgaaggtcggaatgctgtttttgcagctacaaaaggttggaaggtttctgcttttgatatcagcagcgaaggtaaaagtaaagcattacggcttgctgaaagtcaaaatacatctattgactatcagattggtgaacttaagactctcaacttccagacggaacagtttcatgccattgctcttatttatgcacactttccggccgaaattaagtcttctattcatcagatgctggatcggtatctgcgtaaaggaggaattattatttttgaagccttcagcaaaaatcatcttgattatgtaacaaaaaatgaaaaggttggcgggcctaaagacatggggtcattattttcaatggatgagatcaaaggtgattttcccaactatgatatcatagaactggaagaaaaagagatagagctcagcgaaggcttatttcacaacggaacaggttctgtgatccgttttgtgggaagaaagctatag

SEQ ID NO: 477 - DNA, 804 bp, Chryseobacterium sp.
atggttaaaattaataaatttctatcttttatccgaataattttaaaaaatccgagtctggttaatcttattttgaacagtagaattgaggctgaaaataaattcaaaaaatattatccggatatcactgctttgccacagacagacataaaagatttgggtggtgaaatcgtagaagatgttgaaagctttttactggatggcagttcattgataacagatcttcagcttctggctacaattgcggcaagaaaaaatattaattcttatctggaaataggcacatggcgtggagaaagcgtgcacaatgttgccaagcaaatcgatgactgcacaactatcaatttatccaaaaaggaaatgcaggatatgggctggaatctcaagtatgtggaacagcacggaatactttcaaataaaaatccaaaaattcttcatttagaagccaatactaaaacctttgattttggctctcttaataagaaatatgatctgatctttattgatggtgatcatagctatgaaatggttctgaatgacacgaaaaaagtttttcagcacttgattcacgacaattctattgttgtttggcatgactatgcatacaatcctcaaaatatccgttatgaagttttcagggcgatattagatggtacaggaaaggaaaatcacccatttctttatcacccaaaaaatacaatgtgtgctatttttataaaagaaaaggtgcacccttctgtttttgacgaaatggatattcctgaaagacttttccatatcgggattaaggaacagcctttctga

SEQ ID NO: 478 - DNA, 372 bp, Chryseobacterium sp.
atgttcaattttatcaaaaaactattctcaaaagaaattttaattggagaatggctaacggaggatggaagtggtttgtctatgatcatgggctcctggatagaatttaaaagtgatggaacaggtagctatgaaagctggtataatggagaggaaagttatcatataaaaggggattttagatggctgaaaactggatcttttaaagtaaaaattcaggaaaattacaaggacccggagattattgagtataaattccaaacgattcataagaggatagagctattaaattcttccagtaagataaatgataaaactgagcttgaacaattttggaatttggggcaaacgttatttaaaaataacccttaa

SEQ ID NO: 479 - DNA, 414 bp, Chryseobacterium sp.
atgaagaatataattttattcaatttatcgtaccatattttattatttattttacctttagtaattgttattatttttgagggttatggaactgaaatgtttgcttatgctttttattttagtctaatgtaccttctgattggatttatcttagatagtattactcttgttattttcaattatttcaaagttgtcaaatcaaagtggattttgttttttttactttcaataactatatttttactaacagtttatgtattgacaaataaaaatattcttttagaattatttacgtctaatttaagttctaattatgcaagtataatatttattataagtttttttttaagtttttacatttctttaaaattaataaaacccgatgcccagcttcctcctacgaacagaagttga

SEQ ID NO: 480 - DNA, 261 bp, Chryseobacterium sp.
atgattaaaattacatatatatctcatttttttgcaattttcgcattagcactattttttcctaaaatgaaacttgatagttttagtgttatattattttctatttcaattttattaaatatagtttcaattaacattttaatcaagaaaaaaggaacaattaagaagatatggtttttaagtaatttgtttttgaatataatttttatatgtttatttgcatatacattatttatgctttatcaattaaagtatgggtaa

SEQ ID NO: 481 - DNA, 2586 bp, Chryseobacterium sp.
atgaaaaagatgattatcccgatcagtgcattatttatagcgggcttagctcatgcacagctttcacccacagaaaattacgtttattcaaagacatatctttcagaccctgccctttcaaccccaaaaacctcagaaactgttcagtattttgatggattgggcagaccaaaacaggtagtgaatgtaaaagcctcacctttaggaaaagacgtggttacccacatagaatatgatccattcggaagacaggtaaaagattacttacctgttccacaatctggaaccctaaacggggctattgttccgactccactaggaaatgctccatcagtatatggatcagaaaagatctatgcagaaaaagtacttgaaaattctccactggacagaatccagcaacagattcaggtaggaaatgactgggcaaacaagcctgtgaagtttgaatacggagcgaatgtgagtggggaagtctttcaatttgcagccacgaccacttgggtaaataatgccacttcttctgttttgagcttatcagggacttttcctgccaatcagctgtataaaaataccgtaacagatgaagatgggaatatcagtatcgaatacaaaaacgggaaggggcaaatcatcatgacaagaaagcatgacggaaccttttataatgacacctattatgtgtacaatgaatatgaccagcttgcctttgtacttcctcagaaagcccttttccaacctattacggatactttattaaatgatttgtgctatcagtaccgttatgatggcagaggaagacttgtcgaaaagaaacttcctggcaaaggctgggaatatatggtgtatgataagcaggacaggctggttgccactcaggattctaatttaaaggaaaagggacaatggctgtatactaaatatgaccagtttggcagggtggcctatacaggcattaacacaggtggaacaagagcagctgaacagacagaagccaatacctttggatctaatagtgtagacaggggaaatgttgtgttttttaacagacagggaatggatgtatattatggtagttccgaccttacttatcctaaatctcctacatgggttactttattgtctttgaactattatgattcctatccaggttacagtttcaatccctcttttccttcaacaatccagggagaagctgttttgactgaaactccgtcaaccgatggaagaagtaccaaaggattaccagtaatgagccttgtcaaaaacattgaagatgacagctggacaaaaaactatacctattacgataccaaaggccgtgcggtaggaagccattccattaatcatctgggaggctataccaaaacagaatctaaattggattttgcaggagttccacaagaaacctatacgacccatttaagaaaacctaatgaagcaggagtaatggtaaaagaacgttttgtctatgacaatcagaacaggcttttacagcattaccatcaggttgacagccagccagaagaattattggttcagaacgaatacaacgaactttctcagctaaaaaacaagaaagtcggaaataatcttcaaagtattgattatgcctacaatatcagaggatggatgacagacattaacaaagatcagatggctgttcccaatttaggtggaaaattattctcttacaagatcaaatacacccaaaaagaaggaatagaaaatccagatcctgcacagttcggaggaaagaatgtaaaagctaaatacaacggaaatattgccgaagtagactggcgggcagtggaaacattaggtgttaatccatcttctacccctaaaagatatggctatgcctatgataatctcaacaggctttcggcaggatattaccaaaatccgaacaatccttacagcaaagaaaatacagaatctctggcgtatgatcccaacggaaacattacctccctgtacagaacatctgtaataggaggaaataccacggcaacggtaatagacaacctgcaatatacttatcagggaaacaggcttacccagctggatgacgcatcaggaaacccgagtggttatgaagccgcaagttcattttctactgtcataaactatgatgccaacggaaatatgaccaatatgcctggaaagggtattatggagatacagtataattatctgaacctgccgaagcagatagatcttgatcagggcggctcttttacatccagttatctgtatggtgcagatggaacaaaggtgaagaaaactaccgtaagtacggtttcaggatatcagacctctaccaccactacggaggagacggattatctcgatggtttccagtaccttcataaggaaaccgtaagttcgggcggaggaaacccagatgagatgtaccctatggctccaccagaaagagcaatggaaatggaagcctactctgtccagcctgaaaataccgccaccatttctcttaaaacccaggatttgcagttttttctaccgcagaaggattttatgattacacaaaagatcagtatatttacagttataaggatcatttag

SEQ ID NO: 482 - DNA, 3333 bp, Chryseobacterium sp.
atgatgagaaaaataaaagctttattgtttatactgatttttataaagatttcctctcaggcaggaactgtatcggatgataatattgggaaatatgaaaaaataattcctccttctccaagcgcttttgcttttgcaaattatggaaacctaccagcaaatttatttacaggaacaccacggattaatattcctctgttaaagtttgaaacccagaatattaatgttccgatcaatatagattatacttctgcaggtgtaatggtcgatcaatttgaaactttagtcggtcagagctggagcttcaatacaggaggagttattaccaaaaccatttatggagcagatgatgatatgacccccattaattctcctgataattttacgatggtggaccaaagtactatagattattttgaaagtctggtctatacgagtgcttacaatatggaatatgatgagttcagttttaatttcttaggaaattctggaaagttcattatcaataaaaatgggaatattgtacaaacgagcccttctgatattaaactggaaagggtatacagtaacggaaccaattactttaaagctacggatgaaaaaggggtaatatacctgtttgaagctattgaaaaaaccaggtattttaaaagtgcctgtgaaaaaaccgttgtgggacaacctacaacctccttatcgaatgctggctggtatctgaccaaaatcattcatccttctggtgatgaagtttattttgaatatgatgatgttcaatataattatactccttcattaaggcaacaattaaagcttgatatgggagttcagccatatacctgctatgttggagatgatactaatacttccagttttttatatcctaggacaccgtatttttcagactgtcattcgatgcaaacccactatattaaagtgttaaagagaataagttcaaataacattcacaatggggaagtttttttcacttacaatcagaatcatgtcctgtttcagcaatatcagcttttgaccgggatagaaataaaagacggtggcactatccctaaaacgatagaaaaagttcagttagcctatcttaatactccaaacagacattttttaaaaaatgttgagtttcagaatgccgggcagaaataccagtttgaatataatgacgctcaaagccttcccggtagactaagcacaagccaggatctatggggatattataatggagtggataatgggacgtattttgttcctaaagaagcaactatgcttagagtgggagctgatagaaatcttaatgcggaactttcacaaaagggaatattaacaaaagttatttatccaacaggtggtaataccacgtttgaatatgaacagaatacctattggggaacaaaaagaacagtttctccataccagaccatagaagaaagtgttaactatttaacctcgggatcggtatcacagggggcatcattctatacctacacaaaaaactttaattcagggaacttagatccagcggaaccggtagatataggggcttcaattatgttttatgacgagaatatctgtccgccattttatgacccgagcctacctgaaaagtctgatctgtcagtcggcatatctctttttgatgttgatgataatacatatatagacatttatcagggagcaggctctcccatatatgagagtggtaactatatgtcgctacgggtaaattctgaacctatcgcccagactaaagctttgttaaaagctaatcataattatattttaaaggtaacagctcccaaatgcatttctgtggattttggaataagcacttattcatcaataacagttccagcagatgtgctgacggcaggacttagactaaaaagacagatagataatgcagggagcaatccaattgtaaagagatattattataatacgtattccgagaaaaacaaatccagtggtgatgaacctgaagttccttatttcttcacttcgtatgaagatcggatttattgtcctgatgatccgaattcaccatttccaaattgtacctattctgcagaaagcgttggagtatatcattcttccccaatcttttcattattcgatacttcggtacacagcaatatattctatgaatatgttactgaaagtttaggaggagacaatgctgaaaaaggaagaattgaacaccaattcagaattgaccgaaatgcagcctattcttccatttacaatggcacctctcttgtcgggccaagcggaggaattataagttcgggatacagcaatacaggatgggaacatggaaatgaagtagagacaaaatatatatcaggctcagggcaaaccaataaaactattaaaaggacttttgttaaagaaacaagaaataatacaaagtaccacaactttatttttaatcaggtctttccaattaaatgtatatggttggagacagacttggcgaacatgaatgttggatattactttaaagaggcctatcgtaatctgttaggtgaagaagaagttaccgattatgtgaatgggaatattgctttagttaccaatacaaaatatttttataaccacccgtctcatcatcagcttaatcagcaaaaaactacttttccggatggaatagtcaatacagcaagttatagctacgcccacgaaaaaggcaatcagctgatgatcgataagaatatggtagggattccattagaaacaacctcaacccagactattggaaatggcacaaaaacactgtcaagaactgagactatttatccaaaaactgttgcagaaattaccaacaacagctcctctctggttcttcctttatccgttctttcctatgatctacagaataactctccatctaccgaagtcacttatgataaatacgattctaaaggcaaccttcagcagtacacgacaaaagacggtatttcaacaaccattatctggggttacaaccaaacccagcctattgccaaaatagaaggcgcaaaattatcagatatttcacagtctgctattgatgctattgtaaatgcttccaatactgatgcaggtgcggtttcaaataatgatgaaacttcatttttagatgctttaaaaacatttaaaaatagttttccaaattatcagatcaccacttatacttatgatccactaatcggagtaagaagcatcaccccaccatcaggaatcagggaactctacaaatatgatacggccaaccgtcttgaaaaggtgatcgacatcaatggaaaagtattgaaagaattcaaatacaactacaaaaactaa

SEQ ID NO: 483 - DNA, 960 bp, Chryseobacterium sp.
atgaaaaaatatatcattaaaattacattcctgtttttttttctatttttagtaggatattggttgtgctctttaaaaaagtataagttttatggggaatattttataagacaaaaagcaagttattataatcaacacgccgagaaatataatgcaattgttttaggaagtagcagaatgtacagacagattaactctgggttattggattcggcaacattacataaaataaaagcatataatttagcaagtggagggacattcttttccgaaagtctatatgaataccgtcaaataaacattcataaaaatgtaaaatatatattttttgaaattcaagatgtacagccgtttgatataaatgcttataccgagaaatttctatactgtcatgattttcttacggtagatttcgaattaaaatattttatgaataatcatgatttgaattcttcctttttatctgtttcacatttttttgcaaatattttttattttaaaaaattagaacaaagagataaaaccaaaaatgaatttgtaatttataataatggatattttcctttggaaaaagattatgataatcttttaagcgtcaaaaagcaaagactattatatctgaaagatacaacgttagtttacaaagaaagtagaaattttgaaaaaaaaataaaggaaaaattaaacccggcattgatagaacaactgagatttttagcagaagaatgtaagaaaaaaaaaataaaattgatcttagtacttcctccctttgcgaaaccaatggaattaacggaagtaaaaaaaattcctgataccaaaattctggatttttcttcccggaataagtttaaagaattttatattccacagaatgtatatgacaatggacatttgaataccaaaggaagtgctgtctttacaatgaagttagcagatagtgtaaatcatatgataaaataa

SEQ ID NO: 484 - DNA, 537 bp, Chryseobacterium sp.
ttgaaaaggataaggaaccttcttttaaaactaaataacttttttaaaaatggacttaagcatagaagaactaagaagactgctctcttcgatcctacatttagaagattagaaatcattattgaaggcctaaataaagcaatagcatatttcagaggaaatgaattagcaattgattggttgggctcattggatgataagaaggaatatgagtctatgtacaaacttgcaattttagccattgaagactatttaagattaacaataaaatatttttttgacattcatgaagaaaatgattatttacctttctatgaatccgaacctcatattgatttgatttttcttttagctgattacataaaatcaaattcaaaagcatcacaagaattattcagcaagtttgatctaagtacagatgattatcctatttatcatggtattgtaatcctgaataaaaataaagatttaaatgagattctcaagaatctaaagatgtatagagctaaacttatcgatttaaaatatccggactaa

SEQ ID NO: 485 - DNA, 969 bp, Chryseobacterium sp.
atgaaaaaaaatgtatttttattagggatgcttttggtcagtagcttggtttattgtcaagtaggaattaatactactcaacctaagagtacccttgatgtatcggctttaacgactgatggcagcaaaccggaaggctttattgcccccagacttaccggagatcagataagagctgctgatacaaattatggaaataatcaaaaaggagttattatatatgccaccagttcagtcacttcccctgtaccaggatctaaaactgaagatataatggctgaaggatattactattttgatggcaacaaatggctgaattttaaaaatccctattcaggttctgcttctgtagcactagtaggtaactcttttcaaagggaagccttgacaggagatattactgcagctgcgaacagtaatacaacaactatttccaataatgcggttacttccgcaaaaatagcagatggctctgtaaacacagcagatatagcaaataacgctattaccgtggcaaaattgcctgttggtgccacaggaacaagtttcttaagaggagatggagtttggtcccagatccctatttcaagaatgtattataaatattataccttcacaaatccacaaggagactatatagctaattttgacaccaaaatacctgtcagctcatacaccgttcttattgcaggctttgataccaataattccagtgttgttaccgggggatttaaaaattccacatctggagtttatgattttcagacaccggatatccttacttttcagcaaagcgggacctggagaatcaaggctgatgttcctaatgcatcaacaacagccagtcctttttactggggaataagagtattgattatttctaatgaacagatatcaaccctttcaacggaaaatttcaatttaggaggaagtaacgcaggctcggcaacagcttcaccggttccgtaa

SEQ ID NO: 486 - DNA, 780 bp, Chryseobacterium sp.
ttggaagcgatcaaaaataagacaaatgatattgctaagaatataactccttttgattttgatgtttttgaaaggaattatttaggaaatagatatgataaaacaaatcttatagatttctataatgacagaatagaggaaatggaaaagaacgatcaaattggaaatgctcaattttatcaaagtagtttaaatgcaatcaagaaattcattaatgaaaaaaatcctgggaatgtcaataatattcatattatgacaatcaaaaaggaatggttgaaaaaatttgaaaagcatcttgaaaaagaaaataaatctatttcaaccgttggagcatatttaagacctttgagagcaatttataatattgcacttaaagaaaatgcgatttatgagaaaacctctcctttcaatagtggctatcaaattccatcctcaacaaaagtaaaaaaagcattaactaaaaaagatttacgaaaattactagaatcagaacctaaaacccaagaacaacaaaaagcaaaagatttttggtttttcagcttttatgcaaatgggatgaacataaatgatgttgcaaggttacgatataaagattttgattttgaattgaaaaaattttacttcctacgtaataaaaccaaatcttctaaaagaaataatctattcccgattgatgtatttataaatgatttcttacttgaagttgttgaaaaatataaagctccttttgaaaataaaaatcaacatatattttccattgttttcagacacagacgatga

SEQ ID NO: 487 - DNA, 321 bp, Chryseobacterium sp.
ttgaaaataaaaatcaacatatattttccattgttttcagacacagacgatgaaaaacaaaagaaaatgaaaatcaacaattttatccgttttattaatcagcacatcaaaaaacttgcaaaagataatgagataacctcagatgtttctgtaaactgggcaaggcacacctttacaactttgggagttaatgccagtcttacacttgaggaactgagacagtttttagggcataacaatataagaacaacacaagtgtatgttgggagtattgaggatgaaaataaacaaaaaatcaccgagaaaatatataatttctaa

SEQ ID NO: 488 - DNA, 507 bp, Chryseobacterium sp.
atgctaatatcattaccaataataaataacctctcttcagatgaactatgcataaagattttaaaagaaataaagcaagaaaatcaaattatttgcaaaaattgtaaatatgatgaacattactggaagaaagacaaaatttcgtttgaatgcaaaaaatgcaattttagaacttctctaaaatcaaatactctcatgcacagaagtagactgccaatatattattgggtattagcattaaactatataatttgtaaaccccactctacagttgaagctatacgagaaactctcaatcacaaaagatctgaacctatctattatatgtgttttaccataaaaagcaaattaaagaagttgaagaacaaagaaaaaacagaaaatttaatagaaaataggattttttttcatcaaatgtcatttaatctttccgaaccaaaaaatcatgaccaatttacagagagtttaatcaaactgcatcttgaatggttatgtaaaagtatttaa

SEQ ID NO: 489 - DNA, 345 bp, Chryseobacterium sp.
atggaagaactatttttagcattaaagaagagcatttttgaagaattagtagaaattattcagaaaacagttaaggacgaatttgagaaattcaaagctaattttgctcaatcaaaagatgatgagacaatctttacattagagcaaacagcagaaatattgggtattgctccaaaaacaatgtactcaatgaataacaaaaaagatatttcatactttaaaagaaataataaatgcttttatctaaaagcggatattatggattacatttataaaggaagagtaaaatctaaatctgaaattgaaatagaggcagtaaactctttattcatgaagaaaaagtag

SEQ ID NO: 490 - DNA, 693 bp, Chryseobacterium sp.
atgatgaataaatattacattgaagaaatcattaaatacaatgataaaatctctatttacaatttaatctacaaaaagtttaaatatagatggtgggaaatcataattgttcttttttcactaataacaataatatattttttaaaatttttgtgttataaaaattattctagattaattttacctttattatttatgattacatcatttgtgtcaatagtattgattttaagaagtaagattaagaaaataataagcaattattatagctatgctcttaatgaaaatggaaactttagtaataaatcatttttggaaatacagaaagttgagttaatcgcactattagggaatgatttgataaaaaaagacaatttgttgtttttaatagataaattaatggtgtcctatgaacgaaatgcctattcttacagtgttactaaaaatgtagttttaatcactattggtatttatacaggtgcttttttaccaaaatttttagattttgcgactgatatgcaagattttgaaataggtacaaaacttctttcagctgcaataattctatatgcttttttatttatagcaattgataggtttattgtaaaagattttgttttgagaaataaaaataataaaaataggattgtaagaactctagaaaatatctatttggaaaaatacactaattag

SEQ ID NO: 491 - DNA, 447 bp, Chryseobacterium sp.
atgggcttattttcaaccttttttaattcattgggcaaccccattgaagaaactgtcaagacagttgtgggaatttacagaatggcaggaagcagagataaacgccataatctcagagatgtaatatttcacaggatattagccgctaagaaattaggaaatccgaacatttctgatattatgcttttatcagaagaaagtttttttgatgttattgaggatgatatagcattattcatttttgttcttttaatggctgaatcagataaacacaatcgggagttttcacaaaatcccacacattatttctttaaaattgagtccgaagttatcaaacaactgcaaacttatattcccaacagaaataccaattatgtaaaagctgagttattggctatgacttacagtagggataattctgcaaacggacaccgcccaacctattaa

SEQ ID NO: 492 - DNA, 2601 bp, Chryseobacterium sp.
gtgatctcctttgaatatgatgatgttcaataccagtacacaccatctaagagacaggaattaaaatttgatagggggactcaggggtatagctgttatctaggagatgatagtaatacttccggttttttagatcccagaacacctttcttttttgattgttattccctgcaaaccaattatattaaagtactgaagagaataagttcaaataatgttaataatggggaaattcttttttcttataatcaaaatcatgtgtcaacttctgggtataagcttttaactacaattgaaatgaaggacggagggacattacctaaaaccatagaaaaaatccaactggcctatcttaatactgcaagcaggcatttcttaaaagatgtggagtatcagaattccaatcaaaaatatcagtttgggtataatgatgcacaaagccttcccaataggctaagcacaagccaggatctgtggggatattataatggggcggataatgggacgtattttgttccaaaagaagtaagtagttttaagattggggcaaatagaagtgtcaatacggagctttcacaaaagggaatgttaacaaaagttacttatccaacaggaggtgatactacatttgaatatgaaccgaattctgtttggggaataaaaagaacaattattccttaccagtcatttgatgagagtgtcaattatttgacagcgggatctgtcgtgaacggatcattttatacctatacaaaggactttaattctggaaacttagatcaaacagagccggtgaatataggggcctctattatgttttatgatgagacgatctgtccgccgttttatgatcctaatattcctgaaaagtctgatttgtcagcttcaatttcactttttgatattgatgagaatcagtatataagtatttttcaaggggagctaaactatcaaaatgtcaattatatgtcattacgggtaaattcagagcctgctgctacagttaaggccttattgaaggctaatcataattataggttaacggtctcatctcccagatgcattagcgtagattttggactagcaagttttacttcaacagctgagcagatggatctgccgactggaggaactagaataaaaaagcagatagataatgcgggaagtaatcccattattaagagatattattacaatacatatttggaaaaaaacaaatccagtggggatgagcctgaaactccttatttttatacttcttatgaagatagggtgtattgcccctatgatcctactgtatcatttccaaattgttcttactcttcacaatatgtaggagtatatcattcttcttcaatcttttcattatttgatacctccctgcatagcaatatattttatgaatatgtgactgaaagtctaggaggtgataatgctgaaaaaggaagaattgaacaccagttcaggattgacagaaatgcttcatattctacaattcatacaggaaattctcttctaggagttggaggaggaattctaagttcaggttatagcaatacagggtgggagcatggaaacgaattagagacaaaatacatttcaaattcaggacaaaccaataaaattattaaaaggaattttgttaaggaagtaagggataatacaaagtatcacaattttatcttcaaccaggtatttctaagaaaatgtttatggttagatactgatcttggcaatatgaatgttggttactattttaaagaagcctatcgtaatcttttaaatgaagaagaaattaccgattatgtgaatgggaacattgctttagttaccaatacaaaatatttttataaccacccatctcaccaccagctaaacaaagaaaaagttactttttctgatggtagtatctctgagaaaaattacagctatgcctatgaaaaaaacaaccagctgatgatctcaaaaaacatgattggaatccctttggaaacttctacgacccagactgtcggaacagttacaaaacaactggaaaaaactgaaacaatctacccaacttcagttccgacaacaccaaccgggaatttagtattaccattatctgaaaaatcatatgataagctaaataatacttcatcagtggaagtcacctatgataaatacgatgataaaggaaaccttcttcaatatactactgatgatgggattcctgtagctttggtctggggttataacaacactgagcctatcgccaaaatcgaaggaatgacttatgaccagcttacggcttccgtttctgtttcagggattgtgtccgcttcaaacaatgatgcttctaatccagccaatgaaggtgcctttttagatgccctgaatgttttcagaaaacagtcggcattaacaggcaaaaaaatatccacctatacttatgaccctttgattggagttacaagcatcactcctccttccggaatcagacaaatatttgtgtatgatgcagccaacaggctcaaggaaggaaatgtcaggttaaagaatactggtggagcttatattcaggaaacagttcaaaagaataattacggctataaacaataa

SEQ ID NO: 493 - DNA, 180 bp, Chryseobacterium sp.
atgttttatcaaaattggattctaaaatcaaaatcatggttttatgtaggcgctttagttgaacataatctgagtgataaatttgctattcagggagaagtagaatatgccaatttaggagggatacaaattcaaataaaacaaaaactctcagaatttctgagagttttttatgtctta

SEQ ID NO: 494 - DNA, 186 bp, Chryseobacterium sp.
atgaatatatctattctgcaaaagtatattattttatcctttttcaaatactttgaaactcatcagctacagatatttaaatgcccggctccgctcagcgtgacagtttcaataatacaaatcagtatcaaagatgtcgtgctgagcggagccttatcttttaatcttacttcagatacttggtaa

SEQ ID NO: 495 - DNA, 1440 bp, Chryseobacterium sp.
atgtgtcgttctgcattatttttctgtttaattctttcctacattttgtctggacaaaaaatgtctgttaccgagatagatactttacttcacaaaaaaaattatgatttagtaggatcaaataaaatgcagcaagctgttgctctaaataaaaatttatataagaaatctcaagaagcaggttatgaaaagggaaaagtaaaagcaatgatcaatctaggtaatctatattttcttttaggaaattataaagaaagcttaaaatatttacacaaatcggagcaatcaaaaaatattttaaataaagatccagattatctgactcaaatgtatgtttttttggggagaaattatgctgctcaggggtttatggaaacctccaatgataattacagcaaagctctgaatcaggctgaaaaaattgtgaataaaggaaaaaaaggaggatacataaaatttatttacggaaataaagcggtttattttgagcagattaaaaaaatggattcgctttattattatttgcgaaaatcttatggatataaaccgatagtagtagatgcaaccaatctcacagaatattttatgagatatggcaaaaataaagattctgcaaaattgtatttggatagagccgaaatgctgcttacagattctaccgaattattttataaaatgtcttttaatcaaaattcgggattgtattatgcttcacaaaaagagtatgataaagcattgaggttttacgaaaaatctcttaatatggctatcgagctgaaaatgcctaaagatatcatgaataattataaagaaattggtgatatttacagagctcaaaataatgaccaaaaagcaaatgagtatttacttaaatattcaaagctcagagatagtattgcagaaaatgataaagttgctgtgcaagcaacggagaaaaaaataatttctgatgaggaaaaatcttctcagaaatctaaacaaaaatggtactatattctgggaataatacttttgttatttgccatgataggcatttatggctatttgtattacaagaaaaacaaattgcaaaatattttgctggaagagaaaagtgatattatttctcaaaagaatgaagaagtagaaggtttgaaagcaaaagttaacgttgcgtttgataacttgttattattggtaagaaccaatgatccctcatttattatacgattccaagaagtgtatcccgaattttatcaaaagcttctttctacaaacccggatcttaatacttcggagcttaccctttgtgccatgatatggctcggtttttcgtcaaaggatattgcggtttataccttcataacaccaaaatcggttgaaatgaaaaagtaccgactcagaaaaagacttaacctcgaagagcagaaaaatctgcatttatttttacaaagcctataa

SEQ ID NO: 496 - DNA, 1455 bp, Chryseobacterium sp.
atgaaatacacatatcctgaaataatgatttcattactgtttatactattttttgggaatagtaacgcacagaaattaacttattctgaaatagatatattacaggaaaaatggcgccaaaaatatttaaaggaaggaaaactctctgaagggattgaatttagcaaaaaaacaataataatatcggagaaggcagcatatacaaagggaaaagcaagaggaaatatatatacagccaattttctgaatgctttaggaaaatatgaagaggccatgcaatatttgcaaaatgcagaaagcttgatcgatgagtatcgtgatgatcccactttattatcatttttatttgctgaatacggaaaaagctattatgcatcaggctttattgaaaaatcaaataaaaattatgataaatcaataaaagaggccttgaaaataaatgataaactaaacagaaaaatttttctacattttatttatggaaataaggctgtaaattttaatcagcttcataataatgattcattgtactattatacacataaggcatacaggatctttcccaaagtaatagaagcaaccaatcttacggactattttctaagagttagaaaaaacaatgattctgcaaaattctatttagagagagcggaaaatcttctgaaaacttcaacggaaatattcgattatctgatcttttattatatctcgggagagtattatgaatacaatggggaatatgaaaaagctttaggattttacaaaaaatctctagatatatcctttacaatgaaaaggtcaaaaaatataatgaataattataaaaaaatatctgagatgtaccagatcaaaaatgatgatgaaaaagcaaatgaattcttattaaagtattcaaaattaaaagatagtctggctgaaaacaatagaaaggctatacaggcttctgagaagaaaattgttgaagatgaaaaagcatcttctaaaaaagctaagcgaacattatactatattttgggaataatatttctgttattagtcataataagtgcctatagctatttaaattataaaaaaaacaaattaaaaaatattttactggaagagaaaagtgatattattgctcaaaaaaatgaagaggttggagatttgaaaacaaaagttaatattgcgcttgatagcttattattattggcaaaaactcatgatccttcttttattaaacgattccaggaggtataccccgaattttatcaaaagcttctttctacaaatccggatcttaatacttcggaccttaccctttgtgcgatgatctggctcggtttttcgtcaaaggatattgcggcttacaccttcataaccccaaaatcagcagaaatgaaaaagtacaggctcagaaagaaactcggtctggatgagcagaaaaatctgtatatatttcttcaaaacatataa

SEQ ID NO: 497 - DNA, 1320 bp, Chryseobacterium sp.
atgaaaaagttaatttttactattctagcctttacaggttatgctttttttgcacaaacaggcaatgtagggatcaatacctcaacacctgatgcagatgccgtattggatgtagtttcttccaacaggggaattttgaatccccgtattgcattaacgggcaccacttcaccgactccgctttcagcccatgttgcaggaatgatggtttacaataccgaaactgcaggagcaggtgctactgctgtagtaccggggttgtattataatgacggaacccagtgggtgcttacaaaatccaccccggttacttctgttagtaatacctccaatctcacaggagccaacacaatcaccacaacagtgaacggagttaccggggcatcagctatcatacctaatatttatactgcaaacgggacccttacagaagaccgtacagtaacaatggcaggcaaaacactcacctttgctaatggaaccgaaagctcattgatcagcaatagcggtggattttccaccttatacaataccggatcccagagaggggcagtatcccttacaggcggaaacgcaaggggagacctctttgtggataatgccaactatttcagtattataaacagcggaggttccataggaacggtaatagggagtacgaatagcaccccgatagagatgcgtgtaagcaacggggctaccgttttggggaacgcagcccttacacccgccggaaactttgggatcagcactgcatcacctacacagcgcctggatgttgccaccggaaatgtgaggataagggacatcaatactgttgcaggaaatacacttacagataatatagtggtagcagatcctgccggagtgctgaaaaccatttccaataacttccctgtactttcggcaatcgcccttaaacaaacagccactacaggtattgcgggaggtactgccactacagtagtgtttgaaagtaaccctaagatcgagccctcatatcttacctataatactgctacaggtatttttacggtagtaaaggcgggctactacaatatcagtgcttttgtagcttacaacattccgacgggtgctaccgctggtacagcaacaaccaggatcattaaaaatggaacaacggttcccactcttgcttttcagacttcctatcatccggaaataaccaggaatataggacacagtgttactacagttgctttttttgctgtaggagatacttttcaggtgaccgctgtacatacccaggctttcaatatagctcaaggcagcatttctgtgacctatatgagtaattaa

SEQ ID NO: 498 - DNA, 507 bp, Chryseobacterium sp.
atgtctaatcttactaataacagaatcagcagcacccttactgctacacagatcactgctgtgaaaacagccattcagactatctataccaatatcccttttttgttgggacttaccatagaagaaaggatcagcctgcctaaaataaatgtggtcaataaggcttttacagaagatgccatcaatgccattgccaataatgcaggcatgcttcccaattatcttaatgtaggtgatatgaaaaccgatatgcagttgtttgcccagctggatgagcttacagggttggtgcgccagctgctggaaaagctggaagacacccagcttctggcggggagtgaggcatatgtatcggcacttaccggatatagattattcggggcggctgcggaagcaggaatcccgggttcggatgccatctatgatgggctgaaagcgagatttacagtctctccggcaaccaatacaaatacagaaaacacagatgttactatagagaagccttaa

SEQ ID NO: 499 - DNA, 180 bp, Chryseobacterium sp.
atgaaaaaattgattacccttttcggaattgcttcctgtggagtcttttttgcacaaaccggtgatgtagggattaatacttccatgctacattctaatgcggtagacaactactactattgcaacgttgggagccacagatacagcaacttttaccggaactgctttaaccaattttaa

SEQ ID NO: 500 - DNA, 168 bp, Chryseobacterium sp.
atgcaaatcagtcaattatataaaaaacgcagtgtgattgcagttataaaaacaatgattgttctatgctataatgctgttttgtttaaacttgagctcaacatgtttaagaaagatttaaaaatccatattcttatcaatttttcatatataaatttaaacgattag

SEQ ID NO: 501 - DNA, 522 bp, Chryseobacterium sp.
atgaaaaaaatatttatatccctatttgtctttatgtctgcctgtgtttattcacaggtggccataggcaaaagctcagtaacaaattcctcagtttctttagaattcggaaatacagaatcaaaaggacttttgctgccttgggtaacctctgcaggagcagttgcaggagctgtagacggaaccctgatctatgatacaacagataaaaaaataaaatacaggaaaaacgggaactggtttgacctgagtgtagatactacaggaactgtggatacagctttgcaggagccgctttcggagcaaactaccgcaaagaccgctataggatccaatgtaggaacagatccaactccgggcattctggtattaacagataccaataaagccatgatccttcccaaagcagacagcccgcatctcaatatcatcaatcctgccccgggaatgattgtatatgacaatataaagcaccagctggctgtcttcaatgggacagtatggtctttctggaaaccttaa

SEQ ID NO: 502 - DNA, 1434 bp, Chryseobacterium sp.
atgattaaaaattggcaattcgttataagcaaaatattcattctgatatatgtatttacagcaatactattaaacgctcaggactatacgattcctgaaattgatagcctgcagaaaaaagatatcgaaaaattaatacaggtaggaaatattgaaaaggcttttcttcaggagaagtatttgattaattattcccggaaattacattatattgatggtgaggtaagagggtacctgaatataggatgggtattattaacaatggacagatataaggaaagccttcgctttttggaaattgcggataaaaagcttaaaggaattaaaaacgacaaactgagagccaaaatgtataatctttatggaagaaattatttcacgctgggattatatcgacaggctattgatcattttaataaatctttacaatatactacacctaaaaacaaagaattgagatatcaggcttatgaatggaaacgagcatgttttatagctttaaatatcatggattccgtatatagtaatgaacgtaagtgtttacgtgtacagactcctacgcctatgctatatatagttattgccgatagacatataaaggctaaaaatgttgattcggcagcatattacatcaataaagccaatgatcttgtgcttgcaaacaaagctcacttagaaggaaaagctaatgtattgcgcgcgtttggcaaattatatattgctagaaatgaaaatgaaaaagcattagactacctttttcggtcattagcaattactgaaaaattgaaatcgagaaaaagaagactgcagttatatgagattattgcagaagcttataaaaatttggatgtcatagaaaaagaaaacgaatatctgggaaaatatgctatgctgaatgatagtataaatcagataaaaaaaaataccctgagtataccgatagaaaaatttcttaaagaacaaaaagaaagcgaagaaaaagataaagagaacctttattacctcattattggaatttctctggcaggcatagcggcaataacagtttttctcattttatataaaaagaaacaaaagctaaaaaataggcttatttttcaaaaagaacaggaaaataataccataaaaagaaaactggataccacttctgaaaaaatagtacagcttgttataaaaggagaccctgaatttttaaaaacctttaaagatacctatcaagaattttacagtcatcttatctgggaatatccaaatcttacaacaaaagatatcaggttttgtgctttggttaaacttggtttttctaataaagaaattgccttatatgacaatatatctatctataccgtagaatcgagaaagtacaggctccgtaaaaaaatgggtctttccgaagaagttaattttaatagttggatcatgggattaggttaa

SEQ ID NO: 503 - DNA, 129 bp, Chryseobacterium sp.
atggaaatatcacttcgaaacgaggtggctgtcgttacaggagcctccagtggaataggatccggaatagcaaaatctccggcctctgcaggtgctgtggtaattgtcaatcattcttcagaaagatga

SEQ ID NO: 504 - DNA, 309 bp, Chryseobacterium sp.
atgaaatatcttgaaagtgattcctataaaaaattgctggaatttattaactcaaataattatcaagttttcatatttggttgttcttgtagcatttctgatagaactttattaaacactttatttgaacataaaaattgcaactcaataaaactatactatcgtcaaaaagatgatggttttgataactatagtgaaatgataagaaatatttccagaaatttcatagataaagcctcaatgagagataaagcctcaatgagagataaagtagtaaataagaaatatacagatgcactatttagataa

SEQ ID NO: 505 - DNA, 324 bp, Chryseobacterium sp.
gtgtttagagatgcagatggtttttattcattgttaaaatttgcggatcctgcaataaaagattttgaattaggagggttcattacacgagaaggagataaaatgactatggaagttgctggttactttataaattctaatgtgaaaaaagatataggaggattaggtgctcggggtatttctgaaattaatcaaatgttaaaagagatcgcgaaaaaagaaggcgcttctacagttacaataaagtatcaaagatctttagaaagttcttcgaaggttaaaggacccccgctgcgcaaagtctgtgactttgagctacaataa

SEQ ID NO: 506 - DNA, 276 bp, Chryseobacterium sp.
atgctggttcatatagtttggataagctctgcatatcagcccaatgatacaggattgttttctatttctactcccccattggctggggattggtctaaagttatgtcagtaagatccagtggaaaaatatttatggggcttagatttaattttacacttaataactgcagtagctacagattgtttgttcaggaagggataagaatagaaaaagtaaaagtggatattgcctctgcgaatgggtgggcagactatgtcttcaataaaaaattataa

SEQ ID NO: 507 - DNA, 912 bp, Chryseobacterium sp.
atggccctgaaaaaaaatttctctttgataactattttattttgtttgacctttttttatagccaaaatgaaaagatttttaacaggattgattcattaacctcagcaaaagatattcaaaagtttattgaaaataagaataataaaattaactattacttaaatgttgaagacaaaataaaatatgattcgtattgctctgcaattggagatagtctgaaattaaaacagaactgggagaaagcagattttgataataacggattgacagatcttttggtaacaggaaatagttctgatggccctaaaaccatttacatattagataaaggaactcattttgaatcaaaaaaccttagtaagggaaaactttatgaggaatggtcattttcatctgtaaaagataataagatagaatattacagtatcaaaattctcagtagatttggatttttaagcaatttaatcaaagaaaaccttgtctataaaaatggagaatttattgaagagaacctgtctccgaaaaaacataatattttggaaataaagtttgaaacttcaggctcccgatggaattattacaggttcgagatggaaatcgtatcaaacaaagatgcaacatggacttccaaagatgatggttttataccctccggtgtttatacatcaaaactttcagaagaagattttaaggaaattattgactttgtaaattacattgattttgaaaatttaaatgatgaatataatgtctcatattcggattctcatacaggatatttgacaattacttatgataatttaaaaactaaaaggatcagtgattatggattaatgggaacgagaggcttaaaaaaactttatgatatcctggcagcaatgaaaacaaatcaacattggacaaaactataa

SEQ ID NO: 508 - DNA, 150 bp, Chryseobacterium sp.
atgtcacagcaacagataaatcataatatagatattcgttctcttcaggatgaaggttacgaagtggaaataaaagaggctgtctcaaaaggcagtctcattttattagtttttttccaaataataaaaactttcgattttttagaatga

SEQ ID NO: 509 - DNA, 330 bp, Chryseobacterium sp.
atgaatgagaaccaattttttataaatttgggtgctaatatttcctctattaggattaaaaaaggtataaatcaagatgatttggctaagtatctagatttatctcgaccatcagtcgttaatattgaaaaaggaaaacagaaacccagtatttatgcgttgatattaatcgcgaattatttaatggtagatattaaagagttgttaccagaagtaatacccgcagttgagagaggaaatgttattggtatgggctttgatccatcaattttttctcaagatagagactttgcaaaatttatgaaaatcatttcaaaaaacaacaaataa

SEQ ID NO: 510 - DNA, 522 bp, Chryseobacterium sp.
atgtcaatttcaaaaagtattattgatagcacacaagagtatatcaatgctaatacttttcatttccaggatttgccaattaacgtggaactcttagtggaaagagaaggggttagtttgattacttatccattcaaggatgatatttcgggtgtattaattgtagaaggagaaaatgcgacgattggtgttaataaaaattctagtaatgtcagaaggagatttaccgtagcgcacgaacttggacattacaagctgcatactgagaaatctaatatgtttatggataaggttttctttagaaagtggtccgaaggatatacttctaaagaagagaagattgaaaaggaggcaaactattttgcagcaaacatacttatgccggaaaatttagttagaagagaaatcttagaattgaaattagatttacatgatgatagtacaatcgctgcgctagctaataagttcgaagtcagcctatccgcaatgacttttagattaatcaatctaggtctaatttag

SEQ ID NO: 511 - DNA, 3666 bp, Chryseobacterium sp.
atggacaacattgaaaacaacgctgccgaactgccggcagaaaatacaccaacacagacacttttcagatttgtaagcttaagaagcccgcagctgtctgatgaaaatgaacaggataaaaggtttattctggctccccaacaattaaaagatgacgacacattttacagaccggtagtagaggcttcaggttcaaagcatagaaagcttcttgagtgcgcagccgcttttgcaaataatctgaaatgtatttcatctgatcctgataatataaatagtcttgaaagatttaaaagtgcttaccctctggatcatcaattttcagtttggctggcaaggaataaaggaacgtgtacatatgaggaatttacagtaaaaaaagatgagatatataacggacagatttatgctgttcccgagctgctagacctttggaataatttaatctatcaggtagctgtacaaaaagatttttatataaaagaacttgctatgcagtttcttctgttaaaacatgttttctctgcttccaatgaagaagaatttaagcttttattgaatgctaaaattgtacttcctaaagaactaatgctggatgaagctgtttcaggattgcaaactatttcaaaggttgcagcaaatgagtttgcaataacctttcctaccgaggaaatgaaaaagcaacagcttatttctaaagaaaaagtgaagcttgggcggtatgagagccttgcaaagaacctttcccttttagagaagcagtacagggatgaataccaaaaagaatacgaaatccggtacgaagaacatcagttaagaattgcacccattattgaaaaatataatgatgatgtagcagcaaacagagagaaatactgtccagtaagagctcctggagaaatttatgacccgaaagatccttgtcagcagatcccaaaagttcctgagccggtattgccaaagatggactttcaattccggtctgaaattgaggctgaatatctggcgagtgtattaaagcctgaaaatttggataccttactggatattttaggttatgaatttcaaaatgtatcatctgagggagaaagtctggcagcaggagaaacctctgatcttcatcaactgttagaaggaagaaatacattttcagagatcaattctttgattacggaagtaacagaaaatacgaacagaatcattgcagaaaatacggaaaccaatactgaagcctatacaagtatcggaggagttattgttccaatggcaagagcggcgactgtaccgtttacctatcagttgtgtccaaaagatttatatagattttacggtcttgatctcgctttaaatgttcctgatgcttcatgggatatttctggagtatatcatgagttggtatccaacgttggaaccaaaacggggaatgattttgtaaaatccagaaatggaaatacaatcttcttaaataatcttttagggcagggagccgatttctcagaatttgaaggggcgtccttttatattgagctgtattttacaaatggacaggtcgctaaatttaaaacacccggaattactataaaaaactgtatttcttctagttttgaacttgaggttgaaggaactgaaaatcctcctgttattattgatgaggaacagaactttattccttcgggtttcggcttcaagcagatcggaattgctgattatttaaaagttgagcagagtacccatgcttatgtagagggtgaggtggctcatattgagaatattatggcaagagaataccgtgaaaaatctaccaggaagctgagaagaagcgaaaatactacaacttcatcttctgatacagaaagagagcagctttctgataccacgacagccaaccgttttgaaatgcagtctgaagtttccaagatcttacaggaatccaatgattttgcaggttttgcgaatgcaaattataaggggcctggtggatcattttcaatgagcgtaggcgcaaattatgccaatcaccgctcaaaagacgaaagtacaagacaggctgttacccaggctcaggatattacagcaagagccatggacagaatcgtaacaaaagttcatgaagaaagaatcgaaaagatcattgatgaattcgaagaaaacaactctcacggatttgataatagaaaaggagataaaaatgtagtgggtgtttaccgatgggtagacaagctgatgaaaaaccagatctacaactatggcaagcgtatgatgttcgagtttatggttcctgaacctgccaagctgcatttattaggaatggtttctcagaaagcccctgatcagatcgatctgatcaagccggaagatccaagaacatcagctgttatgccgatgaaaaattacggagatcttattacggattctgttttaaaatactgggtatcaaaatataatgtggaagtacctgaaaaacctgtagaaaattacagtataggaaaatccttaagcgggcagtttgccaatgaaaacagtgcgatccagaatgtggctgttaaagacgaaattcagattccggacaattatgtggcggtaagctgtgtagcggggtatagtgcggctggagacagtagtgagtctgcgatgtgtatcatggtaggagatcaggatttctatcaccatggattctggtctcagctaaaatttcattcaagaaaaactttcgctaaatcgtattcaaaaacagttcctgtttctgctactttttacgaaattttctcaggaacagcgaattgtgttgtggatcttcagttgacacaggaggctaaagattcatggtatcagaaagtattcaaggcaattatggacgcttatgaagatgctttggtggaatacaataataagcttactgaagaaaaaagcaaagctgtagagattaaaggatccaatccaatgttctaccgccagattgaaaatacaattttacgtaaaaactgtatttcttatatggcagatagagccttagggtctacacacggatatggtttggaaggattaaccagtggcacttctttcagcaattatgaaacagttttaaacagcagtctggataagtatacggcttttgtgaaatttatggaacaggcttttgagtgggaaaatctttcttacaatctatatccctattactggggaagcaggcaaaactggctgaatctctaccagtccgaagataccgacccattgttcaggtcctttatgcagagcgggatggcaagagtagtggtaacagtccgtccgggatttgaagaagttgtacagttctatctggcaaccggaaaaatctggaacggaggagaggtccctgtcattggagacgaactttacttatcaattgtcgatgaaatgaaagaacctaaaggtttaaaacaaggaaaatcatggatcacgagacttcctacttctctgaatatccttcaggcagaaagtataggattaaaagtaaaacatgcattgcctttcagtacagagaatccggatgattttgaagttccttcagaggtgattacagaggataagttcaattttgaatccaatacgaatcttctgggcgttcaggaatcaggtacatcttctgagcaagtgatttctggagattgggccgcacaaactaattaa

SEQ ID NO: 512 - DNA, 2244 bp, Chryseobacterium sp.
atgagtttagaaatattaaacaatcctttattaggaagtcctgtgagttctttctttaaaaacgaggatccaaaatttcccagctcttcttcagttcttatttcgcctcccgaacttaaacagcttacagcaaagcagattgccaatacgtattataatggtaaacccgcattggaaggcaacgggtttcaaatttattcggatgagccggtatttggcggaaatatagaggaagtagtggtctacaaaagcaggtttagtcaaacgataggagggattgatgttgttctttttgcaagtaaaaacggagcatttcttcttcagcgttatatggaagcgttgccaggcagtaagcagctgatcctttttctggaaattgatgacgaatataattacagtacggtaatgcgtgttgtggcaggagcagatcttacgaagaacaaagaagaattatttgatgatatacttacttttacaagaaaacatgaagtcagcgttcctccaaaggcgcttgaagatcttataaaaaatgggatatatagaaacaaagttagtttcatcagttggtttctggggctgaaagacgccagcgtaggacaaatatttaccttttttaagcaggaaatattagaaggagctgcaagcttccttattgaaggtatcgcagataatattactaagctgagaattccagaaaatggctggaatccgtatctgaaagaaggagaatacgatcctgcttttatccctgctacactttatgaagagcttaaaaagttttatgaacatgagggctccgataatccatacgaaaatttggaaggccaaaagaagatcaattctaaaattgttaaaaccctatttgaaaggataaacggggttaagacagattttaatcatcttttaagcaatgcagagcatttttttccggcttttatctttaaaaaaataaaacagtctttaaacttgtttttcagtcaaatagataaaatagagcaatttcttgttgatcctattacgggtatgcagcatataatctacagaagccaccagatagccaatgcttttctctgtgggatttataacagtctcattgatattgttgccgggattttttccatcatcggttttattttcaaagctgtggctgcaatggataaagtgaacgaccgtaaagtggagtatggtgagatgtttctggaactgatggaagacctgatggagggaatcatcaagtttgattatgcagacttttttaagcagtgtctcacacttcagataagaactgttatgcgtcttgtaaagtgggttgatacaaaagtatctcagcttaccttagaaaaagcagcgtattattatggttatattattggaattatcatagatcttattgttgaaactcttcttactggcggtgcagcagcagtggcaaagctggccaaaacagtagaaagctttatcctgaatcctttggaaaagatatcgaaagcaattacacaggcagggaatttcatgacaaggattatggagtttatcagcatgatccttcatgaattaaaaaaaggaacaaaagaaatttttgctaaattggagaaaattttagatgaagtttttggctttggggatgaggttgccgatcatgctttgactcctgcggaaaaaagggtgaaggataataataggagaagacagcaaaaacttgacaggaagaagaaaggaagaaatggaaaatataatttagatgaagtagacgttttaggctcaagacctgctactaaagaagaattgttagaatgggaaaagaaaattaaaatcttagcttttaaagaaaaaggaagatttagaatggctacaaagaatactcctgcatttagatatatggaaaaaaacaaagtagctgcttattttgatgctcatgagatcccaccaattatatggtatagtgaaggttcctctaattatgtaatagcccatgaatattatcatttggaagagttttgcaagattgggagaaaagcctttatagaaggtgatttaggaactttaaaggaatggcatacaaataatatattacgagagaagtacgtagctgaaaaattgttggagaatgctgaaatattacatctatccttaaatgagttgacacacattaaatggtattatcagaaaaaaattattcaacctgcagttaatgatggcgtggaagtgcttccagaatttattataaaatttaaaaattattga

SEQ ID NO: 513 - DNA, 267 bp, Chryseobacterium sp.
atggaacaacaattattacagaaggtaaaagattatcttgataaaaaaggatttactattaatattgaacaattatcctattcaggaataagaaagaattctcctttgtttgaaggtgaagggacaaagccaatgcatgttataacatgtagtattgatactattaaaaacaatccttatagtacaaatatttatacagttactattgatgtaaagacaaatgaattagaatatattgttggaaataatatatttgaaaaaatttaa

SEQ ID NO: 514 - DNA, 270 bp, Chryseobacterium sp.
atgatagaaaaaaaattagaaaaagaattagaattatttctaaaaagtcacaatagatcttaccttgaaaattccattgaatattcaagtttgaggcaaatgaaaagacgagatgggacatacagaaaattgcatgttgttaactttatggtgtcaatttcagagcaatcatatgacgggaatggattatactttgccacttttgatgaaaaggaatatcacttagttgaaatagtaggtccacaatcttatgaaaaaataggagaataa

SEQ ID NO: 515 - DNA, 234 bp, Chryseobacterium sp.
atggaaacaccacgattttgtaaagtaggagatagacctgtaaaagcagtattagaagatgatgattttggggtttatgcttttgattggaaaacaggttactttattttagatttatcatatttagagaaaatttatttcggaagaatggatgatgttgaaattttaactgaaaaagaattcaatgcatatgttgataaactaaaaaaagaaaaagggtttgatcaaatttaa

SEQ ID NO: 516 - DNA, 375 bp, Chryseobacterium sp.
atgactgtctcatttgaaaatttcccgatttataaaaaggcaattgcatttacagttaaaatttttaaaatccttgataatgaaaatttacaaaaagaattttcactcaaagatcagctaaaaagagcgactttatcaataactaataatattgcggagggctcagaatatggaagtaacaaacaatttaccagatttctttggatttcaaaaggaagttgcgctgaagtcagaaatatgctgtttgttttatacagtttagagaaaatcaatgatgaaattttcaatccacttaatactgagtgtctggaaataacaaaagagatttatcattttataaaatatcttgaaaagagcactttagatgctaagtaa

SEQ ID NO: 517 - DNA, 1146 bp, Chryseobacterium sp.
atgaatcatctgaaaacgggtaatgcttattttgcacagggaagctataagaataataaatataatggcaaggagcttcaggaaaccggaatgtacagttacggctggagggagtatatgccggatattgccaggtggaacggtatggaccagctttctgaacaatacttctcttcaagcccttatgcgtatgtactgaacaacccgatcaatatgtttgatcctgacggaagggaagcagcatatgctgcgtggcagacaatgtgggatcaaactccagatggcaccaattcttattggacaaatagcggctcaggcggtggtggcggacattttgtatatacaggcggaaccgcaggcttgacagcaggatatggcataggctctaccatagactttgcaggtaattttagttctcaatatggtaatgtaacaaatggaatgcttaattacacctattggacaaacggtgcgcctgccagtggatatactaatataggtggacagaattaccagaatatacagggaataacaggatattcaatgagcttaaatttgaattctcctgatgctaacaatacatcgttggatgcatataaaaattgggcagattggggatctacagctatgggtggaggatttgaatatgttgctaagcaaagaacaactctttataatagtggatattggattgataatcttgggcagatgagaagcgttgcctatgccggaagagcagctgattctcaaattggattaagaagcaactacgtaagaaatactgcaatgttcgggaaatatgccaagagagcgggatatgtaggttatgctattagtgctggacaaataagttatggagtttataaagatggtggaaagtttggtgttaggactcaagtagcaacagcaaatgtagtaggaggtatggcaggagcatggcttggtacaaaagcaggagcattagctggcggagaaataggagctttagtaggagtttggtttgaaggcgttggggcaatacctggaggtgcaatcggaggtgcaattggtggtattgtaggaggaatattaggaggtgtgtatggtggagattatgctgaagactgggcttcaggtatactaaataagcccaatcatataaaatag

SEQ ID NO: 518 - DNA, 252 bp, Chryseobacterium sp.
atgaaaatagtaaaaacagcagccagaaatacgagattgaagagattgagaactgagttttcaaagttagaaattgatttttcgtttctcgtaaatttggaaataagtagaccagatattgatctacagggattaaatatagaactaccggaaatcagtatagactttcctgtagtagaattaccaaatatgaatatagatttagtggattcattggaagttttacattttgatcttaaagtcaattattga

SEQ ID NO: 519 - DNA, 894 bp, Chryseobacterium sp.
atgatcacccgctccatctatgtcggtaatcctgcttatctcaaactcaaagacgaacaaatgtatattctttgtcctaaaaccaaagaaatgaaaggcaaagttccggtggaagatttgggtttgctgatgttagatcattttcagattaccatttcccatcaactcattcagagaatgatggggaacaatgtagtcgtgatcagttgcgacagtcatcatttaccacacggtattatgttgccactttacggacattctgaacattccgcccgagtaaaagaccagttagaagccagcgaacctctcaaaaaacaactctggaaacaaactatcgaatgcaaaattgagaaccagagagaagttttaataagattggggaactattatgaaccgatgattgattatcaaaacaatgtcaagagtggggatattaccaatatggaaggtattgcagcacaacattactggaaatatcttattagtctggattttttaaggcagcgttttggagattcacccaatcagttttttaattttggttatgcggtgctcagaagcattgtagccagagcaattgtagaaacaggattacttcctgttttaggaatttttcataaaaacaaatataatccttactgtcttgctgatgatctgatggaaccttatcgcccgtttatggatgtacttgttatagattggttaacaaaaaattcaaattctgatgagttaacaaaagagtttaaagctcacatattgcagattgcaacaaaagatgtaaagattgataataaaactagaccattattggtagccgtaaaaacaacagttacttcactttataaatgctatacaggagaaaagcgtctgatctcttatcctgaactgatatga

SEQ ID NO: 520 - DNA, 513 bp, Chryseobacterium sp.
atgaaccgaaatttgtttttttgcttaataattttaattttcttttcgtgtaaagagaatagtaatcctcctgttaaaaccaaaaacgaatcaaaaactacaactgaaaagaaagatcatataacaactgaaatttctacagatattaatcagcttcaaaaactgattgacttgtcaaaattcaaacctgagaaagtgaaattcaaatatatatttattgacaattcaaaaggaagagtccctggtccctcagactcttatttggaagccattttatatttcgacgataaaacaatggaaaaaatatggcaaattaatcaaaatgcagatctgctaaatctacattatcaaaaacaagatttcaagtttgattggcttgatgaacaaaacctctctgaacttgagaaatctgacagtttaaaaagtatacatccggatttaatttttggaaccaataatggagagtgctggtatttgaaaaataaaattttattcaaaaaagaaacaaactaa

SEQ ID NO: 521 - DNA, 453 bp, Chryseobacterium sp.
atgaaaagaatattagcaataaaaggaattttaattctcagtatattttggatgtgtgcctgttcaaaaacaaaacaatcaggaaaagaatatatttcttcaaaagaaaatctacaaagcaaagatttgaaaaaattcatcggtaaaagcattaccgttacaggccaaaccataaatatgaaacttggtgcagtagtaattacagaaaacggagaaagtatctggatggaaggaatggacagctggcccgatggatattatatagatgattcaaaaaataaaacaataaaagtaacaggagttttaacagaaaaaaatgatttacctttttttatttccaatgaaaatgattcaataattcaacaaggaatacctcaaccggagggaactgaccttaaaaaggcaagtcacaggtatttaataaaagattataaatacagtgtcattaaataa

SEQ ID NO: 522 - DNA, 1569 bp, Chryseobacterium sp.
atgtttaataaaatttttaagcactctcttcaattaaactacaacgatttttttataatattattatttctcttatttgcagtttatagtattttttttggaattgagatgatggattctggattcatcatctcgttatctaaaaaaatagaatgtgggtttgagatttatcgggattttgattatgtaagacccccaattagcatatatttttggaatttattattaaagccattttggtgttttaatgattacgtttttttaataagcagagttcttgtttttatacaattcgtaattatttcttataatattttgagcattttaaaattagatgcccaatctagttggatttatctaactattatcactgtcttgtctattaatatctttccattaatgccttggcacactacggacgggctatttttcttaagtttttcaattaaatatttatatttcagaaagtttattttatcacttttctttgcattattggcttctggcattaaacaatcctttctcatccctttccttatactgctagtttattgtgttgttcaatacaaaaaattaaactttagagaaaactactggtatgtattagtcattgctatattttttatatttatcaatatttatttcaacgcactagactctctatattattacaaatcatcatcttctgcacagatgtcagatttttttaaaacaggatttcagcacttttggaatgtattttttataaaaagaaatttattgttcctaattgtcagtgggggcattgttgtatttttaaagaaaaagaacgttcgtaattttattagaatttatctatgtattcttcttatttattgtttttgtcttccacctatttttaatttatattatcaattggtaaatagtaatcaacatcaatattttaattttgatttatttgataatattttttttatatcaatcatttactgcattgtacaactaagatttaattttttcactgtttttctaatgatttgcgtatggagtctatccatttcttggggatataattcgattatcctaggtctgtcattactgacaatagtatatgaaaatgagatgaaataccttttttctaataaaattacaatctctattattatttttataatattgtcagtaagacttaccaatacatatggtgaggaaaatacattcatttctgaaagattaaaccggattaagaatacacccattatttcaggaatctttactactgttgacaaaaataattatataaacgaatctaaaaggattgttgaattttataaaaacagtatctttgtcaattgtttggtcttcggatctgcaatgtatgacgagttccctaatagagcggtttgggaatatgatgttgaatcaccaaatttagataaagatattgctttattacaaagaaatgatgttgtttatataattgataaaactagaaaacacaactctttccataaaagtactttttcggaagaaatcttgtccaaaaaaaaattaataaaaaccactcgttattttgagatatataaataa

SEQ ID NO: 523 - DNA, 1662 bp, Chryseobacterium sp.
atggcaattgtaaacgtgggaaatttaactcctcaaaattttggagcagtaggagatggaatagtggatgacactgcagcaatacagttagcaattaattatgtagatgctaacaataatgaagcaagattagtgaattttggagattcttcaaaagtataccgaataagtacaagtttacgtatcaaaagccatcagagattgatagcgagcggagctacaattgtgcaagaaggaatgtcggaggtcggttacccaatttttgattgttcttcttgtgtaaatatttacatttcaggttttaaatttacaactgaagacgagaattattttaatagtccatcttcattacatgtagggatttcatgtgcaaactctacaaatattacagttaaagaaaatgtatttgtaggttttacatattcagcattatcaggagtgggtggtatagcaaataattttttatttgagaataatacagtaattggtccaggtattaatattttaaattcaatagataaaagaaacaattctggaattacaataggaggcggtaaaaacatattaattgcgaataatacaatttcagatacaagtcaaggaatttatattatagaaaatagcgatgatgttaggatactaaacaataaaatttcggatatagtagtagaacatggtatgtatattgatactggagtttccaatataataatcgataataatattatacataatattgccaatacaggaataaaaattcaaaattcaaataatgatggacaatcttcatatatatctgaaaatattatagtatcaaataatattattaaagaaacagggaaaagtacattcgtagatccgcatacatttctaggtgaagggatattgattgataatactagtgcagttgttacattatttgccaataatgtgagtattataaataatagtatttcaaatattggtagaaatggtgtcaatatgagattttcaaataatagtattgtttcaaataataatatttttaatacaaaagaatgtggaatttatagtgattcaaataattttatgcaagtttcaaataacttgattaataaaacttcatttaacggaatttcagtcggaataaatggatgtgaaatttttattattgataatatgattaagcattcaggcttaaaaaattcattagatgaaaatcaattgaatgcagcaattttaattagtggaggggaagaaagagtaattaaagataatacggtgattggaaattttccaaattctgcaaaccctaatcttactggatacacaacttatggcattttaattgaatcaggggaccagtcaaccatggagatagtaggaaatagtatcaaaaaagtaaaatatattggaattagattagaagcattgcctagcgagccattaagatactttatgaataatatttctcctaatggagtacaatatatacctgaaggattaaaaaggggattaatagatgtttattttggttcgggaattccaacaactggttatcatatgcagggaactattatttttaatgatagttcaatactcttggcatctgggaaaatggggtggatgtgtatagaaggtggtatacctggaatatggaaagaattacctgatttattatag

SEQ ID NO: 524 - DNA, 1293 bp, Chryseobacterium sp.
atgataaataaaacaattttattgatctcttatgacttccccccaattggcggtggaggcgtacagagaaatgtgaaatatatgaaatatttgtccagactgggttgggatacaaatgttttgactattaaggagagagattattatgtttacgattattcattgttgggtgaaataaaagaaacgaagattcataaggcagattcattagatccaattagtataacatataagattaaaaaattatttagaaaaaaaaatacccaaaatgataaagatgctcccagcgttgatgaaagtgcttggtatgtatcaatatataggtttgtaagagattggtttatgtttcctgatggattcggtggatggattccactagcttacaaaaaaggaaaagaagtgataaagcaaaataaacctgatatattatttgccacatttccccatccaacaaatgcaatgttaacttattttcttcataagaactctaaaattccttatgtcattgattttagagatgcatggcttgatgatccatatgttatattcccatcttttatccatagaaagcttcatgggtattgggagaaaaaaattctatttaaggcgtccaaagtaatagtatatggaacgccattgaaagagattctagaaaagaaatatccagtcttacaaggtaacattgaagtaataacaaatggatttgatccggaggactttgagcatgtaaatccagtaccgaagaacactaaaataagaatagtctattctggggctgtatatgtagatagaagagaaacatatattaattttattgaggcattttcgcaattgccatatgaactgaaagataaatttgaaattatttttgttggagataagttaaagtgggcatcaagccttattgaagaaaagcaacttgaaaattttatatcttttacaggttatttacaacatgcagaagctctaaattatttagcaagtgcagatgtggcactcatgtttttgaaggctggtgataaagtagcattaacagggaaaatattcgaatatttaggtcttggactacctgtgtttgcttgtgtagaagaaactggagcttgtgccgatatgttaaaaagcattaatcatgaccaatatgttgtttctccatcagatataaacaaaattaaggaaattttcattaagctttcggaaagaaaatttaaaatgattgaatatcataatgttgaaaaatattctcgtaaatatcatgcaaactgtttagataatatacttcggtctatcgtttaa

SEQ ID NO: 525 - DNA, 648 bp, Chryseobacterium sp.
atgaaaaaaattttattaacagcgacaatgctcgttggcctttcgatggtttccaaggcccagacaacgggtcgtgtaggtattaacacaactacaccagctgcaacattagacgtagtagccaatactactgacagtgctagacctgacgcgcttttagtccctcgcttgacaagaactgagttagctaataaaaatgcggcttacacaacagctcaaaacggtgctcttacatttgttactactttagatggtactgcagcaggtaaaactgtaaatgtaacagcaactggtttttattactatgatgcaccaaattctgtttgggttgctgtaggaggaggtggtgctgccccaacacagagatatgaagtgattagaggaacagtaactacagttagtgcaggggcatatactgttgctgcaaacgattatctgatagtaactactgttgctgcaggaggggctgttcttactttcccaccattgacagctgctgatgcaggtcgtacagtacttgtatttaacaataacccttcacttgctgctaatactattactggtcctataggacagcttggtaataaccagcttagaggtagaacattagtttggactggaaccaattgggtaagtattggattgtaa

SEQ ID NO: 526 - DNA, 126 bp, Chryseobacterium sp.
atgaaaaagttccttttaattatcctcacccctcgctgcctactaggagtcgaaatcaatgatgagactagtatacgaaaagcatacaaagatcccgaaaatactatgatcactacttattcataa

SEQ ID NO: 527 - DNA, 2763 bp, Chryseobacterium sp.
atgaaaaacaaattgacacttatggtttttgttccgcttttggtaagcggaattgccttacaggctcaaagatatgttgagcaaagaattgatgatggcaattcatcaatgattacattcaaacctggaaccaatgcaagggaccttgcattgtctgacaacggaaaattcttttccgagattttaaaccttcctgcaggatctaaaatggttaagattaaatccgcaaaactcttcagtgatttttccgatgaaaaatatcagctttatcacaatgggattagggttgaatttgccaattatatgctgcactatgtaaaaggcaatctggtaagcatgaatggagaatcctatgataccagcgatgtcaacacccaggcagatgtttcagaatctgatgctcttaacagagccattaaacatttaggtgcccaggttttaatgtctaatacagcgtatggacgagagatcgggtatcagcctaaaggcgaacttgtattgttgcctgtggaggcttccaatgaaaaatacagacttttattagcctacaagtttgatattttttctgcagaaccttttttaagatctcacgtatatatagatgcaaaatcaggtgccatattgcttgatgacccaatcatgaagcatgtgggagaaaatgctcacggtaaagaactgaaaaatgtaaatgtttttggaccggaaaataaatcgggagagaattttaaagcaatgtttgtcaccggaaatgctgaaacaagatacagtgggacaaaatctatcgaaaccactcttgttaatgggaaatatgcattaaaagacaatacaagaggaggaggagtaaatacctacaacaacaataacgcgaattataccagtcttgtaaaaaataatattactgatacagataacaactggacaacggcagaacattcttcgaccgggaatgatgtagcgttggatgttcattggggagtagagaaaacatacgactatttcaaagatacatttggcagaaatagttatgacaatcagggagctgtactcgataattatgttcatgtaggaaattcgtgggaaaatgcagcctggactggaagcgcaatggtgtatggtgatggggctaccaattttaaaccgcttgctgcatttgatgttaccgcccatgaattaggacatgctgtatgtcaggaagaagccgctttagtgtatcaaagggaacctggagcattgaatgaaggattttctgatatttggggagcaattgttgaaaatgcatatgcaccggaaaagcaaaactttttgattggagaagatattaccaaaatatctcctaactatttaagatccatgagcaatccaaattcaggattatccagacaaccggatacttataagggaacctattggaaagatgcaaccactacaggatgtgtaacccctagtcaacagcaaaatgattattgtggtgttcataccaatagcggagtcttaaacttctggttttatttgttggtaaccggaggtacaggaacaaatgatataggaaacaattataacgttaccggagtaggatttgaaaaagctgcaaaaatcgtttacagattagagacttcttacctaacaggaagctctacctatactaatgcgatgacgtacggaattcaatccgcaaaagatctttttggtgctgattcagcggaacataaggctactcagaacgcattttatgcggtaggtttaggaacggcatatactggtggaacaccaataacagatactcaggcacctactgcgcctcagctgtctgcatcttctactacacaaaactccacaacattatcgtggagtggatctacggataatgttgcagtaacagggtatgatgtttatagaggaacgattcttcttggatctacttctgccacaacgtattcagtaacagggctgtctccttccacttcgtacagtttcactgtaaaagcaaaagatgcagcagggaatatttctgcagcaagtaatacggtaaatgtaacgactctatctggtggaactactataacttattgttcgtcttctgccaattctacatcagacgagcgtatcagtaatgtgaagtttgcggatattaatcagtcttctacaggcacagcaggatatgagaattttacttctgttgttggaaatgttgtaaaaggaaattcttattctatttcaataacgccgtattggtcatctataacatatagtgaaggatatgctgtctatattgattataatggtgatggagactttacagatattggagaattggcctggtcaaaaacggcgagcacaacttctcccgtgtccggcaatataaccattccaagtactgctattacaggaaatacaagaatgagagtgatcatgaaatacaatgcagtaccttcgtcttcatgtggaacattcagctacggacaggttgaagattatacattaaaaataacttctgcaggtactgtttcttcattgattgctgaatcttcaacggataatgcagccattagcatttatccgaatccggtaaaagaagtgattaagattaaatccgaatccggttcagagttcaggtatcagcttgttgatacccgtggaagtgttgttcagtccggagaaacaaaatcacagtctatcaatgttgaatcattgctttcgggagtatatatcctttcattggataacgggaaagaaaaagttacccagaaaattattaaaaattaa

SEQ ID NO: 528 - DNA, 852 bp, Chryseobacterium sp.
atgaaaaatctacttctttttacctgcatcttttgggggtatcaagcatattcccaagttggcatcaatacccagacgccactggctacactggatgtcacaggaaaaccggcaaccacctcggttattgacggtgtaatagcacccaggctctccggagaccagctaattagtaaagatccggtgtatactaccgcacaaacgggatctattatttatatcaccgctgtgcctactattgcccttacttctaaaacggcaaacgtaagtaaaactggttattattattttaacggcacccagtggatgacatttgaaaatactattattggggacatcaagtccagttttttgacggcagatcacagtggatggatcagactggacggaagatccgttgcttccctcacagcatcacagcaatccaaagcctcttcgcttggcttcagtacgaatctgcccaatgccacgaattcttatctggttcaaaacagcaatcctttaggaagcatcatcagcagcaatacaagaactatttcacaaaaccagttgcccaatattcagcttggaggaactaccaatagtgtgagccctgatattcattatgacattagaaacggagccagcccaaatcaggcccaaatagctaacggcccttcaacatcgtttttagcagcactaaatagttcaggtaccttacaagataataatgtgagccctacagaactatggcaagatacccataatcatactattaccaccaacagtatcaatggtggcgtaactcaacagcctgttgatattcgtccccaaagcatgagtgtcaatatgtttgtgtttttaggtcagtaa

SEQ ID NO: 529 - DNA, 1470 bp, Chryseobacterium sp.
atgatgaaaaaaaacttattgggattactatgccttttaacaggcatagcaacacatgcacagactccctttggatgtacaaatacgatgtacagttccatggttaattcttctacttccacaactgttctccgaagtataagtacaacgagcaatccttttacttttaatgatgtcggcccggcatcttcttttacttataatgctttaggatataatactgtagacaactatatgtatgccataagaaccagtaattatcacctctaccgtattgatgcgaatgggacatacactgatctggggctggtttcaggtttacccgcctcaggattttataattcgggtgattttgacagtgccgggaatttttatgtcaaaaccgggctcagtagcattatgtataaaattaatataaccactcttaccgccacctccatttctctttcaaaaacgatcaataccgctgattttgcctacaatcctgttaacggactcctatatgccgcagattatggcaacagtaacagattgattagtattgatcccgctacaggaattgtaacgacaataggaaccgctacaacttcaggattatcttttggagccatgtatattgatgttagcgggaatgtttatggaattcaaaataatgacggggcaagcaatcccgggggtttttacaaatttgatattattaccggggaacgaacactgatttcctctgtacccgtaagcaatgccaatgacggagccagttgccccaatgcggtccttaccttcggatcagacctctatgttaccaaaacggataacgttgccacctacactcccggcagcactgttacctatacaattgtagtgggcaatacagggcccttcggtgcgcagaatgcccccgttaccgatgctgtacctgccggcatccctgccgctaatgtaacctatacagctgttgcttccgcgggttctgccaccaatgtcgtaggcactcagacaggagcgatcaatgatctggtaaatttgcccgtagggggcacagttacttataccgtaaccgttgctatccctttaaatttcacagggaatttaaccaatacagctgctattggtgtcccttctggtactgcagataacactatggctaataattcggccacagatattgacagtggcatcgtctgctacaaaccagccgctacctcgggaacctcattacctaccaactatggtattacctcactgggaagagcaggaaccaccaacggaaactggccgatggtaagaaacggagcatggacagcgttggaagccaaaacaaaaggttttgtaataaacaggctgaccactctgcaaaaaaatgcacttagtccggtagagggaatgatggtctatgatacaaaccttgattgtctgagcatttatgacggaacaggatggaaatgcttcaatacacaaacctgcccgtaa

SEQ ID NO: 530 - DNA, 1437 bp, Chryseobacterium sp.
atgaataaaattaaactactcttattttacactttcctgatctttagttttagtgtaaataatttacaggcacaagatactgacggagacggaattgccaattccaccgatcttgatgatgataatgacgggattttagatacggtagaatgcccttctatcaccaatcatccggtatatcatttgtatgatgatgattatctttcatctactaactttttagacctttataagcagttggatgggattggttctacatttgtctgtcctgtaattaactgcagtgttaatccatatggttcattgtataaaagtacaaatattaccggaagtgtaaccaatcttgcgtatgatgacagtaagtattataccgtaaatgccgctgggaatcttttgtataccaccgatattatcgccggaaattttaccaatttagggagtgccaatatagggactggtttcctaaatttagcctatgataacgggatgttttaccattggaaaagagtgggcactacgaacacttttacactatacagttcgccggatccgactagtgtttcctggacattgatgggaacagtaaatggaagagtatattcgtttacaagtggtggttatacctacgatctaaaagatatggctgtagatgatggcgtattctatttcatgtattacagctcggacgctccttatgatgacaatgatcttagaactatagtgtattcttcaagtaatcctatagcgttaacacctacatggcaaaatttaggaaccacttattttggagctgaagtttacaatattgcgattggctctgaagatttaaaagtaacctgtgataccgatggagatggtctacccaacactttggatctagacagtgataacgatggctgtcctgacgccatagaaggcggtgccaatattacaaactcccagttggtaacagcgggagggacacttcagggcggaaacggaataaatcccgtggtaactcctacttccggaacatacaatcaggctgttttacttaatctttgtaacggaactacttgtgtgggagccaatggagttcctatcgctgcaggtagtggtcaaagtataggcagttcacaagacgcatctgtatcttgtcagcttttctgttacaaaacggcaacgactaccgggacttcattgcctgctaaacagggaatcacagctttgggaagagccggagctaataacgggaactggccgatggtaagaaacggggcgtggacggttttggaagctaaaacaaaaggatttgtagtgaacaggctgaccactgtgcaaaaaaatgcactgagtcccgtagaaggaatgatggtctacgatacaaaccttgattgcctaagcatttatgacggaacaggatggaaatgttttaatacacaaacctgtcctcaatag

SEQ ID NO: 531 - DNA, 324 bp, Chryseobacterium sp.
atgatgaaaaaaactttattaggattattatgcctgttgacagccatagtaataaatgcccggactcctttcggatgtacaaatactctgtatagttctatggtgaatccttcaccttcatcaagtatgaaaactgtcggaattgatgcaccttctgtcttattgtttgcacgagacatccttaaggcaaatataaagaatatcggagatactacgaatatccctcatgctttgcaaatcctgggttttcaaggcagacgttacaagccacttcaacccttcaaaaaaacagcaattttatttacagtagtaagggtgaactaa

SEQ ID NO: 532 - DNA, 513 bp, Chryseobacterium sp.
atgagaaaagttataaaaactataagaaaaattagagttttaattgttggattgtttttcttcatcctctcttgtgcaaagaacaaggatcaggaggttttattaaagaatgatattaattctaaaaatactatactttttacctataattctaatgggattgaatgggtcttgacgacttatgaaaatggaaaaaattatacatcaaaaaattatatgataaaaaaaaaagatggatattatgaagatgttgatttagttactaatgatagtattagagattataaaaaagtattagttcgatataatgataattacacttatgatatctctatgcctatgccctcttttgatggcaaagttgaagtgtctataaaacagataaatccgaataaatatttatatacttctaattccggagggacaggtattcgttttttctttgatgaaaattataaaatttataaagtcataagagttttaagtccaaaagatagtttgatttatgaatga

SEQ ID NO: 533 - DNA, 372 bp, Chryseobacterium sp.
atgtttgtttgtttgtttgttaatgttttattaggaattagcgttttattctgctataaaagtgtgagcagagaaaaaaaaaatattgaaaatcaaagaccaataaaagtttatattgtagagattatttaccgagcaaaatcaagcaacgtttgtactgtgaaatataaaaataaaatctacaaaaatatagctttccttaccaataaaattaaagaaaatgaaatcaatgatacatctttttattatgatgaaacaaaagattatattttttgcaaaggaaataatataatacctttttggtctttattggtaatgctaattctttctttatttctatggttaatacctaagagaaaatttatttggtag

SEQ ID NO: 534 - DNA, 141 bp, Chryseobacterium sp.
atgattaaacctgagaattacttctttaaggaaataacattagaaattaacaaaaatcttacttttgaagaattaaaaaatcatctccacaatagcaggctgattgaaatattttttattctctcaaataaaagctattag

SEQ ID NO: 535 - DNA, 4728 bp, Chryseobacterium sp.
atgaagaatatttattctcttttaatgctttccatatatatatttatgggctgcaataacgtatatgctgttcataaagattcacttcagcataatataacgggtaagaacagtttccccattccggaactgtattccgatcattttataagtaattcggataacgatcctgaaactgatgctgagatagggaaggctatgggtgcatttaacgaaattgaaagcagcggaaacttcaccagtcttatcaatcccaacgagcttacagagcttccgataggattaagggaaaatatatccaatgtagaatatggcattgttatcaccaaagccaaattcacccctgaatatgccttaattaatgtatatgcccgtgtagtgactccacagcaaggagcagaaggcgggaaaaaaactctattttttggggcagaagatgttaagctttcgtatggaggaaagattattggagacgccaaattgtcgctgcttggtgatatcaatatgcctttcaaccagaatcaatggatgcttacccttgaaggaggcagaattaataagcttaatggaggaagcgtcaatgacaatacctatgtcattattgactgtgacggcataaaagaactgtcattgaaggggaatgtacaaatatcaagaaatgttttggttcctttagatcataatggaagtgttttacctgagctaggaagtaacggccaaaccaacagggttcgtggagattttgcttttaaagctactgactggaatgatattttggtcaaagtaagtatttcaccatttgccatcacttcccaaattaaaaaccaggacaaaggatatttttcattctttgtaaataatgccgttttggatttgagtgatttacggactgatccgaccgtgatgttccctcaatattacaatactcatggatatcttattggcggagcggaatcctggagaggattatatgttcaaactttaagcatcggattacctcaggagtttaaaacggaagaccacatcgatagcagagtttcttttgaagcgaataatctcctgattgattcctatggagtatcaggaaattttgcagccaataatgtatttccaattgacagaggagtaaccaataaagataatgcttggaggtattcacttgacaagatagggattgatttagctgcttctaaaattgttggagctaatttagaagggaccattcagcttcctattcaaaaaaatgatgacaatcaaaatactgatattccaaaatatttaggatatcgtggaatgataaccgaagaggagtatttaatttctgttaccacttttgataaaattaaatttgatatttggagtgccaaggcattgattgatacaggatcaaccattgagatgcgggtaaaaaaccgcgaatttttacccaaagctattcttaacggcagtctggatattggagccaatgcaaaatatgcagaaagcagtgaccctaatgaaaagaaagatgctgattttaaaggggtaaagtttcaggggctgacaatacaaacaaaagcaccttacataactgcacaatattttggtgttgagggtgagcagaaattagccaatttccctgcaagtatcaatgatattgtggttattgcagatggctctcaggttagtttaggttttaaagttactgtaggattgcaggaaaatcgtttctcggctacaggaggaatgatgattagaggccttatcgctaatgaaaacaatcgtcaaaggtggaaatatgatggctttgaccttactaaattagcccttaataatgttgatatagtagtagctaacgtatcgggaagccttgagattatgcgcaaggaccctctgtacggaaatggtttccaagcccatcttaaagcagaaattaaatcattaagtaaaataacggtggaagtaaatgctgccttcggatacagtactttcagatattggggttttgaaggatcagtaaagggtctcagcattcaggcttctgcccttagaattacaggatttacaggtggagcattttaccggatgattccggacagggaattgagcattaatcctgcgaatgaaaataaagctttggttttaaaacctgataataccgttggtctgaccttacgagccggaatttatggttcggtccctaaggaaaatacaatcgatattatggcgggcttcagtatttctaccaatcccaatggcggtttagctaatataggatttttaggagaggctgttgttatggctaatttatctaaactggtgccgggagatcctttggcaggcgttaaagacaagtttaaagaaatgacaggaaaacctggatttctgaatgatattaaaaagagtggtgttggaaagacctttttagatacaaaaatggtcgacgaacaatatccggtcactgaaaaagtcgacggttccatatatgccaaattagctatgaattacgatttcaataatagcgtttttcatgcaagtctggatgtttttgtgaatatagctaacggaattatcaaaggtatcggtccaaatggaagagcaggctgggcagtcgttcacattgctcctgatgaatggtacatgcatatcggtacgccaactgatatgattggattgaaagttggtctgggaagtttttatcttcaatccggaagttattttatggtaggaaaccgtattccgggaagtccgccgccgccaccggaagttgctgagattttagggcttcagctcaatgaccttgattatatgagcagtcttaatgctttaggagatggaaaaggctttgcctttggaacccacctgaaatttgataccggagatatgaccgctttattcctttacgcccgtttccaggcaggtttaggaactgatattatgctgaagaattatggtgaagccaaatgttcaaaccgtggcggagagcagatcgggatcaacggatggtatgccaacggacaggcttatgtgtatttacagggtgagcttggaattaagataaagctttggttcattaaaaagaaaattccaattattaaagctggtgttgcttctttattacaggcaaaaggacctaacccttactggattagaggataccttggaggatattataacctgctcggaggtatgattaaaggtagattcagattcaaaatggaatttggagaagaatgtgtactggaaaattcttctgtccttggaggtatgaagatcatttctgaccttactcctaagaaagatgaaactgatgtagacgtatttgctattccgcaggcaacttttgctgtgcgggtgaatgaacctattgtcattcctgaagacgatggcgatcatacgtacaaagtggtggttgaaaaaatgaccatcatcgatgatcagggcaaagaaattaagggtattgtagaatatgctaattctaaagatatcgccaactttgtttctgaagatattcttcccccaaataaaacattaaaagcaattgctcaggtaagctttatggagaaaaagaacgggatgtatgaagtggtaatggttgatggtcaaaaagccattgagatcgaagaaagaatctttacaacaggatcggctccgaatgttattcctttaagcaatatcaaatatgcatatccggttcctgaacaggaaaattattacacaggagaagccaataccggttatataaagcttaagcgtggacaggattatttatttgatgatcctaactggaacaccgtaaccgcttttgctgctaaatcaccaactgaaagtaatttctcttataatgtcaatgataatacggtcaacttcaataccccaaatcttgggaagcagaaggattacacatttgcgttaattgccaaaaataaaaacggcaacagttcagatagcggaaatacaaatactggacaatccggcaatgtgctaaattcaaccggaggagtagataattctacttcaaatcctgatgtaaatacaaacggagatagctcagttaccactacaacggaaaccaagactgctcaaagcctttccaaagacggagagatcgaaagactggcttatactttcagaacaagtaaatacaatacatttgagaacaagctgtcttcattgaactttaatccgttgtggatcaagctaagttctgatgtggttacccttcagaacaatatgaatgctgatgaatattttgatgccactgaaatttcaggttcaaaatatacagacaatatgcctcttattgatctcacggcactaatggatgattcttttgccaataaatttaaaggattgatttacaacagttatccgtttgatgagcttacgttaaacagagctgaaagtgaagacgattttgcaggaattccaccaacaaaagcattccctgtctttacttcttatatgcagtatttaggaagcgataaaggaaacgggttcttaaaacaaacgttcccgttcaaatatgatttattcagttattataagtccgactggtatgagctgatctcgaaagctgcatctaaatatgtaggctctcctgctaatgcaaggccacagataattaatgctttgctggaatcaacctatggaattatccctgaaaccagatacaatgtgaaagctaaatatactcttccggggaataagcagggaacagaaaaacaaataaactatgaatttaaataa

SEQ ID NO: 536 - DNA, 945 bp, Chryseobacterium sp.
ttgaaaattaatggttgtaaaaaaataaacatttttgcaggtaaacctaatgctggaaagagtaatattttggaagctttgggaggatatcaatttttaaaaaatcaaagtcatagaagagcagtcgatttaaaaactttaaatgaatttattagatttgaaacgctacaagatatattctatgagggtaatataaatgaaaaaatttctataggaattaatcaaattgatttaaattttgattacaatgacttttcagaaactgatctccacgaaataagtataaattctcaaattgaaaaaaaaggagaagaacttattaatcatattaaagaatccgaacatataaaatactataagtttaagctatcagatagcaataaaaataattatttaaaatatttaaattatccattcggagaaaatataggaaatataattgctcaatatagtgaaataagaagttttgttaataactttttagcatttaataaacttaaattattgatagagaaaaacaccaacgagctcaaaatcttcaaagaatatgaagatggtactgttttcacattaccatataatatgattgcagacacacttcagcgactaatattttataaagcagcaattatgagcaatcaagattctgttttattatttgaagaaccggaagcacattgttttgaaccctatattttagaatttacaaatgaggttaaatttaatgagaacaacaatcagttcttcatggtaactcacagtgattttattatacaggaatttttaagagatgaagaaagtaaagataatttacagatttacttagttaataatgttaatggcaaaacggaagtaaaaaaattacaacgagaaaataatgatgatgtatatgagtatggaatgaatgtatttttcaacttcgacagtctttgggaaaataattaa

SEQ ID NO: 537 - DNA, 543 bp, Chryseobacterium sp.
atggaaagggtcgttgctgttgaatgttttgcagataaatatttttttggaaagttattacaaaatgaaaaacgtatccgaaaagaaaaaaataaaaatgaggttattaaagcttttgagagagtaagaggagaatttttaattggcattgtagatgaagacagaaaagatttattacttaatcctaatttaaaaaacttcgagaaaattaaagaaggaaacagtttcaaaatttataaggagaaaacaaaatatcagtttatttttgcactttgtcctaaagcttttgaagattggatttgccagtttttaaaaagccaaaacaaagatttaaatgaatttgattattttgattttgaatcattcaaaaaagaaactaaaagtgaacaaatagataaggaaagtaagtataaaaatttggttaaacatattatccaaacctatccaaattttgataatcatgtaaaagaattcaaaattcatattgattatcttcttacagaaacttataattttaatttagagagatttaaaaatttatag

SEQ ID NO: 538 - DNA, 138 bp, Chryseobacterium sp.
atgaaatttatgtttccaataatcagattaaaaattggaacatcagaatttcatcctaatcttttccacaagactgcagatttttttaaaagaaaagaagtaacagatgatgcttatccatacccggattttgtttaa

SEQ ID NO: 539 - DNA, 1155 bp, Chryseobacterium sp.
atgaaaaagtatttattctcagcagctttatcaattctttttggtatcacagtatttgcccaggtaggcattaatactagtatcccaaatgcaaagtctgtattggatattctgtctaaaagcaacaatacaggagtgctgtttcccagattaacaacagcacaaagagatgcaatatctccaggtacggatccttcagtggatggattgtggatttataataccgataataaatgctatgaattctggaatttgaccaaatgggtatctttatgtgaggacagtacagatgtccctccgctttccggagttaaattattatcttatgagcaggatgccacatttacctttgctacaccggtatttacagattttttcaactcttttgacaattttggaccttttccctcatctaccattcagaccgatggctcctcattggttccggaaaagagaccgtatacggattttgcaagccttaactttcaggattataatatcataggagtgtcatatcgccccggtgttgacctgagtgcagccgaaataacagctctggtaacttttgccaatactccggggaagcatctttactttttcacggaaggatttacacaggcaggaaaactatcactgcttacccagctgataggtgacattacgctaacagcttccgatatcgttgccagtttgggttcaaatggagactccaatgcagcaggaccatgctattatataaccactgatcctcttaatagttcttttgtaaccggatcttttggaacattacaggccggattgcacagatttgtagatcatggtagtacatctaattcattttcatatgctaaattaagtaccagtgccaatgtacagataatcgctgcggatggtttagtgggaggattacctcagccaacttcaaaagttggtgctttcaaaataaaaaataaaaacgtttttgtatttgcagacggagcgcccttctttggaggaaccactaatagcggtcctgcctgtatgacagcttcttcagtaggaggaacaaggggaagaaaacctctgaaatgtgatcctgtttcctccaatgggaataactcaggggtaggtatattcatggctaatgttattgcgtggtctttaaaaaatttatag

SEQ ID NO: 540 - DNA, 228 bp, Chryseobacterium sp.
atgaaaaaaataaataaacttgtattagttctgttcctttttgtagtgtcattagcttatgctgatgttccagatcttccagccccaactactgctaaagatggaataggaggtggaggtccgggagctgttgcttcaccaattgatatgtatgtttatgcattgtcagtaatcgcaatagtatttattgtattttttacaaagaaatacaaaattcaaaaaatataa

SEQ ID NO: 541 - DNA, 156 bp, Chryseobacterium sp.
atggtgagtcatattttggaactaaaaaaatattctcctttttatttcatttttgtgtgcttgaaagaaaataactctaatttttttgttcaggaagataactgtaaattcaaatattattttattaaacaattgtttaattttatgtatttttaa

SEQ ID NO: 542 - DNA, 387 bp, Chryseobacterium sp.
atggaatatttaattgacaatgtgaaaaatctttacatcgtactattactgacaatgctagtattagtgattttagatatgatttttgaaaaagaaaaaaatagaaaattagaaagggatcttaaaatctatgaattggaataccaaaaatcgaaaaaaaatttcagtgagtttaaagataatatgttgaagaatctaaaggactgtaaagatattatagagaagattaaagaaaaaaatatagaaaatattcgagatctagaagatttaaaaacggattttaaagatgcagctgaaaaagctgactattggaagaataaagttaagcggctacaaaaccagttaaattatcaaaaaagaaaatgcaagaacagcaacatcaaataa

SEQ ID NO: 543 - DNA, 255 bp, Chryseobacterium sp.
atgaaaaagtttattttgcctgttgtagttttcttaacaggcgcaggaggagcatttgcatccaccgtatctaaaacagcagattcaacaatggtccctggccacagatttgatccatctgcatcggaagtgaaatgtatcgaagtagcccagtgcagcaccatcgaaggtgcagaatgtacctggaactccgaagtactgaaagaaaagatcaatgacactgcatgcggagcgccattgtaccgacttaactaa

SEQ ID NO: 544 - DNA, 2583 bp, Chryseobacterium sp.
atgaaaacagcctatcgtttgctcatgatgcttataacgctgcttttgttgtacgggttcaggtggatgcctgtgccgctgcccttattcccagcgcaggagctcaaaataaaggatactaaccatcttcagaagctctcctcagaatcctatgaaatccagctgcttaaaatatcagcagacggaaattggttggctgtaaaaaagataatggattccgggcaaaatatgctgatgatcttaagaacaaatgcccccgaatccattgttcttaaaagtaccggtattactgaactacagtttcttattgataatagggcattgctgttggataaacaaggaaaggcagaatatctgagcttaggagtgcagaaaaagggaaaagtacatgagaaaaatagtgaaggtaatatttttgccaatggtaaagtttttaatcaaataaaaagaattgaagttcttaaaaacggcaaagaatttttgttatggtctgattcctcacaaaagaattccctcgcatggtatacagcagaaggaacccttttacgggtcttggaagatgttacgacttatctaatagataggaattctgaactttatgcggtgcagaaggaaacaaacggagataaaaaagacaaagagtacagcattttcaagttttctgattctgctaaacggttgttgtatcagactaacagactaattgagagtatttacactgcatctgatggagaaaatctgatcagccttgaaaaagaccttacgaccggatatatgaaaatggtatctataaaccttaacgactttaaaagctatcctttagacgaaagtcttttgttccatcatgttacggtaaaaagcattgggaaggaaaaattattttttcttcacgctatcaaaaacaagacagagacaaagaaatcgtcacccgagatttggtacggtaatgataaaaatcttgaagagaaatttttaccacaatttcaggaaacgtactatctctggaaacctgaatcgaggcagcttgaaaacctgaatgacagcagtggatttcaaaaaatcattcccctacataacgagcggtatttcctggcttttaatccccgggagcttaaagattatactcgaaaaacatctcctctgctgatttctgtatacgaccggataagcaatacttccgtaaaggtagataccgtgggtactgaattatacgtctctgcagagggagaatatcttctctaccccaaaaataaccaatggaaattatataggatttctgatggaaaaacaaaccttatctcaaaaaatggagtagagcagccttactttacccgtgatggtaaaggaattgtttttggtgggaatgatgctctctggtactatgatatcgagaaagaaagctttaaaaccttaaccggaactactaaaggatacatatatcgtattatggaaagtaaaagggaatcactcttatccaattacaatttttaccgttcggtgattgatgataaagctccgctgatcgtagaataccggaatgaaatgaataataggtttgggtatgagaaattatatgtgaataaaagctataccgccattcctcttaccaatggcagagcgagttcccttttgtataatcctccttgcagcacctttgcttatatacgggagaactacaatatgccccctcagattgttgttgctaaaaatggaaaaaatgatgtgatctatcaaagcaatacgcaagacactaagatttcaaaagcaaggatagacattattgactataccggaccggaaagtattcccctgaaggggctgttgtattacccaatagattataatccttcggtgatatatccgatggtggtgcatatttatgaggctcagcaccatctgagctcccgttactggcggcctacctataaaaacagcctgggctttaatgtaaggttactacaggaaaagggatattttgtctttttaccggatatcgcttatggttcggaaggcccgggaatctctgcgctgcaatccgtagaatctgctatgaaagcggtactgaagaacacctctattgatcccttaaaagttgggcttatagggcagtcatttggcgggtatcagaccaattttattgctacccgatcagatctgttcaaagcctatgtttccggagcagccaacgctgacattgtgcatgtttaccatacttttaatgaaaattaccatatgccggaattctggcggtatgaattcgggcagtacaggatgggaaaatccttttcacagaataaggagctttattttagaaacaacccgctatatcatgctgacagagttacttcacctatgcttttatggtgtgggatgcaggataagaatgtaaactgggaagaaacccggacgttttacaatgctctgaaaaggaataaaaagaatgtcatagcattattttatcctgatgacggacattctatgtggcaagaggcttctaagactgaccttacttacaagatattggactggtttgatttttatttgaaagatcataagaaggcaatatgggttaataataaataa

SEQ ID NO: 545 - DNA, 1461 bp, Chryseobacterium sp.
atgaaaaaatataatatcaatctccgtactatacctattgtccgatctgttatcaatattgagggtatagacaggctcctgatacctttttcggctataaaaatacctttcatcctttttttccttttgctcacagcagtttcgtgcgaaaagctagtagaagcagatgatccggataaccagatcgggactgagcaggtatttgaagacctgcaaagtgccaatgccgctttatcgggactatattcgggattattcacctcttcgcttatttccggtggaagtgatggaacaggagctcttttgggaacctatacagatgatctggactgctactatgtaaataataacagcggggcactggaactgtatcagaaccagcagatcccaaccaaccccatgatcgaaaaaacatggaatacagcatatcagcaaatttatgctgccaattctattataacaggagtgaacaattccttatcgctggcagtagaagataaaaacaggattaaaggggaagcccttctggtacgaagccttatttatttgtatttgcagcagatctatcaggaaatcccttatacggataccaccgactatcaggttaacagccatttgccaaagctttccagagaggcattattacaaaaattagaggaagatttgagccttgccatcagtctgctttcggatatctaccgcaatgcagagaggatttatcccaataaaaaggtagcagaactgttgctggccaaagtatatcttcttcagcagaaatgggcactggcagagcagttagccggaaatatcatccaaaatcctctttatcaattggaacaggatattacaaaagtttttaagaaaggaggaaagcatattctgtggcagctaaaaccgctcaactccggggattccactaaagaggcttctctttattacttctcaggggcagctcccaatgcttatgcgcttagcaccagcctgatcaatattttcagtggttctgacctgagaaaacaagcatggatgactcctgttaccgtttctcagaatacatggtatcgagctgctaaatacaaaaacctttcaggaaacactgaagagtattccattattttcaggcttgaagaagcatattttatcatggcagaggctttagcccggcaaaacagggtaacagaagcacttccatatctcaatgctatcaggcaaagagccggaatagcaccacttaccggaacctggtccaaagatgcttttcttcaggaattgctgctggaggtcagaagggagttctttgcagaaatgggacaaaggttcatggccttaaaacggtttgaccgccttggcgatttggctactacaaagcctaactggaaaagctaccatactgcctggcctctgcctcaaaaagagctgatgctgaatgctaaccttaacccacaaaaccagggatactga

SEQ ID NO: 546 - DNA, 720 bp, Chryseobacterium sp.
atgagtgaaattataggacttagaatcaagcagttaaggaaggaaaataaattaacgcaattggaattctcttccaaaattaatatagataatagtcaattaagtaaaattgagtctggaaaactattgccaacacttaaccaactaatggaaatatcttccatttttaataaatcgcttgattggttaactggaatatcagaaaatcaggaaatttcaattaaaaacttagatcaaaatattgaaccagaggtaataacttcatcagaaaaagagtctgattattctaaaattataaataagttaaaatttaaagatgaaataaatatatcagatcatggagcgcctttttataatttaccagttagtgctggtagggttgctgagttattagatatagaagaaaatcccagtggatttttaaacatacctggctttaattgtgatgcttatttccctattactggatgctcttttgaaccatacattcaagctggcgatatcattggtataaattttatagatcgttgggagaacttagatcctgactgtatttacttaataataacccatgatcagcgaatgatgaaaaggttaatgagtcatcctaccgacagcacactattaatatgcctatccccaaattataaagaatttactattgataaatttacaattaggtacatacataaggttacttttaaaggtaagcctgtttaa

SEQ ID NO: 547 - DNA, 153 bp, Chryseobacterium sp.
atgacagactttgaatttatcgccggagtatctacagtgttttttatttccggctttctgatcggcgttcttgtttccgcaataataggaacaaagtgtatcaaaacccaaacaaaaattaaaatttcaaaaaatggaaaacaaagtaattaa

SEQ ID NO: 548 - DNA, 282 bp, Chryseobacterium sp.
atggaaaacaaagtaattaacgctgagatctcagcagaagaattaaaagagtacttaaaaaacggacttgtttctgtaaaacgttcaggagccggaatcagtttaaaatttggtacagataaactagactcaaaaaatgatgctgatctggtttcttttggtaattatttattatcaccggaaaggaaaaaaagcatccagtttgacgagggaataagaggaattgcaaatcctaatgtcgtttacgatgcagatctggaaaactggaaattaaaaaaatga

SEQ ID NO: 549 - DNA, 654 bp, Chryseobacterium sp.
atgaaagcaataattgcgtgtgaatattcagggttagttaggaaggcatttagagttaaggggtgggatgcaatatcttgtgatttgcttccaacagaaatacctggaaaacattatcagggaaatgtgtttgatattataaatgatggatttgaccttttaatcggattccctccatgtacttacacaacaagctcaggtttattcaggtgtagagtcgataaatatggagaaaaggctttagaaagaattaagaaaaagcacgatgcagttgatttcttttttaagctttggttctccaatattgaacatataagtctagaaaatccaacaggatacatttctgctaatatttatgcacctacacaaattatccacccatattattttggagagaagcatttaaaaaggacatgtctttggcttaaaaacctcccccccttgattcactctgttggagatttatttactgaaagaacacatactgaatatcctgaaccaatcagcgtggataaaagcacaggaaagaaaagatattttactgatggtttttcaggaaaggctttaaaaacggcacatgagagaaataagacatttaaatccatagctgaggctatggcagatcaatggacaaaatacattatagaaaaatga

SEQ ID NO: 550 - DNA, 555 bp, Chryseobacterium sp.
atgaaaacacaagcaaaaattcaaattttagcacatatactccagtttaaaattaacaaaataactgacgatggcatacaatatcctaataaaaacggctttattggtgatgtattaagcagtggtgaaaatattccgatcggaactttagtcattccgttttgcgcaccgaatacgaaattttacttatcctggctcaaagaaataaaaaaagagaatggagaaataaaataccttcttgaaagtattgaggatggcgaactatgctggtggtataatgtttcactttattatttaccattagaatacatagaaaagtttccagattggaaatggacagacaaacagtttgaatttgcaaaaaaatggtatagggtaaaacgtgactatatggctgtccctatgcagccagtttttttggaaaatggaaatgtcattttaaaagttcggtataagttcggcttaaataaggatcaaccggaaaaggagttttctaattggaaaactcttacaaaaagagaaatgcaagtttttgtcgatagcttgaaggtatga

SEQ ID NO: 551 - DNA, 279 bp, Chryseobacterium sp.
atgataagagtaatgccagcaggcgaaaatatttcgagaatggaaattaaaatgcacctcacgcacgaagcaatattcgctttcctgcaacgaagaggatatgagacaaagccctggctttacgtctacgaagatgaaactttccccggaggcaaaacgcagcatgaattctggacgttcactgccacaaaatccggggaattacaaaccaaagaaacactgtttttaacggtctttgaaatggaattgaatacacatttaaatgagcttaaaaattaa

SEQ ID NO: 552 - DNA, 204 bp, Chryseobacterium sp.
atgaaagaaattcagattacggccaaaaaaggctattttaaaacgttttcgcctgtgtttatggacagcgatatcagaaatcgtttaacctatattttgcgcgttgaaaaaaccacccacgagcagactattatttttacttccattgagggggaagagatttcaaaagaagactttaatgtcttaatgacattgcttccctaa

SEQ ID NO: 553 - DNA, 339 bp, Chryseobacterium sp.
ttgcatgagtgcgggccatatggtccgcactttttttatctttgtaatgtggattacaaaacctacatacaacagctagaaaggcatcagaataacgctgacagatggatgtatttacaattgcatcaccttattattgccattggaaaagagaccgaaatcgaagatcttaaaaccgaattacggcagatataccaggagtataaaaacactaaaaatccatacagcctacaggacggatctgttatttatccaaaagccttagataagatccatttgttaattataaaaattatagatttgctaaacgatcactatggtaactataaaactatctaa

SEQ ID NO: 554 - DNA, 528 bp, Chryseobacterium sp.
atggtaactataaaactatctaatatgaaaaaaacactcttctttttattgttttctatctttggatttgggcaaaatactgaattgttaaagagtcttcaaaatggagaaaaaaacattactgaagtactagcaaatacaatgattcctgattataagttaattaacaactataaaatagatactagaaatggtgatgaagtaaattatctttacttacccaataatacttcagatcaagaaataaagaactacaaacaagatggccttaatgagaatgaaataaaaataggttatattaaaagaggtccctattatactttctcaattgcaactggtaaatgtgatgtacttcttccgttttggagaaaagaaatacagcctgataagaatgcagaaaaagatagatttgatggttatagttatgaaaactcggattataatttaaagtatactattcaaacagaagattatacgggctataaatgtacaattagtaatagcaataagtataaacccgctgattag

SEQ ID NO: 555 - DNA, 225 bp, Chryseobacterium sp.
atgagtttaacagccggaaaaccaatattaatcaatgatctgctggaagttttcaccactgaagctcaggcgactgaaaaccctgcagaatcaagacagagaatggcagaaaaattagccagtgcaatagataaatttatccgtagtggtgatgtatcagtgactgttgctacaacaggaacagctatagcacaaacaggaacaggaacaggaaatataacatag

SEQ ID NO: 556 - DNA, 294 bp, Chryseobacterium sp.
atgaaaattaaggtactaccaaaacagtcgttcttagatatagccatagaacatacaggaagtgtttttaatgcttttgctattgctgtatccaatgatatggcagtatctgatacactgatcacgggttctgaattggtaattccggacagtctgccgaaagataattatgtactgcaatattacgggttgagaaatatacaccctgccacagctctggacgaaagtacggatgttgatgaaagtaagggtattggctggatgaaaatagaaagcacatttaaagtagggtaa

SEQ ID NO: 557 - DNA, 864 bp, Chryseobacterium sp.
atgaataaaacatttgaagaattactggcggaactgatcgccgaaaagaataaaaaacctgctttatcaggacttgatacagcatcgaaaacagggatttggcgtttactatttgaatgctttgcatgggtgctgtataccttttcacaggctgcacttttgcacctgcaggagatccgggaccttattgcagaccaaaaagttttcactcttcgccgatacagaaccgaggcattcagatttcagtacggttttgatcttattgatgaaaccgaccagtttaaagaaacatatatcgaaaacggaatcgaagttccggcagatgaagaaaaaatcgaagcttctaaaataattaaatacgctgcatgcaatagggttatagatggtggacgggctaaaatagtaatgaagatagcgcctgaagatatggaagaaattttccctgctgaagttatgacggccttcgctaaatacattgaagaaatagccccggctggcgaccatgtaacgattatcaattacctgcctgatatgctgaaattcggctttaagatacgctatgatccgatggtattgctggctaatggtatgaatattataaccgccaaatatcctgttaaagaagcgatcgaaattttcctgcgaaatttgccttttaacggtgaattgtcggtgcaaaaattagaagctgccatattagcggttgacggtgttgtggatctgcaaaccacattaatacagactaaatggatagaccctgcatccagtggctatggattttatcagcctgtcaatatgtatgtaatcccggcttcgggccgatttaaagtagaaaattttgacgacctcaattttgtgacgtaa

SEQ ID NO: 558 - DNA, 486 bp, Chryseobacterium sp.
atggaaaatgcatttaatattaatttttggaagaccgcccgactatggcttcctacatttttgagaggtgttttttttacagctttaactgctgtattgactactccggtagagcttatttataatcagtttttagcggaaagaaaacaaaatatactgaggctcaaagtaactgctcaaaaattttctttgcaaaaaaggcttaatgatgtttttgaccctgtagagaggagaatcgagattgtgaaggctgttctgtttgatggtctttatctatataccgaggcggaagatgatcagtggcgaactaaaacgcagtggttatatattgatagcctgcctttatacctatacaccgaagcagaattatatagtgatatagattttattgtcaaggttccggccggactcaatgaaacaaggctgaaagctgagattgaatatttcatgctacagtcaaaaaactacaaaatagaagtaatctaa

SEQ ID NO: 559 - DNA, 813 bp, Chryseobacterium sp.
atgagacttaatttcaaatttctacagacagacggcgtgcccttaacggcagatctcatggatgagatacaaaacgcctattctatatttaacgtactgggagatatagccggaaattttacgatcctttccggatgtgagcttcagggtactttagtgttacctggtattgtcgtgattaatggtgatgttctttattttgaaggcggaaccacctacggaaccgtttatatccatcaggagaatatcacaaaagtatttaaaaaccaacagtccaaagtactgattgaaaagaaaacggtcagatttggcgatgcaggaactacgtatccctggactgattttgtccgtatccaaacgttaagatcaataaaagaatctttagccacaaaagcggagcttgcaacggttttaaacctggttgaacgggttatgatattggaaaagaaaacagccccaattaagccgggaggtactgtatggccgtggaggacagcagaaatacctgtcggatggcaggtggttacagcttttgaagggaaaacgctggtaggtgttgatcctaacgatcctgattttgatgaagtaatgactgcgttcggagaaaaaacacacaaacttacgatcgcagaaatgccgatccatcgtcatggtattgctgaatatgccggaagcccaggtgtgaactttaatcacttaacagcttcaacgaacggcggatcttcaccgctgactttaccggaaggaggcgatcagccgcataataatgtacaaccatcccaaatggtctattttatagaatacatcggataa

SEQ ID NO: 560 - DNA, 2664 bp, Chryseobacterium sp.
atggcatcactaacagatattttaggatactttcaaacgggtgacattcccacagagccacagttcatagaaacgttttcttcatttcgtcataaagatgataaagtggctattgcagatgtttccaatctggaaaccactttacaaaataagcttgacaaaacccatacaacagatgaaaatgctcatattttgcaccttgccaaaatagatgcatccaatctaacccctgcatatattcaggcgtggaaagacgcgctggacgttggttctttacctcccaatgtagcaacaattgacgcacccggttatactggtaatgcctatgataaagatcagtctcacactatctttatggaaaaggacaactataccaataatgaagggaaggtacgatctgatatgattgaagctttagcgatcacgtctttaacacaggcgaatgaaaccacaatagctgattttgctgctaattctgctaattatccttttgaggataacgattttatagctattcctgataatacagggacgaagttttcgctgtatatgtattccggaggtgataagaccattgtaaacaactatctgccaaccggactgacaaatattaccatagcaatggttgagggccttcaaacggcattaaacgcaaaaatggataaagttacgagtgcagtgacgttcacagataatgctgtttctgctgctaatcagatcacttttaccggggataggttctatggaaccgacagtgccggtctaaaaagaggattcgcgtggcagggtgaattcacggaaactcaaacatatattgaaaatcctgtaattgggacttcaggtgtagatcttgttatattctataccggagagtcaggacctcagcaacgtggtgtttgtgatcttactcccttcaaaaacaatgtccttgccgatgcagcaattggctataaaggctttttaaaaaagaatactgtagcaccgaccgttataggattatatcgattattagaaataggcaattatccgaacttaatacctgctgtagatgaagccggggcaacaattgtagttaacgccgcaaacgggaaattaaatgaggcctattgggatggcatcaattggacacaacctggtatttctttacctggtggatcggtgactgctcaatttgaacaaaataacgctcaagacccgcagggaggaaagcagataaacgactatttgaaatccaaaggcctaattgccggcgataatacatatcgtttttttgacgatttttcaacaaataaaggatgggtagcatccccaaattttccattaaccccaacaatatcatcaggggttatgacattggcatttactgccgggcaaagtcaaggtgttcagattcctttacccggcatgaatactactacaccaatgacttttaaagtaagaataagaaaaacaacaggtaacgcttctatactagcaataggaacatctttcggaacaagcactacgaatacagcgtacaaacaaataactgctaccaatactttttcagaatatgttttcaacattaccgcagttacaggtgcggtttcaaacttagtaattggaattccttctgccaataactttggagatacatttgaagtggatttcttctatgttgacgaagttattaatgagggcatgattgatttccgccctattttagggacaccaaaaaatgatttaatagaagctattggagcgggaggggctgtgtatcttaagcctcagacgtatacagtttcagcagcagttaatataccgtcgaataccattattaaaggggttaaaggcagaacgataattaaatatacaggaaccggagatcttattactttggatgcctcgcaagaaaatataatatttgaggatgtaatttttgaaggattaaccgctaaaacacctacccctatgactgcttccgaagtgaaagcacttacaggaataggcactcaaaatgccattaatttaacaggttacgctaaagatattcattttaaaggttgtgtttttcgcaactttacgggatgtggaattaaatccgctcaaacgcataccggaacatacaaccggactatgaaaattactaactctgttttttacaataattttctaggaatgcagctgggagcaagatctgaataccatcaattcgtgggtaattcttttaactacaatcaagtaggggtgtggatagaaggaggaaataattttggatcaaataatcatttcaatgcaaatggcgtaggtgtagtagtaacaggagttactccgactagtaatgatactcatggatctctatctgcttgctcaatcaatcataatttgagttattcgctgtttgcgttcaccgttaataatggctacactttcaatggctgtcatctatttcaaggtgatatttatctcgaaaattgtagggggttggttatattgggcggagaaatagccgctggaattcaatctgtgaatgaaaatacttctgcttataatataataagtaataatattttcgtcaaaagctataacggagggactatttccggcagcccgacaaaattatcaatgagtggtaatcgttttatagatgggagttcatctataacaattaataattctatttaa

SEQ ID NO: 561 - DNA, 1215 bp, Chryseobacterium sp.
atgtctcaaggtgatgcgagtgcatttggaatgaattttaatggtggaaataataccattggtttccatccaggctggtcatggtcttctggcttacaggctcctgcaaatcaatggacacatgtgggatttgtaagcaatgggaccaacgtaaaaatatatgttaatggaaaggaaagtgtgaacagtacagcattaccgtcagaaattgttaatactttatttttgggaagttatggtagaggatattctgataggtttgtcaaattggaaatggatgaggtggctatatggaacagagctctgtcaattgatgagattcgacaatggagacatcttacaaaaagcacagcaggaagtcctatattgaacggcttagtatattatcttcagttcaatgaatcagttggtgatattactattaacaagaataattctaatactgcagcatcttataaaggtgccggttatacaagattattgtctaatgttcctgtttttcatggaataagcgaaaaaattaatatcaactcttccgggttaaaagattttacgaacgcaggagtatctatggaatttgcttcaggaacctatcctaatggtgatgtctgggtgtcaagaggaaccataaatcctgatcagctacctaataataatactaactttggcttttattctattgttaataattatggtactaatcaaacatttactccgcttacctcactgtctttttataagaatgccaattttgctaattactttacagcatcttcttacaatcttttcaaaagaggaagtaatgatttcggaaatagctggggaagcagtattgataatgcggataacatttcaggaagtggtcttgatacaaaagtaacctttagcaatgggcttaatattaattctttcagccagtttatattaacatataattcgcctgtgctatctactcttaatcctgtaaaatctaagattgaatatcctcaagtagttccaaatccaatattacagggtactcctatttctatacgtttaccggaaaaatggattaactctcatttgatagtttacgatatttcaggaagaaaagttgcagagaaattcaatttaaaatctgatgaaagtatattgcttaatctgcctcagggaatttacacggcattattgattaaacaaacagataagtacatggaaaaattcattattaaataa

SEQ ID NO: 562 - DNA, 165 bp, Chryseobacterium sp.
atggagaaaacaaaacagaagtcaacaaaaattcagaactacggacaaactgaaaagaaaaacacagtaatggtacagcaagaaaaagactaccagataaagatttacatttattgtttggactttccggtggattctgtgcatactgtaaaaaacttttattga

SEQ ID NO: 563 - DNA, 585 bp, Chryseobacterium sp.
atgtttttattgcatcccacttgccataaggaaacggaaaattttgagttggaagagctgcagttcattaagaaaaaccatgaaaaacatataagagatacattaaatggggtatataatccttatccagtaggaaacggtaaatatttgaaatatccgcatgttgtttatgaacaagtaaaaagaccttttaataaactagatgcatatctaaaccttctgctatttggaggcggaatagtaatatttgtactactttttatattttttcttcatgacgatcagtacttagatgccggtgtactgctaggaatgtttactattttctttattttcgctatatttatgacccttaagtctttaaaggagaagccgcataagattgatcatgaagcagaatgtatttttgcaggttgcaacggtaaggttttaattagacaccaatcaatattcgatacatttgctaagaggaatcttcccgctaccggaatgggtgtttgtaactttgatactacacacacttttactgtgccacaggatttaaaattatcaaaccgtggagaccaccatcaatttatactttaa

SEQ ID NO: 564 - DNA, 3033 bp, Chryseobacterium sp.
atgattggtgcaggaaaagaatttaaattgacaatattattattatcaattacttttcaagcagcaaatgccaccactgtaaaaaagacagaatcttacaaaatcttatcctatgtacaaaaaatagtaaaaggaaaagtaacagacgaaaaaggagcaccaatttcgggtgtaaatgttacaataaaaggaaccaaaaccagtgtgcaaactgatgcagaggggaactttgcaatagaagctcccagctctgattctatactagtatttgaattcttaggaatgcaagatcaagagattgcagccggaaatgattttataactattgtaatgaaagaggctgtacagcaaatagatggagttgttgtgttaggttatagtaaagtaaaaaaagaaagtttgacgggttctttgcaaactttaaacaataaaaaactattagatgttactactcctacagttgaaaacttactttctggaaaagcatcaggggtttttgtaagtactagtggtggtcagcccggaggtccatcaaaagtagttattagagggaaaactactgtaaatggaagcacagatcccctttgggttgttgatggtgtcattgttggaaatgcttctccgagtatgaatcctgctgatattgagagcttaacggttcttaaggatgctgcatctacagctatttatggctcacaaggtgctaacggtgttattgtggttactacaaaaagtggaaaaacaggtaaggcaactatcaatttttcggcaaaaacagcagtatcaattataaacaatggcaactacaaaatcatgaatggggcagaattgtatgatttatataattcattttcaaacaaagaagtgtttcaaaatgctacatggtggacgcctgaactaagaaacagaaactatgattggtggggaaatgcaaaccaagcaggtattgccaatgattataatttatctattagtggaggcggtgacaagtttaaaagctatgtttcggtaggcatttatgacgaaacaggagcgataaaagggtatgattataaaaaatataatgggcttatgaaatttgaatacaagccaaatgcttggttaacaataaggcctcaagtaaatttaacaaaagaaaagatctttaatcagcagcactctgttggtgctttgtacagaaacttgccatgggatagtccttatttaccagatggaactttggtaggaaatgcgccaaacccaacttgggtaaatgttactggatcaaattatttgtatgatttacaatggaatttttctgaatcggaaagctatgatgtgcgttcaaatcttgattttgatgtgaagcttactaaatcgttaacttttgcttctgtaaacaattatatttttggtaattccaactcaacttcttactctgaccctagatcatcttcaggattggcagtaaaaggtagaattgaagataattttagcacattcaacagattatatactaatcaattactaaaattcaacaaatcttttaacaagcacgagataaatgctgtggccggttatgagtggaatgaatttaagtcaaaatttagccaagcaattgctactggaatccctcccggaattattgtaacagaacctgctgcagtaccggaaaaagtagaaggaaacagatctgaatgggcagtacaatccttattatcaaacgtaaattattcgtataataatcgttatttggcacagttttctttccgtcgtgatggtgcttccaactttgggaaaaatgcccaatatggtaactttttttctataagtggtggttggaacattcataatgaagctttttttaatgcagattggattaataatttaaaattaagagcaagttacggttctgtgggtaaccgcccactacaattatatggacatttaccattgtactctttatcagcaagttataatgcgaatccgggagctcttatttcacaaatagggaatcctgatttaagctgggaaaaaacatatactgcaggtgtaggtttggatgtaagtttttttaacagagttaatattacatttgactattataacaaaaacacttcggacttattgtaccaagtccctcttcccggagttattggagtaaccagtattttaagaaatgttggtgctgtaaacaatagaggttttgaggcttctattaatgtagatattatcaagaatgaaaacttaaaatggtctgttgatgctaatattggtgcaaataaaaataaagtaacgagtctctatggaaaccgccaagaaattattgtttctgacggtagcggtgtagcaggttctgcattcaaattattaaagcctggctatgatgtagatagctggtatcttacagaatgggcaggtgttgaccctgcaactggtgcacctcaatggtttacaactaacgccaatggagaacgtgttaaaacttcagactatggagaagcctcaaaacatcaaaaagtaatagggtcttatacacctgatttctttggagggttctcaaccagtttaaattataaaaactttgatttttctgctgtctttagttattctgttggaggcgaaatttacaactattctagaaccgaatttgattcggatggagcttatacagatcgaaaccaaatgaatttgcatagtggatggacccgttgggaaaaaccaggtgatattgctacacatccaaaagctacttataataattcaagcaattcaaatagagcttcttctcgtttcttagaaaccggaacctacttaaaaatgagaagtatttctttggggtataacatacctatcaataagctaaacatcagtactttaagattatttatagctggagaaaacttatttaccatttctcacttttctggtgtaagtccggagctttcaccaaattttaatagcggaacaggtcaatatgttatttcaggtgtagctactgatgtatatccacaaactagtaaaattactctaggacttaatctaacgttttaa

SEQ ID NO: 565 - DNA, 252 bp, Chryseobacterium sp.
atggcaaagttaagtgaacttgataaggagctcaggacaaaaataattttacgagtaaaggaactacgggaagagtatgaagataatcaatctaagttcgcgggagagcttggattagataagcagttattaaataattgggaaagtctctcaaataatcgaggaatctcaatatatagcattaataaaatttgcaaaggcctaaatatatcactcaaagacttttttgatagtactatttttagtgaatag

SEQ ID NO: 566 - DNA, 747 bp, Chryseobacterium sp.
atggaatttaaaacccttagaatagaaactttatttatcatactatttttcaatgtattacaagcacaaaattatagaatttcctatcaaatgaattacaaatcagattccttggataaagaatttagggacgaaaatatgatgttactagttagagaaaataaatcaaaattttttccctaccagcagtttgtaagtgattctttggttatagaaaatgcaaagcaaggacgtaggtcgccccaaaagctagaatataatttcatgataataaaagacaataaggaaaagaagatttctaattttgcatttttactccgtgatttttacaaagtttcaaataatatgcctgtttttaattggatcataagtaatgaaacaaagaaaattgggaattatggatgccaaaaagctacattaaattattctagtcgtaattgggaagcatggtttaccacagatattgctttacaaaacggtccctccatttttaatggattaccgggattaataatctatatgaaagatactaaagataattacgaatttatttttactggtttaaaaaaagatgagattacagatataaattttttggctaataaacctttagaaattactaaaaaacagcttgaaaaagttttgctggattataatgatccctacagagagttaaaatgggtggtctcaaaacaacttggacagatgcaaacggaaaagtatttactcctgattatggtaaaatga

SEQ ID NO: 567 - DNA, 195 bp, Chryseobacterium sp.
atgagtgtaaatgatattgaagagcaaatcaaagagatgtatgattttgatgtttctacctccatcatttcacgaattacgggtactgttgccagcgaagtagtggcttggcagaaccgacctttagatgagatatatctgagatggtactcctatgcaaatatgtgctataacaatagattcgctacaaattaa

SEQ ID NO: 568 - DNA, 963 bp, Chryseobacterium sp.
atggacgagaagtataaatttatcacacatctcgcatggcttttattgggaatttattttacatatggtgtggaaaactatatttatggagatgtattttttagtatcatctctttaatatttttttctggtacattatatgtgtatttattaattagaaataaagattataatttagatgtattttcaagattaattgctcctcttcttttaatggaaattctttttataagcttctatacatggcaatcaactcctcttatatgtttattcttaattatttctccggtaatattgataaatatattctcctttaagactatactttattatggaattttttgcagcctttttttagtaattattattgctattaatagctattttaaattattttttcataaagaaatgtctatagaatatattacacttatcaattatgaaactattattttttcaacaggattagttttattcagcctttgcagaaatctgaaaatatatcaactaaaatctgagctcacttttatcgaaaataataaattcaattttactgataatcttaccatatcttcaaaagaacactcagagtatacagaaaataatcttggagataagtttgataaactgtatgatgaaataataagttattttgagaaaaacagaccttgggagaatccgcaatttaatctgcccaaactaacagaagtattagattctaatgtaatgtacgtctcaatggtacttaacaaaaagggtgggaaaaatttcaaaacactggtcaatcaatatcggatcgatcaggtaaaagaagctcttttaaatcgtgagcaccagcgatttaccataaaatcaatttattccaaagcaggatttataaatcaatcaacttttaacagggtttttaaacaagtagaaggaaaatctccacaggaatatatcaaagaaattgaagaaagttaa

SEQ ID NO: 569 - DNA, 201 bp, Chryseobacterium sp.
atgtgtaacataatattaagaataataagaaatactattaacaagaataaatttatgatgaagaaaacttacatgataaacaatgtcaatacggttttgatattgtttttatatctcatggcatctcaatcctcctttgtgcaacatgctgatggtactacgaaggatagaatttctagaatgttctacacgaaaatgtga

SEQ ID NO: 570 - DNA, 1833 bp, Chryseobacterium sp.
atgaaaaataaaatattttatatactcttgatactattattttctgcaacagtttttggacaagtcggtattaatactacttctcctaataccaaatctgcattagatgttgtttccaaaaataataataccggagtcttaattcctcgtcttactactgtacaaagagatgctattggtgcagcagctacagaagatggtttaatcatttataatactgatgaaaaatgctacaactattataagtcaacggcggcaacatggttaagcttatgcggtagttatccaaaagcagtgtataatccggattgtacttctgttaaggtctttggcaattatactcagggaacttcattaaataatagtaactacatcacaatgtctgtcccagtaacaacagcagggacttataacattattgcaaaaacaactaatgggtactattttgaaaagtccggggtatttcctaatacgggtacctttaccattacattagatgcttcgggtacacctgttgccggtcctcaaacggacacactttcttttgtttatgatgggataacggatactgtatgtaccaataaaactataaacgtatcaggttcgcaggttagctatggtatcaattgctccggttcaacagtaaacggagcttataataaaaatatacagttggattataatactaatacggttaccattccgctttctaatgtagatactgccggtacagtgagtattactacctctaccaataatggcgtaagttttaatacaacagaagcaattactaccggcagtacaaatattacactgcacggtgtaggaacaccagcaagtgcaggaaactatacttatacctttactactaatggtgccaatcctcaaacgtgtacgttttctgtaacatttggtaccactttaggtactttcaccaaccctgcaaacagatgcctcgaaatatataatgacggtaaaactacagatggttattattgggtaaaagatgcttcggcaaataagttcaaaacgtattgtgatatgtctaacgggggatggactctgattaagtctctttctgaaagacagattctggtagtggaaaaaactcaaaatgagtcctggtctacccagcctgcaagaaataccgtaactacgcaaaccggaatatttaatgaatatgctttttctctgtcctctgctaccgtaaacaatatagggagtagtgcaggagctaaagaatatcgcttttccataaaagaaaaaggacataccggaactacaattgaacaggtagaaagttctacgattgctcccgttaacgattactgggcaagagccaattatcttaatgcattggttacagatggaaatatggccacttcagactaccttacttatggaaataccaccacgggtaaactattcggctttgatttcggtaaaccggttaccggaaacacactctacaaattaaatggtgtagattttatagcaaatattccaggattatacagtcaggctaatttctttacaggaatttatggaggaaccggttatgcaggaatcaatgtacctaccaataatttaacctatacctacccaaccagccagacctatactttcaataaatattacgtcaatgatgagtttggtttatacatgaattccgaacagcaattaaaccaccatattggtacctgttcaaacagtacagatgattatgggggagcaagtttctgcaatgcgggatgggcaaattggaggcctcataattttaatttgatatcaggcaattatcaaggcagaattattcagtattgggtaaaataa

SEQ ID NO: 571 - DNA, 1449 bp, Chryseobacterium sp.
atggaaaaacatgtaattactttaggtggcttaatgatttccgcactatcatttgcccaaattgggataaatactcccaatcctaatccgaatgcagcactggatatagtgtctgcaaacaaggggcttttgcctccaagactgacactgacctctacggcttcctcttccccgttatccgctcacgtagccggaatgatggtttataacacggcagccgttaatgatgtgatcccggcattatattatgatgatggtacaaaatgggtactggccaaaaatgcaggaactactaccaatgtattaagttcatcaggcaatatccttacttccacggtgaatggagctacttcaagtaccaatgctgtgaatacagtgagcaatacatcgtcaggaaacaatttgtctacaaccgtgaatggagtagcgggtacggctgtacccattattaacagtaatacattgtcattatcaggaaccaatttgacaagcactgtcaatggaatagcaggcagtgccgttaatctggctcctgctattacggctgccactactaatgttttgagcagttcaggaaataccatgacctctaccgtaaatgggatagcccgtacagcacccatcatcaacagcgtgagtaataccatttcaggaaatactttaacaactacagtgaatggaattgcttccggttccgttaccctcccgcagggaatcaacatttataactctgacgggacacttatcagtaacagagttgtttcaatgaataataaaatactttggttttctcaagatgctaataatcaaatgacatttgataccggagctgtcgttcccggatctacccgctttattgcatccggatcttcaggttctctggttcgggctgcggcagggtcgaggctgcttgatatggagttgttatctaatggtacctccagattattttctacgggaagttcagaattatttataggaaccaatacttcttccggacctttgactttcggggttggtaccaacagagcagtattagcaaccaatggtaactttgggataggaaccacaaatccaggtcaaaagcttgaagttgcaggaaatataaaagcaaacggctccttaatttcgggtactactacttatcctgactatgtttttgaaagatactacaaaggattttcaaagatcaatcccacatatacattcaaaaaactagatgaggttgaacaatttattaaagagcaggggcatttgccgggatacaagtctttagaagaaatcagacaaaaagatatgacggtggatattacccaaaactccataaccaatatggaaaaaatagaagaattatatcttcatgtaatagaacttaataacaaaataacgtctctggaagaaaagaatatgaggttggaaaagagcattcagaagaatagagaaaagtaa

SEQ ID NO: 572 - DNA, 198 bp, Chryseobacterium sp.
atgctgaaagtttggattctgaactgcttttgcgatggagttgataccataggaattgtagacacaactttacagaattctttacttgagaaaaccgatgcaaaagtctctataggaacacctctcataccgggaattctggttttgaaagatactaacaaagctatgatattaccaaaagtgacaagcccacgctga

SEQ ID NO: 573 - DNA, 813 bp, Chryseobacterium sp.
atgattaaaaatatcattattatattgtttgtactgatccctttccattgggcaatgtcccagatcggtattggtaccgtaacaccgcatccatcttcagctttggatatatccaaccagacccaaagagctttactgcctccaagagttgttttagctcaattgaccgacagcaccactccggtttccggtcctgcagaaggcctgatcgtttacaataccggggggacacaattgcctgggttttatatctggaaccagggaatctggagcctcatggccacttctgccaattcagttaccaatgtacttgtttctaacaatgtgtcaacagtgatgctggctgggcttgcaaataatacttatcaggcaatgacgggcggaacgctgaccttcaacgggattgcaggagtggtttatgacccggttaccggtgtggtcagcttacctgcaggaaattattcggttcaggtttcattaaacatcgaagttttggacgaactgccttcggcaggtatcggcagcacggtaagaacgcacgcgcactattatacggcaaaacttacggatctttcaggcagcgtacaatatgggcctgttgcattagataatgctttatccaactcaagcggaactaaaagacatatcgccaatttttcttttccggtgacacttgcctcgcctaccaccatggttgtcagactggcccatgcgccgggcggaacctatcagaacggcttaggcggaatagctcccaataacggaaggattactttattaaactcattcattcatattcaaaaatcattatga

SEQ ID NO: 574 - DNA, 231 bp, Chryseobacterium sp.
atggcgaaaataaaaaatacagacgatacatttgaaatcgaaatccgggaaaaaattgaccctgaaagcatgaaagcagaaataaaacattttcttttggaattgatagacactaaacagaaaacagtttcacaggttgcaaaggaaagcaatatcccggaaataaccatttataaatggcttttttacagatggatacagaaaaaacttaaaaaacccgattaccaataa

SEQ ID NO: 575 - DNA, 450 bp, Chryseobacterium sp.
atggaaacagatctaaaaaacatccatatcggaaattatatcaaaaagcgggttgaggaacaagaaatttctatgaccagaatttgcaatttcttcaaactttttgagcaagaaattacaaaaatgtacggactgaaaagtatggataccgaaatgcttctgaaatggtgcaagcttctggaatatgatttttttagaatctattcacagtatctgatactttttgcaccgccttcgggaacagaaaacagaaaagaaaattctaaaaaaaaggaatcatctcttcctcagtttagaaaaaatatttatactatagaggttatagattttcttttggatctgatacagagaagagaaaaaacaaaacagcagattattgatgaatacggcattcctaaaacgacactttacaagtggatacaaaaatacagcaaacaaaattttaaataa

SEQ ID NO: 576 - DNA, 1377 bp, Chryseobacterium sp.
atgaaaaaacaattattgttattggggatgactgtcattactataacagttaaatctcaggtaggtattaatacccccaaccctaaaagtacattagatattgtagcaaagaacgcgactggttcttcagtaagtgtagatgggatgcttattcctcgggtagacagacaacgagcattaagtatgacgaatgttgagtcatcaacattgatttatatcaacgatatttcaacgggttcggcaaccgaacaagcatccaacatagataaagtaggcttttattattttgatagagcggttagtaaatggataaaacttaatgatactgttggggatcctactcctgatgcttttattgacaatccaggtaatgcaggggtagaattgggatcgacttctacaggttcagtaagagcagcaggatcagagtttattgtgaaggacaatggaaatgtaggaataggtacaaatcagccgatttcccatgtacatgtatgggagagcggtgcagctggaagtaatgagattagaaatacatctgtaaatacttctccaaaacttattttagatagggctactgctgataattctaatatatcaagtggtacagtagtgggaaatcttgttttcaatggaagggtagccggtagctcttttcctttagcaggtattaaggcggactattggggaaatggattgaccaattcatcttctttaacattcagtacgagtgacaggccaaatatgcttattgatgaaaaagggaatatgggaattggagctggtgatgttaaccatgcaatgagtcctacccaaaagctggatgtagatggcaatgtacgttttagaggagtgcctgatgcaagcatgaattcatccgataaattaatggcattggaaagtaatggaactgcaaaagctgttacaggggtacctagaatgacattcgctgctgtaaataatacctattctctaaaaagtggaggaaataccagacatattttattgtttgaggatgtaaaaggtatcaatacaaatatcatcactagaatcgatgcaggtaatcttcaggccaaggcagccggtttatatacaatatctattgctgtaaaagcatctgatatcccaaataggaccagtgaaggtatagccatagatagaggagtgtcagctgcaatacaaataacagatggcagaaaatatcaatctcaaggaaatagatggactgatgctaccggagactgctcaattactattactgtaccattaaatacaggagacggtttctatatagatactattatgccgggaagtggaaattataaccaggcaccaaactctacaatatcggtaatgtatactcctttttctttgtag

SEQ ID NO: 577 - DNA, 1473 bp, Chryseobacterium sp.
atgggacctgtacgatttaggctattatttagcattatatgttttttgctgtttacgaatttatcctcacaaaaaaatctagaaaataaaatagatatttatacaaagaaagctgattttttttttaataaatatgaagatgttaatgccttagagtatgcaaaaaaagcaaatgatttggcaatcaaatcagggaattctgaaaaaatttctaaatcatattttttaatagcagtattattatatgagatggatatggagcatgaaagtttagaatatgcagacaaagcattgcttgaaaaatatgttaagagtaattataagatcagagctgaattatataaattgaaagcaaataattatataatgttacatctatatgagcgcgctagaagagaatgtagaaaagttattaaaattatttcctcttcagatcttgatccagtaatgattcaggaactttatggctcttaccgggatattggagtaacatattatagagaattaggaagtatggactctcttcagaaatattcaaaaataaaattgaccgtacttaaaaataaacctgaaaagcttgtatgtagttctttatctgaatattatattgatgaagcaggtgtttttttaacactaaaacaaacagattctgctctttctaacatcaataaaagctatgcactcaaaaaaaaatatgttgagaaggctttattctatgagcagtatattgcttatgggaattattattttgaaacaaaagagtataatacttccttaaattattatctcgcagcacttcaggaaatagaaaaatataatgttaaagatagattctttttatatatttataaaaagttatctgaactatatggtttaattggtgatactgcgaaagaaaaggagtatttattaatttactccaataaaactgaaaattcattaagggagaatgaaaaaagaactgcctgtgcattaaaattaattgtaaatgaagaaaaagaaaaaagctcatctgttcaaaataagcttataattctgatctcttgtatatctattatcatattggttttaattattttttacaaaaaatctcaaacaataaaaaaacaggcgatgactagtcttctgctagagaaagaacttgttgaagaccttcagcaaaaggttaatgaatccttttctgaaatagtgcaattggcgagggataacaatcctcaattctggacacgttttcaagaagtatatcctgaatttctcaataaaatgctagaacttaatcccaatttcaaagtttcagaacttacatattgtgcttatgtatatcttggtttttctactaaagaaattgccgaatttactttcaaagctgttaaaacaattgaaaataacagatataatctcagaaaaaaattgaaattatcccctgagcaagatttttcgatttggcttcataactttattggccggggttaa

SEQ ID NO: 578 - DNA, 744 bp, Chryseobacterium sp.
atgatgaaatttagcaaatttattttagtatcctttctcattctaattacaagttgtagaaatgacaattcagatattacattgaataattcacagatagagcctgtgctacatttaaaaaaaattagttcttcagtaaaaggttatagtgttggatcaactggtgaaataaagtatgacagcaatgacaaaatcattcaaatggtaagcagttcaatgaaaactgatataatctatgattcacaaaatagaatcgtgcagattaatagctattatatagacaatccatcagttcttataagttcaaagaaatatgaatacattgctgacaaaattataatctctaatttatattctggtatctatacagaagtaatgactttatttattaataatttaggactccctgttaagtctaatcataatattggcaattctatcatagaatcatactttgagtatgataacaacatgaacttgattcatcattattacaataatggttatcaaaataattattattcatacgataacaaaaaaaatccttattatttatttccattggttttaaatatttatttgaacgaatttaatcaaattggcaagaacaatgtcaattctattaaatactatgacgatactgtaaatcaatttaaaattattaataatcttctagaatataactcaaatgattatttaacacgctttgagaattatcagtcaataatacaattttattattag

SEQ ID NO: 579 - DNA, 1065 bp, Chryseobacterium sp.
atgaaaagtataataaagaatatagtagctatgtttgttttgttaggatttactggctgtaaagatggttatatagatgatataacagaagttgcatccggtacagatactgctgctcctacagtaaacattgcaagtccttcgggaactatatggataccttcaggccagtcttctgccaatttaagctttaattttgtagttgtagatgatattgaaataaaaaaagttgaacttttatttgacggaaccaagattgcaacttttgacagttttctggattatagaaaatttgttaaggaatatccatacagcaatatttcaattggaagccatacactaattgtaaaatcagaagatatgtctggaaaaacagcttctgcaacaaccagtttcactgttaaaaaatatgttccgattttggattctgaaactctttatatgccatttgacagtgactatacaaatttaattaatctaacaaatgctactccggttggttcacctcttcttgctgcaggaggacattcaggaaatgcctataaaggggctacaggagcttatcttacttaccctttatcaagtttgtataattccagtaatggagtaagctttacattttggtataaagtaaatgcatcacctgacagatcaggaatcattgtaattgatgataactctaatgacagcgatgataatagaaagcaaggattaagattattcagagaaggtagtgtaacctcgcaaacaataaaaatgaatgtaggaataggttccggagaatcatggaatgatggggggaccataaacgttaccagtaatgcatgggtacatgtaggagttaccttatctgctacagaatccaaaatttacttcaacggagttcttcaaagaacagcagctcttgcaacaccttttgatttttcttccagttctaaggtaacaattggatcaggtgctccatcatttgcttattggggacatttatcggatcttagtttaattgacgacctgagagtttacaataaagcattgacacaggctgaagtacaaagtacattgtaa

SEQ ID NO: 580 - DNA, 1515 bp, Chryseobacterium sp.
atgaaacgatcaatttatataaaagcccttttactttttacagcaattagtctattaagctgtgatgataagcttgatgagaaaatggaacttgatgctagttcaagttttaactatagtagtacagaaggtgctaaaggagcattggtaggtgcttattcatcttttcaggatatgggctgggagcaaattccaatactttcagtacttggagatgatgtaaatgcgggaggtttaggtgaccaggcagcatattccgatactgatagatttatctatgataacaatttctggatgtacaattctttgtggtctgtctggtatcagcacatccttcaaattactacccaaatggaccagttggacaaatttagagaaggaggtgttaatcctgccttaattagtcagtatcaggcggaatgcaaagtaatgagagcttttttacatttagagatatcaaaattatggggtagggtaattctggtggaaacaactgatcaaactcagttaaagctaaagaataaggaagaaatgatgcaatggatttctgcccaaatggatgaagcaataccgaatttaccggatatgcgtcctaatcagagaacagacataaaaggaggtgttactaaatatacggctcttgctataaaagcaatggcaaatctggaacttaaaaattatcagggagttgcagatgcaacgggagcaattatcaattctggaaaatttactctttataatgattattatgaactatttaaaattccagggaaactagcggatgaaaatcttatggaaattcaatactctgacttgggagttgcttctggaggagggtctattaatcacctctgggcattttatggtcctacagactggacacctgctgtagcaagtgctactgcaggttggggattctatgaaccaagtttgaagtacatcaaatttatgttgggcagaggtgaaatgaaaagacttcagaccagtgttttgtttacaaacagaggtatcaataagatcaaggaagatcccgctttcgctacattacctggttgggttaccaatacaacacctgacggagatgtaataaaagattatgcaagagctatgttttccagtgggaaacattatttaccttctaatcagttaactggtggtagaacagagtatggtagcaacaaaaattatattgttacccgctatgctgaggttttgttaatgtatgcagaagctgtgacaagaggtgcaagtccttcagcaggttcagctgtttcagctgttaatttagtaagaaatagagcagggatgtcatctttagcaacagtgacagcagatcaggtaatggatgaaaaatatgcagaattaggaatggaatggggaattcgttattttgatatggtaagattgggtaatacgtctgctttgagttatgatggcagagcattctctatggataaacagttcttaccttaccctttggctcagttagataaaataaattcaattaaaaattaa

SEQ ID NO: 581 - DNA, 2850 bp, Chryseobacterium sp.
atgaaacaaagtaatttaaagtattcatgcctcattgcggttttgtacttcggtatgaacatcaatgcgcagactaagcctagagatactgctactaaagaaaaagaaattcaggaagttgttataattgggtatggaactgcaaaaaaaatggatttaacgagtgctatttcaacagtaaaagctgtagaaattgtgaaaacgccagcaggacaagtagcacaatctttacaaggtaaagttgcgggtgtacagatcagtagttttggttcacccggtgaagcacctaatattacaataagagggatcaaatcgcttcagggaaataatcagccactatttgtagtagatggactttttgtagacaatattgattttcttaactccaatgatattcaggattttactattcttaaagatgcttctgcatctgccatttatggggtgaaagcatctaatggtgttattgtaattactactaaaggaggaagttacaataaaaagccaaaacttacatatgatacctattatggtgttcagagagccaataatgttctgaaaatggcaaatgcagagcaatttgtaaactttgctatggagtctggttctgctgctgaaatagaaagtgttaatgctgcaattcagcgttttggaagaagccgtattaatcctaatcttcctaatgtgaatacagattggtataaagaaacattgcgtttagccactatacaaaatcatagtttatctgttgatggtggttcggaaaatgtagcctattcattaggagggaactttttcactcaggatggcattctgaaaatgaagaacagctatgagagattcaatataagagctaaaattgacatcaaagcaacgaagtggttaactgtaggaagtgttgtaaattattcccgcagtgaaaaatatgatgacgaatcatctgcatggtcacaaatttattatgcagtgccaattttaccagtttatgactattcatataccaatgcttatccttttccttatgcgagtgcaaaggatttaggatatagagatcatcaaaatccatttgcaacattagataatactgatagacttggaatcaggaagagaattaactttaatgcatatgcagaggctgcgataattcctaaagagctgatatttaaaactgcattatcttataatagtcaaaatgatgatgaacgtatcatggtattgccttatagagtaagtaatgcttttcaaagagaattagatcagtcttcaatagagagaaattcagtttcattcgaaaactatatctgggataatacccttacctggaacaaaacttttggaaagcatagtgttacattaatgggagggacttcttttgcagatgacagttataaaaaattaagaacaaaaggatatttctatgacggaagcccttttaacaggtatgatgaaactagctggtatattaataacacagatcctgattccagggaagtatatgattctgataaaagtgatgtaacacttcagccgtatcgtttctatagaacttcttattttggccgtttatcatacaaattcgataataaatatattgtgtacggaactataagaaatgaaggatctaataaatttccatatcagaaaaaaattaatttaccggccttcggagcaagctgggtagtttccgaagaatcatttatgaaggacatctcgtggatcaatttattaaaattccgtggtggttggggaagattggcaaatgatgctattgctgcaaacagagcttctacacctactgctactactggtatatttgacgatcagctttataccggatacttttttagtacattcaaagataatgtaaagagagaatttactgaagaaacaaatattggtttatcttcggaatttttaagaaagcgtttgacgttagaagcagattattttataaaggatactaaaaatctggttatccctttacttccaattgtgggaacagaagttagttatgccaatgtaggatctatgagaaatagaggatatgaacttgcattaggctggagggataaggtaggagaaaactgggggtatttcattaatggaaactatagtcatattaaaaatgaaattactgatttatatggacaggcatttattaacagaggtgaacctgaatttcagcaaagactttcagttggtcagccaatagatgctttctatggttgggaaattataggagtatatcaaaatgatactgaagtggctgcagaccctacttctcaaggaaataatataaagccgggatattttaagtttaaagatatgaatggggatgggaaaatagatgctgacgacagaacttacttaggctcaccagtaccgacttattattttggagcatcattgggagttaattataaaagctgggatctttctgttgcattttatggacaaggaggtaataaaattcttgccagaaatagaggggaggttattaaaaatcctggtagaaatattgatgcagaagttgcaatcaaccgttggcatggagaaggaacgaccaatgagttcccatcttctgaaggatacagacaactttggaatcaaaaaatgtctaacttttggttagaagacggcgattttgtaagaatacagaatatccagttaggatatactctgagaagttcttctttaccggaaatgcgatttacgtttactgctgacagaccattcttatggagtaaaagtaaaaatctgatgaatcctgaagtaggtagcaatggtgtagatcagactacttacccaacaccttcagtgtttacttttggatacagtattaaattttaa

SEQ ID NO: 582 - DNA, 1608 bp, Chryseobacterium sp.
atgagaaaaatttttatttttttatttcttttgataggcattcaatgtatgtatgctcaggatcctaaaatagagggtcaagtatgggagttgtttgatattcagtttcattcgcctgataaagctattgaaataggaaaggaaatattgaataaccctaaatctgataaaatagaaatctcatatgcattaattggtataggaacttcttataatataaaaggctcaccacagaacgctgtttcctatttgataaaagcagttgaggaagtgaaggttaccaataattatgaagtacaggcaaatgctaatatgggtcttgctaatacatatatcaaaatggggcttgtagagcaagcggataaatacttaaaagaagctgtaaagtatactgaaaaacaaccggatgcacatttaaaaaatctaagcctttcaaggctataccagtatattggagaaaactataaaaatcagaagaattatgaacttgcaattgccaacctaaagaaagcaatagattatggaagtcaatatgacggtaagaggcttcctcatgaggtacgcgaagaatttgacctaatgtatatgaggctgggagaaatttatttttatgcagaaaaaatagattcgtctgagtgggcttttaaaagatctttggatccttccttagtgattgaacaaactaaaaaacatcggaaggcctatgcctatctatatcttgggaaaatttattcttatagaggggaaaataaaagagctattgatacactttcaatggctataaaagaaggtaataacgaagggctttatgtaaagacggaattgtacagcactatatcaaacagctataaagctgtaaatgactttataaattacaagaaatataatgacctgttcttaaagtcttctcaaaagctgtcaatagaagagaaagaggcgctggaagaatctattaagcaggaacaggtgatgtctgacgcaaaagaaaaggataaaaaactgaaaataatagccttgttgatgggtttagcagtcgttgtttttgtagcatttttcagtatttacaaaattcagaaggcgaagaaaagagaaaagctccttttccagaatattatttctaagcttgaaaacagactggaagaaaaaaataaagatctgatagacttaccggcagtagattcagagacaatcccccctgtcaattcaactgaagaaaatataaagaaacgaatcataccggaaatggtagaaaaagatatattacagaagttgcagaaatttgaaatttccgaaaaatttaccaatccaaaaatgagtgttacctatttagcttcgcaatttgggaccaatgccaattatatttctgaagttgtaaatgatcggaagggaaaaaatttcaatgtttacatcaatgaacttcgtatagattatatctgctcaaagattattaacaatccggaatatcaaaattataaaataagctacttggcacaggaaagtggcttttcatcacatagtgtgtttacaaaaatatttaaaaatgtaacaggcatttcgccttctgctttcatcagccaggcccggggaaaagctcatcaaaaaacctag

SEQ ID NO: 583 - DNA, 1500 bp, Chryseobacterium sp.
atgaaaaaaataattttatttctgggagttgttgtctcccaatcttcatttgcacaggtcggcataagtacagaatctccaaaagcaacattagatgttgtggctaaacctaatgatattaccaagaccgacgggtttatagctcccagattaacgggaaatgagttgaaggcgaaggaccttttatacgggacagatcaggtgggggctattatatatgcaactgctgccgctagccctgtaacacctaaaaccattaatgtagtcactacaggatattattattttaatggaaatgtttggataggacttgcagatacttccagtgagaacggaaactatatagaaccctggtatgattctgctaccaataagcctgctaccaaaaatacacaggatatttatcagatgggcaaagtgggaattggagcaagtagcgctgttacaaaattagatgtccgcgggtctattcgtggaggaagtcctaatgcagaagaaattaacggctcatctcctgttggaagtaattctattgcagtagggaataacaataaggtatcaggggtaagaagtgcagcctttggagatagcaatactgtgaccgggcccggtaatattgtagcaggtaactcaaatattacaggaggctcatataatggtatatttggtattcaaaacaatgtcgaaggagtcagaagtcttattagtggcgctgataatattgtttcaggcaatgcaactggatacaatttagttactgggcttaacaacaatttatctccaattgctgggataaccaatacggtaggaaacatggtaggaggaaatggaaatcagatacaaaatgactattcaatagtaaatggaagtcaaaatataatacatggagattataatattatcaatggcagtacaaactcaacagaccaaacttcttcaagtgttttcgctactggatttcaaaatatagccaacaattcttcttatgttgggttattggggagcaagaatactcttattgacgcaaacctctctttagttgttggcacaaacaataaagtaagttctcctactgcttttgtttcgggagcaaataatattgtaaatacagatgctggatatgctacagtctttgggcttaataatacaattggagggaatggtacaataaattatgcaacttctattggaacacggaatacatctaaaggacatgcttccacaacaattggttcagatttaatggctaactctttttcagaaattgttttaggaagatggaatgaaattgcctctacctctaatccctcaaactggataggagcagatcctattcttcaagttggtattggtacaagtgacacagctaaaaaaaatgcattaacaatatataaagatggaaaggttcaagtaaatcaattgaaagggactggaaatgcttttgcttgtattgatgcagatggtaacttatttagaagtacaacaccatgtatgccctaa

SEQ ID NO: 584 - DNA, 216 bp, Chryseobacterium sp.
atgaaaaaatttaaaaaaattaaggtaagtttatcaagaaatgaaatgaagaatatcgcaggaggaaatgatatggatagcagtgtagatgaaggtgaaggtagcttttgtggtggtacatgtccttgtaatgcaggaggagcgtcttgtggttgtaaaacagtaggaggaagtacgcttggaggaggttatgggatttgtgtgctacacggataa

SEQ ID NO: 585 - DNA, 960 bp, Chryseobacterium sp.
atgaacattcaagaattagtatttaacagccttaatgaagcattacctgaagatgtaatgaacttaattaacgatacggctgtgattgaaaatgtgtttcctgtaaatcacggggaaatttttaacggacagatcttaaaagcggatgaaattatttgccagccagatgcaacattgacttttaccaatccaaatctgccgttttgggtaatctattgtaataagctgaagttaaagaataacagttttccaataaaaatagagattgatcagaccattaatgggaaaaacggaggtaatggactaagaggtatggatggagctaatggaataggggaagttgacagacaagggcaaccgggatcagccggtcaggttggtttagcgggtgaagatggagagttcttaaaaaatcctgatttgtacattattgccaaagagatcatttgcatagatacccttcagaatattgaagactcaaagtttgttttggattttgatggtatcggtggaggagacggtggtaatggcggcaatggtggtaatggcggtaacggttctaatggtaaagaaggagcgacatctgcatttgattgcaaaacaggtcccggcaggggcgggaatggtgctgaatccggaagaggtgggcaaggcggaaaaggtggaaacggcagcaatgcttctgatatttattttgtttcaacagcagtatttacggaagtatttgttaatacatcaaagttttacataagaggtggtaacggaggtgtaggaggtaatggaggcaaagcaggaaagccgggatacggaggtaatggaggtcctggaaacggatggtgcggacgtggttcagatggttcagatgggatttatccggaaccaagaacattaggagatggcccggatggagaagatggcaacaaaggaaatgtatttaaagttacacttaatcacttctaa

SEQ ID NO: 586 - DNA, 1233 bp, Chryseobacterium sp.
atgaatttcaaagttttaactattatttttcttttaataatttctaatttttctttcgggcaaaacaatttttcagaaagtccattaaatgcagtttttgaaacccgggatttcaccaatttttggagagcatttgacaaaatggaaaattcaaaagaaaatccatttaaagagtatttacaaaacggttctgttggtttaaaggcatttccttacagagtaatgagcgcagattctttatatgctaatgttaaaagaaaaaaatctgaatacgaaattacacgaaatataatcaatgacatcccatcgaaagaaaaaaggttacgggccatttatagcgctctgaaatattggtatcctgaagctaagtttccacccatttatttggtttatggcttaggatattcaggaggaacctctacaaatgacggattaattattggaactgaagtcataaaaaatcttgatggtcttccggcacttgctgctcacgaattaattcactttcaacaaaatgttgagggagaacaaactttactgaaacaatcattattagaaggaggagcagattttatcggagaatttatttcgggggaaaatataaattctgcaagtgtacaatatggagaaaaacatcttgacaaactatgtaaggaatttgtcagtagattaaaaagagaagatacacaagactggctgtatcaaacgtcaaaaaaagatgaccggcccaatgatttaggatattggatgggatataaaattgtggaagcctattttaataaacaggaagacaagaaaaaggctattgatgatattctacacataaaagatccaatgcaatttttgaaagaaagtggttttttaagttcatatattgaaagttatcaaaaatccaataatgaagatcccgataaattctataaaatattttcagatgaagtttatcatgtaaccatcattgtaaaagttcctaataaagaagacgagatttatatcaccggaaatcaggaagaattaggaaaatggagtcctaataagataaaactgaataaaaaaagtgattatgaaagaataataacactaaaattacacaccccggcaaaatttaaattcacgaaaggaagttgggaaaatcaagctgaagtttcaggaatagaaaaaggcagtaatatttctttagaaacattaaaacccaatacaaaagtaaaatatgagataataaattggttttag

SEQ ID NO: 587 - DNA, 432 bp, Chryseobacterium sp.
ttggttattattcaaacggcaattattgcagtcaatctattaaatcaaattacaccattgttactattaggtaatgacacttacttgaatacttttcagcaaaaccaactcgcaacactttctcttttgtccttaaatattcaagcacaaggatatggaattggtttagtgttttttggattttattgtatattaattggatatgtaattttcaaaacaaatgcaatcccaaaaattattggattagcctatggaatagcaggagtatgctacttgataaataattttacaatgtttctgtcaaaaggatttgtgaatccgctgttcatttaccttgcaattcccatttttttaggagaactatctctttgtttgtggttactcataaaaggtattgacatatcaaaattagaaacaaaagatgaaaattaa

SEQ ID NO: 588 - DNA, 261 bp, Chryseobacterium sp.
atgatctcaaataaaaatttagccagagttgcagggttttgctacttgattgtaatagctacagggttattttcagaagttttcgtaagacaagcattaagagtctcaaacgatgcattggctactgctcacaatattcagactaatgaaatgctttttcgttggggttttgtggctgacctaatcaattttgtagtgggcatacccacaatattgataatttatcatttctttaaaaagtcaaataagattatattgtaa

SEQ ID NO: 589 - DNA, 153 bp, Chryseobacterium sp.
atgcacaattcgagaaataattctaaaaaaaccaagcaattacgagacgaaaaaattgaccttgaaattattggtaaaggatttattagtttatatcacaacgaaaatgttattagcagccaggcaagaaagcaacctgctcactcaatataa

SEQ ID NO: 590 - DNA, 381 bp, Chryseobacterium sp.
ttgagtaattgtaaagaaaaagacgcaaatcttgaaaatacaaatactaaaaatcttgaatttatcgatgtgaaaattgataacaattgtaatttctattttttattttttagagaaggctcaattattggaaaaataaatacttcaggaaattgtgaaaaattgacaagtgaaatgtattataaaggttatgaaaaattacttcaaaataacattaataaaattccgttgaaaagtggcaaattgatttttgaatttgaatcaaacaataatgattcactttttataaccaaactaaacgaaatatcgaaaaaatatttcaaatcgaaaagtgaaataatatcgaaaacagaaagagaactaacacttgaaataaaataa

SEQ ID NO: 591 - DNA, 279 bp, Chryseobacterium sp.
atgagtaatacaatagaagaattatttcaaaaatttaaaatgggtaacaaagaagtattaactataaggtttaatgcaaactcttcaagttattttacttttggagaagagatagttattttagttgagtttacagatgatgaattattacaaattttgacaaacattagaaatagtataaaaagctacaattatacattaaaagggaaactaattgacacaatggaaaatgtagaaattaatcttaaagaagttattgaaattacacaacaaaaataa

SEQ ID NO: 592 - DNA, 918 bp, Chryseobacterium sp.
atggaatatataattttacttttgattggattagttgtttatctttttatacaaaataaagaaaaagataaaaacctcaatggagaattaagagaaacgcaatctgatggtagtataagggttgggctttataaaaatggtattcaatacggagaatgttgtttatacaatagtagtggaaaattaaaaagtcgaattaatttcgaaaatggtaaattgaatggttcatatataaattatggaataaatgaaaatattatattaaaaggtcaatattctaatgataaaaaaagtggaatttgggaagaattttatgaaaatggacaactaaaatctaaatatgaaatatatgagcctaattcgccaaaaactctaattcagtattatgaaaatggaaaattaaagtttgaaaatggaaaagaatattatgaaagtggtaaaattaaaagtgaacttataaacaagacatttataaaatacttcgaaaatggaaatattcaatacaaacgtgaaaataataatagtacaagagttcaaaatagtatttcattagaacagtatttctatgaaaattcaaaaatgaaagaagaaaaaatttatgaagatactaatcagcataaatacaaatatttacatactcttttttttgaaaacggtaatattgaacaaaaaggaattattgcagactctggacacagaaaagataatttaggatattggaattatttctatgcaaatggtcaattaaaacgtgaaggagaatttcaaaacggcaattcaaaaggtatttggaaagaatactacgaaaatggacaactaaaatctttaggaagttataaaacaagttggcaaaaaactggagtttggcaatatttcaacgataatgggaagataataaatcaagaaaattatgagtaa

SEQ ID NO: 593 - DNA, 177 bp, Chryseobacterium sp.
atgaaggccggcgttactgaagtctttttaaataatagttgtatgaatgtaaacctgacagaaagaaatattggaaaatggaatctccgattatttgcccattttaaaatgaacagaaatataattacagagtataaaaaaatatacaccattattacagataggtattttgcatag

SEQ ID NO: 594 - DNA, 366 bp, Chryseobacterium sp.
atggatcagcaaatacaaaatagaaaattaggacagcctgactacaaaaaaatctatctggatatgatcttaaaaagatatcctcaaaaaaaagaaagatgcaaaaatattctgtctaaagattgcatcagtgttctggatgtaatcatgctggaaaatataattttcgggcataccggaaaggaagatgcgtcattcaatcagaagcataaatcttacgataaagatgcagtttacaaaatattggaatatcaaagaatcaatatgcttaataatacgcaagtatcccatcattttaaaatcagccgaaacacaattgcaaaatggaaaaaaattcataccgtcaggaatttttcaacacattaa

SEQ ID NO: 595 - DNA, 432 bp, Chryseobacterium sp.
atgaatgcaaacctaagagaaataaatatcggacaatacattgaaacaagagtcaatgaattagagatacctatggaaagaatctgcagttttctgaaaaaagaagaggatgagattctgaaaatgtatactgcttcatctttggattcggacatactgcttcgttggtcaaaattgttaaagtatgattttttcaggctttatagccagcatttgattttatatgcccctccttcctcaggaaaaaggatattggaaaatacctctgtcttaccggagtttagaaaaaacatctacacaaaagaagtaatcaattttattatcagcttaataaaaacgaaggaaaaaaccaggcaggaaatcattaacgaatataaaattcccaaaaccacactatacaaatggatcagcaaatacaaaatagaaaattag

SEQ ID NO: 596 - DNA, 519 bp, Chryseobacterium sp.
atgaaaaaaatattcatctcaatatgtgccgttatttccatctgtgttttttcacaggtggcaataggcaagagttcagtgaccaactcgtctgtttcactggagtttggagcagaaaacagggggctgttgttaccctgggtcacttccgcagcaggggtaacaggtgctgtagatggtaccatgatttatgatatcacggataaaaagatcaagtaccgtaaaaacggagtttggtttgaccttagtgtagatgctacaggaactgtgaataccacactgcaggatccgcttgttgaaaaatcctctgctaaaacggcaataggaaccaatgctgccactgataccactccgggtgttttagtattgacagaccttaataaagcaatgatattgcccaaagtggacagtccgcacctgaatatcgtcaatccggctgcaggaatgattgtgtatgataatgtgaaacaccagctggctgttttcaacggaacggtatggtctttctggaaaccttaa

SEQ ID NO: 597 - DNA, 2712 bp, Chryseobacterium sp.
atgaaaaatattttttcagcaattgttttgcttttattttcccttgcattttctcaaacgaactctgatctggagtttagaacgggagccggaaacccgtcaggaaatggtcctgtgcaatcaaccatcattacttttcaaaaaaacacagacaatcccagcggtactactaatgttacatatacacctactttatctgcagcatttgccctacctaatcagcaatatacctttgctcctgttccagctaatggagtgagcatcggaacggctgctaacggcacatcagctaatgcctctgcatcagctatttttggtttaatgaatagtaattctgctcctgttaacaccaatttcacttatgcaaaaggagcagctgcaggaacaggtattaatgtaggcacgaacagatctgttcagttttttacctcaactacaggactgtttttaaataatgaaccgctgcctactcccggaaatgatgtacggtactatatgtctgatcttaccatcaactttaaccggccagttactaatcctgttctgcatattgcaggtttgggaggcgcaatagggacaaatattacattcgcatctgagctggaattgtctacagccggattgacacttaccagattatccggatctacagaatttagtatacccaccactacccaaatattcaattctgctgctgcatattccgcaactaccggagcaggggcagcttctggctctgtagtggttaacggaaataatatcagctcaataaccttcaaagtatatctgaaagcgaaagacccgaataatgctttaaatcctatatggggaacaacaacatccagtagcggggacatcttctctataggcatttccactctggaagatgatttgtcgatcagcaaaacggtagataccagctctcccgtaataggaggtaatgtagtttttactattcttgcttccaataacggaccttccaatgatactaatgtcattgtgaacgatcttcttccttccggttttacctatgtaagttctacaacttctaccggtacctataaccctcttaccggggtatggacaataggcagtctggctgccggaattactcaaacccttacggtgacagctacggtgaaccttaccggaaaccataccaatacagcctctatagttggagataatgcagaccctgatcttgcaaataatgatacttctgtatactcttacccacaaccggattctgattcagacggaatccctgataattgtgaccttgatgatgataatgatggtattacagatttggtggaagaagaatgcgcatcttccggacaaacccttaggataggatatatcccaaattctcgggatttggatgcagataatggatatacttttgatggagcattgatgagcggttcgggagctctaaaattaactaatcctgccaattttggtcctggaggaatcgtaaatactacgattcagttagtaccaattacagccaatcccatcactaaaagcagcattaccgccctgaacttaaataccatttttataggcgggatagatggtctcagctctacttatctctctgctgtagaactggctgccataaaagactggtcagatgattcccctaataatctggtagtagcaacccaatactcaaccacggcatggaactcaacgattgccaattctaatctcaatcctgatcaaccgacagctttaggctctaccactactatttttaaaggaccttttggtacggtgactacttttgatcaaggtggagggtttcagggtattttcagtaatattgatacctcttgtgggactaaggttttagccgtagattctaataatgagcccgtaatttatacagatggtaactatgatgactttttagttggcgatgtagacatatttactactttaggcggagttacttctggaaatgccatcaccagtaacaatgataagctttttgccaatatatgggcaaatgtagctcagagaacactttgtacagctaaagatactgacggagacggaactccggatcgtctggatgtagatagtgataatgatggctgtccggatgccatagagggttccgaaaatgtgactgccgcccaaatttacccgttaaccgatcctctctatccaggacaaataaaagtgaaagcagatgggataaccattgggctgcttccttctcaggtagtaagtacttctatatccggatccggaatccctgaacttgtaaatgatgctgtcaacaactcttctggtaattctggtgctgcagataataccgatggttctgcagacctgggccagggtataggaatatcaacaaatgcagctataagtatatgtttctgctataaaccggcaacattggccggaactgtactagatactaaatctggtatcacagcactgggaagagcgggaacagacaacaacaactggccaatggttcgtaaaggagcctggacagcactggaagccaaaaccaaaggatttgtagtaaacaggattcctctgacggctcaggtagatgccattgctacccctgttgaaggaatgatggtgtatgacgaagaagctgactgcttaaaaatctataccacaaccgataatggaacttcattcagctggcagtgtttcaatacacaaacctgtcctgattattag

SEQ ID NO: 598 - DNA, 1425 bp, Chryseobacterium sp.
atgaatatttctaatgccttacaattttttttggccagcttttgtataagtctgttttcctgtggttattcacagcatcgcaatgaaaaacagatagacagtttgcaagcctatggaagtgttacattaagagaaaaaggagaatatcaaaaactgatcttgctgaatcagcaaataattcgtgagtcaggaaaaatcaatcatgcaaaagggataaccaaaggatatattaatatagctaatgctttatttttattgggaaactataaggaaagcttacgctttctgaaattggcagaaaagcaagattatttacaaaatgattaccgtcttttagatgcattatatatagagtatggcaaaatatacgaccaagtaggtttttatacaaaagccgatgaaagttttgataaagctatctattatgccgaaaaaataaatgatagggattcattgaagaataacagtctggggtatgtatattgttggaaagctttaagtacaaagattaataaacttcctgattcagcattatattatttgcataaagcctataaagcagaaccatttccttcaacagccgtcaatatatcacagaaatatctggaattgaataatatagactcagcagaattttatgtaaaggaggcctggaagaaaattattgtcaatcctgatctgaaataccataaagcattggctctgtggggatttgctgatgtttatttccggaaaaaacaattcgaaaaggccctgggatattatcagcaatcttttgaaatttatcagcagattgatagaaaagaagatatgcggacactttatcagaagatgtctgttacttatgacagccttaaacaaccggagaaatctaaagaatatctgacaaaatatactgttttgaacgatagcctcaataccacacaaaagcaagtacttaatatttccgtggaagattttttaaaggagcaggaacaaaaaaacacatcctcccggcagaaactgtattatattattggtagtataagtgttgttggttttatattaggttttttaggttttcagttttataaaaggagaaagaaagagcaaaaagtaaaaatatctcatcttgaacaaaaagtaaacgtagcatatgatgaggtagtacagcttgctaaaaataatgatcctgcattttttggcaagttccgtgaagtatatccggaattttgtgataagcttttaaaaataaaccctggactcgtaaacagtgagctgaaattctgtgcattactttttctcaacttctcgactaaagaaatagcgacttatacgtttgtacaacccggggcagtgagaatccgtaaaaaccgtatccgtaaaaaactggatatcccttctgacctggatattaatgtttggatgcatgatcccaatcaataa

SEQ ID NO: 599 - DNA, 1503 bp, Chryseobacterium sp.
atgatcccaatcaataaaaatttggtcaattatccctcatacaaattaaacacacagataatataccaggattataataacacaatgatgaatattttaaatatttttttggttaccttttgtataagcctgtcttcttacacttattcacaaaattatagtaaaaaagaaatagacagcttacaaaacaaagaaaacatttatctaagagaaaatggagaatgccagaaaatgatcgtactgaaccagcagatgatccgggaatctgaaaaaattcattactcaaaaggtattgcaaaaggctatatgaatattggcaatgcctttttgatagtaggagattatcagaagagtctgcgttttttgaaactggcagagatgcaggattatttgcaaaaggataatgtccttttaagcggtttatatgtagaatatgggaagatatatgagcaagtgggaatttatacaaaagctgatcaaagctttgataaagcaatatattatgcccggggaaaaaatgatgaaaattcaaaaaaaatgctcggatatgcttacggctggaaagctttaagtacaacgatcaataagacccctgattctgcactatattatttacataaggcatataaaattgagcctctcccatcaatcattatcaatatttcccaaatacatttaaaacttaacaatatggattcggcagaattttatgcaaaagaggcgtggaataaagttgttgccaatcctgatctcaaattccacaaagcaacagttatatggggacttgcagatatctgttttcagaaaaaacaatttgaaaaagcattggaatattatcagcaatctgttgaaatgtatcaggggcttaaaaaaagagaagacatgcgtacactttatcagagaatatctgttacttatgacagtctcaaacaacctgaaaaagccaaggaatatcttatgagatacacagttctgaatgacagcctgaatgtagcacaaaagcagattctgaatatttccattgaaggttttttaaacgagcaggaacaaaaaaacagatcttctcagcagaaactgtattatattattggtagtataaccgttgttgggtttatattaggttttttaggttttcagttttataaaaagagaaagaaagagcaaaaagtaaaaatatctgatcttgaacaaaaagtaaacgtagcgtatgatgagatagtacagcttgctaaaaataatgatcctgcattttttggcaagttccgtgaagtatatcctgaattttgtgataagcttttaaaaataaaccctggactcgtaaacagtgagcttaaattctgtgctttactttttcttaatttctcgactaaagaaatagcaacctatacctttgtacaacctggggctgtgaggatccgaaaaaaccgtatccgtaaaaaactgaacatcccttctgatcaggatattaatatttggatgaatactattgtaaatggagattga

SEQ ID NO: 600 - DNA, 1572 bp, Chryseobacterium sp.
atgaaaaagtatataagtaaagtaaataagataattttctctgcattgttaatcggggctgctgtatcatgtaacaatgaaaattatgatgatgaatttaataaagatgtgcacggaatatataaagcatcttatacagcacttttgtctggggctatcatgaattttggacaaaatggaggtgatgctagtaatgtttatcagatgatgcccatattatattcccaatatcagtctcaggtagtatatactacagaacaagtttatggtgatactcctggtgcatggggcaggttttatgcaaatcaaattaacaatttgaatgcaattatttctgcatattccaataatcctacacctgaggcattaacccaaggaagtgctgctaatatgatcggggtatcgaaaatttttagagcaattatcatgaaaagagtaacggatgcttatggtgatgctccttttactgaggcaacacaggcaacgtcagggctatatctgccaaaatatgataagcagcaagctatatatgaaggaattatagcggatctgaaaagcggaagagatatgctggatgccacatctacagctccgaaaggagatattttatattatggaaatttaaataagtggaaaaaactggctaattcagtactgcttcaggctacattacaattatccaaaaaatttccttcggcaactggatatgcagcaactgaatttaaatctgctttgactaattccgctggagtcattgaaacggtagctgatgaagcttggtttactatttcacctgcaaactcgtatcctaatccttttgctggttttagatcagcagactatcgaatttcgagagagttagtggagtcgatgaaaggatctggtagcacttttaaaagaacatcaaatcatactcctgacacacgactaacattatatgcaagctctggtacaatgacagcggtgggattgccatatggctataattctacagatttagctgctgcaggctattccacatcaggaacttctacagttaatttgaaatttagaagtaatagttcggctattagtttaatgactgctggatacacttacttaaatagagctgaagctgcagcgagaggatggacaggtgaagtggctgctactatgttgactcagggaattactttaaattataatactttagatgatcattatgttttaaatactaatgcatatagttcttcacaaaacccttttgggggaaataagatatctccaaatgcggcagcatatgcagtagcaagagttgccgatatggctacatttggtgctcagagagtaataggtgaagaaaaatggattgctttatttatgagtggatatgattcttgggctgaatttagaagaactgggtaccctgctttattacccgcaccaagtgctgtaaatggaggagtaataccaaggagaatgagatatccgttagaagaagttaattttaataattctaattatttacaaggggttcaggggcttactcctgctgaagataaaaatacatcaaaagtttggtgggatcaataa

SEQ ID NO: 601 - DNA, 219 bp, Chryseobacterium sp.
atgaaaaacaggaaagtattatctttaaatcatagaattaaaagaataatttttcttattttaaattataaaatttttttcatcatttgtgtttttaaggcctccatcaggaggcttttttatttttcgatggcggttatgaaagagacggaaagacatgatattaatcatgaatccgcgactggatatttattccaatctgcttttattgttttgtga

SEQ ID NO: 602 - DNA, 813 bp, Chryseobacterium sp.
atgaaattaaaattgctatttcttactaccattattcctgtaatgggactttcacaggtaggtataaatactcctgttcctcggagtactttggatgtcagtgcgaaaagagattccgcaggtaacattagtgatacttctcaacatttgggtatccaagtgccacgcattaccagagcagagttgacagctagcacagccacctatggcatcaatcaaaatggatctctcatatacattacagatatttccagcggtaatgctacagcaggtacgcaacgagaatttattactgcaataggatattattattttgatgcggtggctaatcgttggctaaaattactaaatagcgaagtagatccgttaaaagcaattgcctatttttcttcagatgtagctggctatcaaatgacaagcagccaatatccaatttacacgaaaattctttatactggtgagacttctgacaatggtaactcctttaatcctgctactggtgtttatacaataccttcggacggcacatattttttttctgcttcagtgcaattcgacaataccacatctagcttaccgaattatactagtatgggacttcgtctagtaaggcaaacacctaccagtacttctgctgtaactcagcaattcaccaatattattacaaaactttattccatgagcattaccggagcagtacaatgtaaagccggagatcaaatctataccatgtttgtagggataactcaaaccgccggtagcaattatcaaattgccgcatcatctctactaggttggaaaattgctaattaa

SEQ ID NO: 603 - DNA, 192 bp, Chryseobacterium sp.
atggctgatatttttttaataattcaccttaccgatctaaatattatgtcatgtataacaattttcacatatacaatatatcacttaaaagtgattgcaattaatcatttctaccatttacccctatataatttaaaatttactaaaaaaatgttgttttttttagtaattcttcttaattttgaaacataa

SEQ ID NO: 604 - DNA, 462 bp, Chryseobacterium sp.
atgattttaaaaaatttacttttagttttttgtattttagctttaaccaccggttgctcaacgaacaatatgtcccgtgctattaccgatacagcttttaacgtaaaaaatgctgataacgtactgattatttttcaaaatattacattcccggacaaaacaattaatgaattaaaacaggaattggacaatacttttaaaaagcacaatgttacttcttcgagtatcatatattctgatatggataaagaaagagaatatgtactaacaaaagccttaaccacatttcattcagattatatactggaaatcaaacattattctacttcttatcttcaatggagtttaatagatgccaatacaaaaaaagaagtatggaaatcctttacaagttatattactgatgcagataagataaataaggcttttgaaaaggaatattttggtaaaaataatcattaa

SEQ ID NO: 605 - DNA, 513 bp, Chryseobacterium sp.
atgaaactaaaatttttactacttgctgtggtaatactattctttaattgtagtaccgtaaaaatgaacagcaatgtatcttctgattttaaagacgcgaaattagacaaagtacttgtcatttttaatggcggacaatcaagaaaaattgaggatacctttatttcaactatcagctcggaattaaataaacgcatggtaggaaataactcattagctataagacctgccatgctgaactatgaaacagcattaaaggaagctgaaggaaaatacaatcccaactacatcatgtatattaattatatgcaagttactacatggtctgacggaacagctgttgccacctatgatgtgaacatcactgataaaaaaaatgattatgctatttataaagcaactgtaacacttggaatcaatatgtttacagaaaaaagcggcggcgaaaagctggctattaaaataattaatgatttagcaaaaaataatctaattccaacatcacaaaaatga

SEQ ID NO: 606 - DNA, 1443 bp, Chryseobacterium sp.
atgtaccgttttattttacccttttttttgttactatcctgtgtattttatactcagcagctgtctcctgcagaaatagatcaattgcagaaagataagtataatcaatattttcaggaagaaaaattctatgaaggcatagagttcagtaaaaaaacaattaagttgtcagagaaaattaattatgctaaggggcaagcacggggatatacttatattgcgggttttctgcattccttaggagattataatgaagtgctgcaatatctgcaaaaagcagaagacctggcttctgaatacgaagatgacccggttttactatcatcattgtttacattgtatggaaaaaattaccatgtattgggtttcaccgaaaaatcaaatgaaaactataataaggcattaaaagaggcttttaaattaaaggacaaaaagcagaaacaaaaacagctgcattttatttatggaagtaaagctgtcaattttggattgctcaaggataatgattcaatgtactattatgtccataaagcatataaaatttctccccgtgtagtggaagcaacaaaccttaccgattactttattactaaaaaaaagaacgaagattctgcaaaattttacttggataaagctgaaaatctgttaaaaatatctacggcaacatttgattatttggtgtttaattatatgtcgggccagtattataagaataaaggggagtacagtaaagctttgaggttttatgaaaattcccttgaagcgtccatcagaatgaagagacctaaaaatgtaatgaagaattataaaggcatagctgaaatatatagttctcaaaacaacatttataaagcgaatgagtatttactgaaatatacaaaactaagagatagtttagctgaaaataatgtgttagctatacatgctaccgaaaaaaaaattattaatgatgaaaagaaacagagccaaaattcaaacatgaagttgtattatattttaggaggactgtttttaggagttattattataatcagtgtgctgagtttttcacattacatgaaaaataaaaaaaaagactttttgcttacgaaaaatacggcagctattttacagcaagatcagcaggtaaaggagcttaagaaaaaagtaaatgaaagtttcgaagaagtcatacaactggcaaaagaaaatagcccggaattctggggtcgctttcaggaggtataccccgattttcgcggaagaatattgacaattaatcctaatttgaaaacctcggagcttatcctatgtgcctatatttatctgggatttaatacaaaagatattgcccaatatacttttaaagctgtacagactataaaaaataataaatacaaccttagaaaaaggctgaatgttcctcagcaagaagatttcatattatggatgaggataatttaa

SEQ ID NO: 607 - DNA, 141 bp, Chryseobacterium sp.
atgcctattaacaaaagacttctgcattccgtaggagctgtagaagaacattactatgccggagactatattttcctcgaagatggcacggcacaccacaattctattaccaggttgttgacagagacaagcaaagtataa

SEQ ID NO: 608 - DNA, 957 bp, Chryseobacterium sp.
atgtctgctatattattaggatatgctctggtattttattttgtaattaaagacaaattttttgcagcctgtacatttgcatttggcgttatcatattttacacctttatgatcagtcgtaagaattataatgtaaaaacacttgtacatctttatcttacttatgctcctttatttgcaacatttgtaatgctgggcttttggaagtattctgcagctacatgcatgtggcttttacccgttcctcttgcagcccatattcttttagataagaaatatgtttacatttattcagcctacattttattgataataatctcagtaagtattttgactagattttatgattttaattatttcagtcttcaaaatatacagtatataattatttcagatactttcgttgggattgtgagtattatggtatgtggccttttattatactacaatgaaaaaatacgaaaagtagaaattgaagaaaatattttaaacaagataaaattttcagaaaatacggaggaggagcaaataaatgtaaattctacaacaattcgagaatattctgagtttgaaaaaagtgaaggtgtatcctctgagaaccttgggaaatatattgctttatttaatcaggtaaaaaatgttgtagaagaaaagacacttttcaaagagacggatttttcaatctcacaattatctaatattttaaaaaccaataatttatatatatcaaaatctatcaaagcaaatgggtattcaaattttaatcattaccttaatgcctgcagaattcgaaatgtaaaaaagctgatccaagagaatgatattaacaaagtcacattaatgtatatttatacggaagctgggttctctaatcaatcaacttttaatagggtatttaaacaaattgaagggataacgccgtcagaatatataatgacaataaaagaggaaaaataa

SEQ ID NO: 609 - DNA, 354 bp, Chryseobacterium sp.
atggatagaaaaatacagaaaataaacgaaggaccggactataaaaaaatatatactgacttgattcagctgaaatttaaggaaaaagaaaagtactgccaacctattctctccaaaaaaaagctttcgatattagacgttattcgattaagtgaaattatttcttctcaacaagagaaggaaataaaaagctttaatcagaagcatcgcgcttataatgagcaggctattttacaaatgctaaattatcaggtgataaataatttgaataacagtcaattagctgttcattttaaacttagtcgaaatacagttacaaagtggagaaagacttacaaaattgccaattcttag

SEQ ID NO: 610 - DNA, 429 bp, Chryseobacterium sp.
atggaaggtttcaaagagattcatataggaggtttaattaatctggcagttaaagaaaataaaatcacatcatctcatatctgtaaatatttaaactgtacagaaaaagatttgtattcattttatgaagataaagatattgatacaggtatactcttgaagttgagtaaactgctgggatatgatttttttaggatttattctcagcaccttatattattttcaccaccatctgcaaataatgaggatggagcaaagaatagtaaatcagaacttccgaaattcaggaaaaatatttataccaaagaagttatcgacttcatcttagaattagtagagacaggtacgaaaaccaaattgcagatcatggaggaatataggattcctaaaacgactttatataaatggatagaaaaatacagaaaataa

SEQ ID NO: 611 - DNA, 1458 bp, Chryseobacterium sp.
atgaaatatttttattcttttttattaatagctctcttttgcataaaaattagttcgcagaaaagacatttttctacaatagacactttattgactaataagagttttgaattagtaacaaacggtcattttcaggaagctattatgttaaataaaggtttaattaaagaatctgaaaatttaggctatgaaaatggtaaggttagggctattattaatttgggaagtttatatattgtgatgggcaagtatgaagagagcttaagaaaattaaaatgggcaagtgatcttattgataaagcggatgatccttttctaaaggtaaagctttatggggagtatgggcgaaattacagcgtgcttggtctttatgagaaatcaaatgagatgctggacaaggcaataaaaataagcagtactctaaaaaataaggaacaaagaagcagagtggggtatctgtattctattaaaatagataattatgaatccaggaaaaattatgattccatgtatctgtatcttaaaaaagtttataatgtcagaaaaaatcctcataattctgccagaatagctggcttttttgtagataaaagaaagaatctagattctgccgaatattatattaatcaggcaaatgatatcttttctctaagccctactccagataacaaagcttatcttttactaaacgaaggaaagctctacaatgaaaaaaaagaatacgctaaagctattgaagtttatgaacgtgctcttgatatcgttaaaaaaaatcatttagagaatcattatagcattattttaaagttgatatctcaaacttacaagaatcttggaaacaggtatagaagtaatgaatatcttgaaaggtatactgtattgaatgatagtctgaacatggtgaaaataagatctatggattttcctgtaaaacagattttagaagagacagatatctctaataataggcagaagaaaagcctttatcttgtgatagttttgattttttctataggtatcattgtacttattttgttttacataaatcagagaaaggcaaaaaaggaaatgaaattgcatctaacccataaagagagtcttatatcaaaaaaagatgagaaaattgaggagctcaattcaaaagtaaatgagtccttggttgatcttattattcttgcaaagaataatgattcctcattttttttaaagtttaatgagttttatcctgaattttcaaagcgacttcttgagatcaatcccaaactgcaggtaagtgagcttaccttttgtgcctttatttttcttcatttttctaccaaggatatttcagataatacttttgttacgataagtgctgtacagcttcgaaaaaatcggcttagaaaaaaattgaatattgattctgatgtagatctttatttgtggatgaatgaaattgtttatccggttaaatactaa

SEQ ID NO: 612 - DNA, 141 bp, Chryseobacterium sp.
atgactaataacactgcaaaagtgattgttacttcaggaggaaatgtgggaataggaacagcatccccaacggctcagctacagactacggggaatatgattttgggaactgcaaattctactaacggagcagcaggataa

SEQ ID NO: 613 - DNA, 204 bp, Chryseobacterium sp.
atgatatttttatttgcctcaatttttagaaaagagcaatacagtaattccgactggagatctgctgatggtggttccgttgaggctatatcggttaatatttattctgcaaatggaagtctaaccagcaatagggcggtaatacaaggtgctaataatttggtagttatagggagtcagactaatgcattctcagtagactaa

SEQ ID NO: 614 - DNA, 1050 bp, Chryseobacterium sp.
atggactatactgcaggcaacaaccagaaatggaaattgtctcaaacaggaggaaattataaaataatcaataagaatagcaacaaactggttgacaacccttctagttccactgctgacggtacagtaatgatccaatatggcgatactggaggtgcaaaccagcaatggcaattagtggatttaggcacgggatattataaaatcataaatgtttcaagtggcaaagcattagataactcaggatccagtacaacaaatggtacaaatatagtacagtggacttatggaggagggaataaccagcaatggcaaattgtagaagtatttgatccggctaaagattataaaatcataaaccgtgcaagcgggaaatctcttgatgtatattctgggtctttgactgatggagcgaaactgattcaaatggactatactgcaggcaacaaccagaaatggaaattgtctcaaacaggaggaaattataaaataatcaataagaatagcaacaaactggttgacaacccttctagttccactgctgacggtacagtaatgatccaatatggcgatactggaggtgcaaaccagcaatggcaattagtggatttaggcacgggatattataaaatcataaatgtttcaagtggcaaagcattagataactcaggatccagtacaacaaatggtacaaatataatacagtggacttatggaggagggaataatcagcaatggaagattgttgatgtggcttcttcaactggaaagatggccggttctaaaacgacattagaccaaagcaatactattgataagcctatcgtatatccaaatcctttaaaaagcaatacgccactaaaaatagacgtgccggcaggatgggaaaattcgacattatttgtattcgatagtctaggaaaattaatggtaaatgctacattaaaggaaggcgtaaacgagatgttacttaatgtatccgccggggtttactatttgaaaattgtcaatcaaaatgatacttttagtacaaaacttcttatgaaataa

SEQ ID NO: 615 - DNA, 1368 bp, Chryseobacterium sp.
atgattatgagaaaaaactttattctaaggctatttttactagtagccgtcagcattttgctgtattcctgtgttcatgatgagattaatgcctctgttgatcccacttctaaagaatacgccaacaaaagtctctggaaagaagatgagaaatacattaaaaatgtaatgcagatctatcaggagcatgaaacagaaatcaaaaaaacaaacggaatacctctttgggattatgctatgaccatgggacgcactgatgaaagctttctgattgttcctgtagcagtagggaataaggtagtatcctgtatacaggtgccaagaaacggagaccagattaggtttgtgtatgataatgatcccgggcatatcaaattttttcagggatatactaccgcaaaatacagaaaacctctggatcagactaagccccaggcttcggagacaggaagattaacaatgtgcagtgtaagtacggtatcagtatggtatccagacgatgagagcaatccttatcctgattcaggatcagggcactgggagacccagtatattacgacctgtacagaaaatccgggagacgggggaaatccggggtgtagcggatattatgatgcacagggaaattgtgtatcttcgggatctcagggtccttatcattatccgggagggggtggaactcaaccgcaaccgcaaactccttgtgagaaaattaaaaacaaattttccagtgatgtaaaatttaatgaaaagtttgctagcatgacagctccgggggtatttgatctggatcatgagctggctgcatatatgaggtatcctacaataggcacaaatacaccaccgacatttgtaaatgtagatatgtcctcatgttctacggatggtgatctgccgacttttacggaagggatggccggattgatgcatactcacaataatgaaagctgtaatggaggaacacccataaaagtaccgtcgcctacagatatacagacatttttaaataccttgcttccggaagcggggcagtatgcaggcggttatgacagtgcatactctatagtggcgacttccggaggaaattatatgatagtctatagtggcactaactatccgggttctatgaactataatgaatggaaaagacttaataaaagttatactgatgcatttcaagacttatattctgataaagaaaatgttacacaggctgatcttgaaagagtattcactaaatttatgaaagaagaagtgaacagagagggcttagaaatatacaaagtaactgcaaattcttctacaaagctagaatataatcctaattccccaaatatggtagcaacaatcccttgtcccaatttttaa

SEQ ID NO: 616 - DNA, 2511 bp, Chryseobacterium sp.
atgggaactcagggacaatcatgttatgcaggagatgatagtaatacttccggttttttatatcccagaacacctttcttttttgattgtcattccctgcaaaccaaccatattaaagtactgaagagaataagttcaaataatgttaataatggagaaattcttttttcttataatcaagatcatgtgtcatcttctgggtataagcttttaactacaattgaaatgaaggacggagggacattacctaaaatcatagaaaaaatccagctggcctatcttaacactgcaaacaggcatttcttaaaaaatgtggagtatcagaattccaatcaaaaatatcagtttgagtataatagtgcacaaagtcttcccaataggctaagcacaagccaggatctgtggggatattataatggggcggataatgggacatattttgttccaaaagaagcaagtgtttttaagattggggcagatagaagtgtcaatacggagctttcgcaaaagggaatgttaacgaaagttacttatccaacaggaggtgatactacatttgaatatgaaccgaattctttttggggaacaaaaagaacagttattccttaccagtcatttgatgagagtgtcaattatttgacagcgggatctgtcgtgaacggatcattttatacttatacaaaggactttaattctggaaacttagatcaaacagagccggtgaatataggggcctctattatgttttatgatgagacgatctgtccgccgttttatgatcctaatattcctgaaaagtctgatttgtcagcttcaatttcactttttgatattgatgagaatcaatatataagcatttatcaaggggaggcaaactatcaaaatgtcaattatatgtcattaagggtaaatgcagagcctgctgctacagttaaggccttgttgaaggctaaccataattataggttaacggtctcatctttcaaatgcattagtatagattttggactagcaagttttacttcaacagctgagcagatggatctgccgactggagggactagaataaaaaagcagatagataatgcaggaagtaatcccattattaagagatattattacaatacatatttggaaaaaaacaaatccagtggggatgaacctgaaactccttattttttccgttcttatgaagatagggtgtattgcccccatgatcctactgtaccatttccaagttgtacttactcttcacaatatgttggggtatttcattcttctccaatcttttcattatttgatacctctctgcatagcaatatattttatgaatatgtgactgaaagtttaggaggtgataatgctgaaaaaggaagaattgaacaccagttcaggattgacagaaatgcttcatattctacaattcatacaggaaattctcttctaggagttggaggaggaattctaagttcaggttatagcaatacagggtgggagcatggaaacgaattagagacaaaatacatttcaaattcaggacaaaccaataaaattattaaaaggaattttgttaaggaagtaagggataatacaaagtatcacaattttatcttcaaccaggtatttctaagaaaatgtttatggttagatactgatcttggcaatatgaatgttggttactattttaaagaagcctatcgtaatcttttaaatgaagaagaaattaccgattatgtgaatgggaacattgctttagttaccaatacaaaatatttttataaccacccatctcatcaccagctaaacaaagaaaaagtaactttccctgatggaactattggggagaaaaattacagctatgcccatgaaaaaaacaatcaatatttaataggaaaaaatatggtagggattccattagaaactgctaaaacccagactattggaaacagcacaaaaatactatcaaaaactgagactctttatcctttaaaccaagccgaagcagatacaaaaacatcaggactagctttacctacttcaattttatcttatgatttacaaaaccctacagtttcatccacagaagtcacatataacaaatacgattccaaaggaaaccttcagcagtacacgacaaaagacggtatttcaacaaccattatctggggatacaaccaaactcagcccattgcaaaaatagaaggcgcaagattatcagatatttcacagtctgctattgatgctattgtaaatgcttccaatactgatgcaagtgcggtttcaaataatgatgaaacttcatttttagatgctttaaaaacatttaaaaatagttttccaaattatcagatcaccacttatacttatgatccactaatcggagtaagaagcatcaccccaccatcaggaatcagggaactctacaaatatgatacggccaaccgtcttgaaaaggtgatcgacatcaatggaaaagtattgaaagaattcaaatacaactacaaaaactaa

SEQ ID NO: 617 - DNA, 507 bp, Chryseobacterium sp.
ttgcctcattacgaaaaagtttataattttgatattgaaggcaatgagaattattatgtgactgaggatggaatcctggtgcataatgggtataatttaaaaaataagcctaaaaattcaccaactcctaaaaaatggatagctaaaggtggtacagttgaagagctgccagatggaacttggagatatacagattgggaagggaatgttgtagattatgtaaatgggcatcctgtcttcaaagaaccgcatgttagacaaagtgttgatattgatcagcagaagggaaattatacttccgattacacagatgctgcaaataaatctaaattagatcctcctaaattaccaaatgaagaaacaacatgggatcatcatcaaaatggtaaaactatgcaggaggttgataaaaaaatacatgacagatttactcacaatggtggagatattgctaaggttacagaaacctatatatcaaggtaccagtcaaagacccgtaggatttaa

SEQ ID NO: 618 - DNA, 297 bp, Chryseobacterium sp.
atgaataaagcaatagagcaattgaaagggctcttagctgagttttttaaatattataaatacaaagatgccattactaaaatcaaagatttaaaaatgtcaggaaagctttccgaggaagtatggaatgagattaaaaatctaattaatgaccgggatctaccacaaggacaagctttgagtcttgtcgcttttgatgctaatttaccacttgatgaagatactgaagatgaagcgtacaaatggttgaatttatttataaataacattgatagtaacgaaattgttgaatattag

SEQ ID NO: 619 - DNA, 270 bp, Chryseobacterium sp.
atgagtattgatatagcagcaaaattcgtaggcaacaaagaaatgctcagagagaaattgaaaaaatacatttattctgaagatgaaaattatgatgaaataactttatcttttttaaataaatggatttggatatatttttatgatgaaaatgaaagcttttttttagatataaactttagcaaagactttataaaagaagaaaaactaatgtttacagatattctaacagaacttgattttcaaattgacgataaaacaaatatttag

SEQ ID NO: 620 - DNA, 240 bp, Chryseobacterium sp.
gtgttttggcttaaactggatctttgtattctaaaaaaacggaaatctgaaaattggaggagttcaggctaccagcttctgaaaagccatgaagagttcagatcgatcccggtgatttatgttacagccaataatgatatcataaggctggcccaagaggctcaggctgatgattatgtggcaaagccattcaatcttgatgatctggaagaaaaagtggctcaatatttacaggaatag

SEQ ID NO: 621 - DNA, 516 bp, Chryseobacterium sp.
atgaaaaaaataatgacagcagcggttctgctttcagccgccgctatgaaatcgcaggtcgcaataggtaaaagttccgtaacgaacagttcggtctctttagaatttgcaaataccgcaaataaggggttaatgctcccttatgtagaaaataaaagtactatcacagtaaatggtaccatgatctatgataccacagacaaaaaagtaaaatacctgaaaaatgggagctggtttgaccttagtgtagatgccacaggagtggcaaatattgctattcaaacgacaaaagcagagcggactactgccaaaacagccataggaaccaacgcagcaactgacgccacccccggagttttggtgcttaccgataccaataaggcaatgatattacccaaagtggcctcgccgcatctgaatatcattaatccaagtgcaggaatgatggtatatgataccgtcaccaaagaacttgcagtatataacggtacggtctggtctttttggaaaccataa

SEQ ID NO: 622 - DNA, 897 bp, Chryseobacterium sp.
atgaagaattttaattttaagaatatcagcaggctgtttttactaactatggtatttctactgggagcaggctgtctcagtgcacagacctgtgatgcttcaaccgatatgccggtaggcacccctaccactgtgaacggggttaccgtgacaagaactctttcaggaaatacagctttaagtggtccatttcccgcaaattgtgtaagctggtccaccctcaaccctggtccatatggcgttgcttttaatgggggcagtgttatctttaatttcagtgtacccgttaataatgtagtggtacggtttaatgctcttaacggtcttgtcactcctgttgaagcggccacctttacgacaaataacggaacggtaactaccagtacaatcagcagctgtttacttaccaaaaccggcaatacatatacctataacggtcctgtgagtcctactatttccggtgatggtgttgtcaaggtaacctctactctgccgtacacctcgcttacctttacagttaccggcgatggtggtaacggcggtgcagtaccagcactctgcagcttgtctattgtacctgcagcctgctacaaaccgggagtggcaggtacagcactcaatagtacaatgggaatcacttccttaggaagagccggagctcaggatgcggataactggcctatggtaagaaaaggagcatggctggtattagaatccaaaacaaaaggttttgtcctgaacagggtggctttttcaggaggaaatcccgtaggcattgcctccaccgattttatggaaggaatgatggtgtatgataccaccaataactgcctgaagatctttaacggtactgcatggcagtgctatattacacaagcctgtgtagattttccttaa

SEQ ID NO: 623 - DNA, 996 bp, Chryseobacterium sp.
atgacaaaaacacacacaatgaaaagaaaaaaaaatctaatgaaaaattttaattttaaaaatataggcagactggttctgccggtgatggtatttttactggggacgggtcatctcagtgcacagacttgtgatgcatcaaccgatatcccggtagatacccctaccactgtgaacggggttaccgtgacaagaactctttcaggaaatacatatatagaaacagctacagcaagttcaccacttctctcaaattgtgtacatataaccaaccctggtgattatggcgttgcttatggttcttataatgatggttttagtggcggtggtgttgatggtagtattacctttaatttcagcgtacccgttaataatgtagtggtacggtttaatgcggctaataatttaagccttccggcagaagcagtaacctttacggcaaacaacggtacggtgtctaccagtacgatcagcagctgcaatgttgctaaaaccggcaacacgtatacctctaatgccgttcctccctcgtatcagcccagtgattctggtgatggtgttgtcacagtaagctctacacagccgtacacctcgctcaccgttacagttagtggtcacgtttccaactatggtgttgtagtagcactctgcagattgtctgtcgtacctgcagccccatctgtatgctacaaaccgggagccgcaggtacagcactcaatagtacaatgggaatcacttccttaggaagagccggggcccaggatgcagataactggcctatggcaagaaaaggggcatggctggtattagaatccaaaacaaaaggttttgtaatcaacagggtggcttttttggcaggaaatcccgtaggcattgcccccgccaattttgtagaaggaatgacggtgtatgataccaccaataactgcctgaagatctatgacggtaccgcatggcagtgctataacacccaggcctgcgtagattttccgtaa

SEQ ID NO: 624 - DNA, 504 bp, Chryseobacterium sp.
atgtcaaatataaccaacaaccgcatcagcagtacgcttaccgatgcacaggtttcagcggcaaaagatgcagtacagacaatctatgccaatcttccttttttattgggacttacggtagaagaaaggatcagtcttcccaaaataaatgtagccaacaaggcttttacggaagatgctatcaatgcggttgtcaataatgcaggaatgcttcccggttacctcagtgttagcaatatgcagacagatctgcagctgtttacccagctggatgagcttactggtctggtgcgccagctgctggaaaagctggaagacacccaaatattggcagggagtgaggcctatgtatcggcgcttacggggtataagctcttcggagctgctgcagaagcaggaatcccgggttcggatgctgtgtatgacagccttaaagcaaggtttacagtttccccgtcaacaaatataaacacaaatgccaatatagagaaccccaccctatag

SEQ ID NO: 625 - DNA, 1395 bp, Chryseobacterium sp.
ttgattttttgtttgtttctcttttccattagttattctcaaaactatacagaaaaacaaacagacagtctgcagtataaggtgacagcttttctaaaagacaatggcgaatatcagaaattaatcgtactgaaccgcaaaacaattgatggctccaaaaagataaaatataccaaaggaattataaaaggatatattaatattgccgatgcattgctgtcaaagggtaacagcaatgaaagtttacggtttcttcagcttgcagaaaagcaggaggagatcaaaaaaagtaacaatctcttatgtgaactttatataggatacggcaaaaattatgaaatattgggactttatgagaaagcagatcaaaatttcagtaaagccatctattacggacgcaggataaaagacctcaaacctaaccgtatactcgcctatacttatttatgcaaagctcaaagcgaagcaatgtttaaatttgcggactctgttttttattaccttcataaggcctatagaatagaacactctccgctgatggcggcaaatttatctaccgggcatttaatgtttaatcatacagattcatcagattattatataaaacgtgcctatagtgagctgggcagatcaaatgattttcccaaccctaaagctcagaaagggacagttctttctcagcttgcacagatttattttgtgaaaagacaatatgaaaaagcgctggaatataatctgcagcttcttgaatattataaaagcatgaaaaggccaagagacgaaatgtcattttgccttcagatttcgaaaatttacgacagcttaaaaaataaaaataaatcggaggaatattttatcaaattcaaaaaattagatgacattcttcgttcttcccaaaatctagcgctcaatacttctgtttctcattttttaaaagaacaggaacagcagaatgaatccggcacccaaaaactatattatattataggaagcattatagctgttttttgtttattaagcatattgctttattggttttataagaaaagaaaaaaacaggagaatgtaaaaatacagcatctggaaaagaaagtggatgcatcgtatgatgaagtaatgacacttgctaaaaataatgatcctgcctttcttggaagattccgcgaagtctatcctgagttttgtgacaaattattagaaattaatcccagcttaataaataatgagctgaaattctgtgctctgctgtttcttaacttatccacgaaggaaatagcgacttatacctttgttcaggccggaactgtaagggtccgaaaaaaccgtatacggaaaaaactcaatatactttccgacgaagacattaatatctggatgaataatattgttaattaa

SEQ ID NO: 626 - DNA, 1083 bp, Chryseobacterium sp.
atgaatcatctgaagacgggtaatgcctattttgcagagggaagctataaaagcaataagtacaacggtaaagaacttcaggaaaccgggatgtacagttacggatggagagaatatatgccggatattgccagatggaacgggatagaccagttggcggaagactatttttctacaagcccgtatgcatatgtactgaacaatccgatcaatatgtttgatcctgacggaaggacagcagcattttcagagtggcagacaatgtgggatcaaactccagaaggcaccaattcttactggtttaataacggttcaggatttaccagctacgatggtggacctaggggaggaggtggaagcctgccttacaattccactgtaagctatggaggtggttttacaatgggagacgggacgtatgcgctgcctccgattatcataaacggccaaggaactgcttctacatggaatatgggaggtaactattttcctaatggtatggccatgatgaatgggttcatgagagcctctgaaaactggactcatcaggtaagggctgatgatatggcatggagactgtctggggtaagggctgacggacctatcgggtatattggaggtgcaggtgatccggcgggtatttttgatattggtgcacagctcttaagtaatatgaagcctgaaaaccaagaggcagcgttaggcttagccgctattgcagttattctcactaaaggtaaagctgctccggggattattaaagctgaaacgaaaggcgctttttctgttgctgattggtcaatgtatccttccgccataccaaaaccaacaggaccatttaaattacttgaaggagtagaatatgagaccgccagaaaagctgcaaatagagctaatcaagcaattagaaaagcaaatccggaagcatataaaggattggaaattcatgaaatacatcctgtgaaatatggaggtagtgcaaccgatcctttaaataaaatagcaattccaagagattatcacagaaaagttgttactccttggtggaatgataatatgagatcaattaaaaaaataccataa

SEQ ID NO: 627 - DNA, 330 bp, Chryseobacterium sp.
ttggtgcataataattgtgaatggttagaagcaacagtaggccaagcaaaaaattggatttcaacagaacctggaatgcaaagtgttaaggctgtagatgatatagcaggggaattggctaaaaatgacccttttgtatttgcccaaccaataaaagttgttgaggctgaaggaaaaacatttattttaaatggacaccatagaattgaagctgctattaaaatgggatatgaaggtttaattccatatcaaaaaataccagcaagtcaaatttcgcaacattcaggatttagtagtataggagaacttataaaagcatttgggcattaa

SEQ ID NO: 628 - DNA, 348 bp, Chryseobacterium sp.
ttggtgcataatgattgtggacttcctcaattattttcaagaatagaaagtaatattataggtggggaattcagatatgcaagtggagaatcaattgagtttttggcaaatcacaatgtgaaaggtagcactttagaattaactgaaatggctttttatccaaaaggagctttaggaaatgagatggctaatacctttggacagagacaaatgattcaaagttttaaagttctacaaaattatgcaagagaaaatggctttagtcatttaaggcttcaatttcaacgagcacctaatagctcctctgctaatccaggacatatttttgaccaattatttaaattataa

SEQ ID NO: 629 - DNA, 597 bp, Chryseobacterium sp.
atgaaaaggatattattatttattctaataaactgtattgttattacttactcacaacaatacattaacattggctctactaaagcacaagtgaagaaaatacaaggtgagcctaccagtatagaaccttatgagactgttggagaggaaatttggagatatggagaaactggtatagctacagttacttttaagaatggtaagataaaaggctttaaaaactataatggaatattgagaattggtgatacaagtaaaaagcctagtaaacctgaaaagcctagctctaaagaggaactatggaatagactacaaaaaaaggctgataattataagtctacagatactatcaatacatctagatcaattacaggcttgtatggaggtagtggacaaagtataaagacctttccaaaagagtatgaggaaatggcagaagctaatggattaaatccttatgcaatgcctgatgatacagatctccaaaatatgcagaaggaatatgaaaggaagaagcttttaaaatgggtattaatcattttaggagctataggatttctattcctgatatttaaacttaaaaagaaaaagaaatga

SEQ ID NO: 630 - DNA, 1155 bp, Chryseobacterium sp.
atgagaaatgcctatagtggttatacatatcagaaacacataacattacttttgttatccattatggatgctgaaagaaatatctcctgtattgagattgaagctaaagtagataacaaatttgatgaccttaaaatatctgttaacaatgatatactgtactttcagatcaaggactttgaaactattaatatatctgatctaattatagaaaatggagaacttttaattaaaggtaaaccacacaaactttctacacataaaaatattttattctttaaacacattgacattactccaaactctaaaatcttagattttgattgttataaattagaagatgtttacataatttctctgaatcgtaggaatgttgatatttatattgataatctgtataatggaaatctaaacagaagatatgagattgaagcttttttaagtgatttactagatgaaagaatatggaaaatagacaggattaatttacctgtattaaaaacatttaatactgatctacaagaggattctgtaaatattagtcacaaactgctagagtttgaaaagattcttctaatagaaggcaagccgggtgttggtaaaagccactttgtaaattcattaactgaattatatcctcaacatgtactctataggttctgggttggaaatcaggatagagattatctggaaagattaaagttcaaaaatttcatacaagatatacttataaaactatttcatgacttaaaaaaggatagatcagtttctgatctatttcaagaagttaaaaatagaaaaattacttttattatagatggtttagatcatattgaaaattataataaagatgaattagataagttcataggcttcattacagatttaaaagaacattgtaatgtaatagttctatcaagacctctagttacagaagtagaatggaaaaaacatactttagagaattggaataaaaagcaaactgaacgggttttagatgagttatttcatataagtgattattatacacaaaagcagatattttatttaactcaaggatatccgttaacaagtataaaaaaacaagtgaagagagatttaaagacggaattttatatattgaagatattgacttcattaaggacaagaaactaa

SEQ ID NO: 631 - DNA, 147 bp, Chryseobacterium sp.
atggattacaattatattctatactatactcccggaaatgttttatatatgattgataaatatgggaataagaaagattttgaagtagcagttaagagctttaagaaatttgttgatttatcattaatagatattcattataattag

SEQ ID NO: 632 - DNA, 1416 bp, Chryseobacterium sp.
atgtgtagaatatattgtgatacaaatatatactctataattttcaataaagcacataaaagctatacggaaagtttagaaactacttttgagtctttcaaagacatagttttattttccttttcagaatctcatattatggatttacataactcaacacaagatatgagagataaacaattagttttcatggagaggtttgtaaaagataattattttacatatgactctataaagaaagaactgaattgctatcttgcaacacccatgcaagtttatgttgataaggattttaatacttataacacctttctgagtaatcctttagatattgataatcttctggatttaagagaggacaatgaaagtgaaagactatttaaagacacaattgattcactatttaataaaccatttgcaaacctaattccaatacctaataatttagatgataaatcattggagttttataataaattcttccctcaggatgaaaatttaagtttaggtagttttctaaatcatactttaaactatggactagaacttttaaataatgcgaaagaagttactgacttaagaaattatgttgcttcttacattaatagggatgaatacagctttgaaaagtggggagaggagtttgatattaagttaaaggaaacttcttttaaccagactttctctgagatatttaaaaagactaatgaaataaataataaacaaaataattattatgatagctttatactctattataatttacttgagttattaaacgttacaaaagaaaagtcaggaggaaaaaccaaaaaatttaatttaagtagccttaatacagatgctaatcatgcttattatgcgtcaatgtcagattatcttgtgacagatgataaaggcttgcaaattaaggcttttcttgtttataagtattttaacattcctactaaaatactatcctctaaagactttgtaaattacagaagcattcttttaaaccaagaagagactgataaaaatagattttttgattcgctcatacatgaaatcaatacagctcttctattaatagataaatttgatttagaaaccaactcaaatgtcaaaacatacaaaccaagttatgtgttttttaatttctttgatagatttcagacagctttaaatgataactacactaaagttgttttatatagaagaagacttggatatttatatagagagttagaaattcttgtaaacaaacttattatgacattaggcttagatatacataatcaaggattattcgattttgaaaatgaaaaagaatcagagagtagtataattagagagtggaaattaggtaaggcagaaataattttagcattttcagaaagtaatcccaaattatttataacaatctttaaatcttaa

SEQ ID NO: 633 - DNA, 435 bp, Chryseobacterium sp.
atgaaaatatacagtggaataataaaagaaaataatttagaattagatcttgccttcataggaagtagcctaagtattgaacaaattttatttttaatgaaatcattaagtcctgattttgttgaaattgataatcaaatatatttacattctaattataatagctacgaaacagacatcaataggtttgataataccagccaagggaaagaaaaatacataaataatatttctatttcagatatattttatttttcagaagattacaattctcaaaaaaaagagattcaaaaagaaataggattatatattttagatttctggaaaatgagacttttttttcttttcccagagaaaaattttgattttatcttatcagaaaatggtctttttgatgagagtggtatttgtattactttttgtcaaagtatataa

SEQ ID NO: 634 - DNA, 552 bp, Chryseobacterium sp.
atgaatatctctcttttagtaaaaaaaatgtcgtgcactttaatgttgctgacatttgtttttatgggggctaaaatgagagaagattcaactgaaaacaaaagtattgaaaaaaatgcaaaaatatctacagtttttattgtaaaaggaaccattgtttatgggattgaaaaaataataaatacagagctcaggtttgaaggaaagaaaacggttaacaatactcctaaaactcacataaaaaattctttaagaaaacaaaagaaaaaagtaaaagagaatctgggtaaaaaagaaaatactaaagatacttttgaaaataaaattaaaataacaaataaagatactgaagaaaaatatttggtgtggctatccaaggaattaaaagcaatagctgatagtcagtataaatcaagttttacagctgttacgaatcagacaacttttgagctgttttctgaaaagacattacttctaaaaccattaaaaagctgtaagaagacctttgcaaaaaacagggcttcttatatcaggcctccgccgattatttaa

SEQ ID NO: 635 - DNA, 1077 bp, Chryseobacterium sp.
atgattgaaaaaaagattacgagaattgaaacattagactggctcagaggattatgcgctatttccattatgttttatcatttgaccatgtggaagttcaaatcattagattcctcagatgttttaggaaggcttggcatttatggggtctcaatattttttattctatccggtttaagtatggcaatagtatatcataaaaatattgtttctatcaacaaattcattgcttttttcttgaggcgttttttcaggatcgttcccttactttttataactactacttttactgttattttcaatacatataaaggaattgaatttgatcttcagaaatattttctgaatattacttccctttttggtttttttgattacaaaggatatattgcgaccggagcttggtctattggaaacgaaatggtgtattatgcctttactcctttaattttctttagctataattacaacaaaatccttggaaatattatcttttttataaccattgtaataggcttatattttgctttttataaattaacagccgatgagccattaagcaaacaatgggaattttatatccatccttttaataatttttttctttatttttcaggtattgccttgtattataattttataaatatcaagcttaagccgctatataataatatattgcttctatcaagtattttattatttactttttttcctgtatccggagatactataaatattgtgacaaatatgaacagaatagtttttgtagtatcatgcttttttattgtgtttggattttataaactgactgtagtattaccaaaaaaaatagcttatgttttagaagctttcggggtggcaacctatggcgtatatatgtttcatcctgtaatttataattatttgtcggttttcttctctaaaatcacagtacaaaattattatatcgttttttttactgttgtaactattactattattacggctattatttcctattacaaatttgaattgccagcttctaattatggaaaaaaactaacaagtacttttaacaaaaataaatttcaactatga

SEQ ID NO: 636 - DNA, 843 bp, Chryseobacterium sp.
atgaatgacaatgtaagagtatatgagcccagtaatagtaacaaaaatttgttatctattctcagggatatgtttgcggatcttttcagttccaaagatttagcgtaccgcttattcatacgggataaaaaggcggaatatagccaatctatatttggagtactctgggcatttttcactccattagcaaccacggtaacgtggatattcctaagtgcttcaggagcggtaaaaattcagaccacacatgttccctatcctgtgtatgtatttttaggcaccatgctttggtctgtctttgtagagagtgtgatgacacctcttacacagacacagaatgcaaaagatatcctgtccaaagttaatttccctaaagaagcaattcttctatcaggaatgttaaaaaccggattcaatatagtgataaagctcattcttatagccggaatgcttattatttttcaggtaaaaatagattcaggaatacttttgcttccactgcttcttttattgatcgtttttctggggtatagcatcggattacttgttacacctatcggaatgctttataaggacataagcagggcattgccgttaatgttttcatttctcatgtatctttcccctgtagtatacaaaggagggataagtggtaaaatggcaaaactaatcgagattaatccccttactccattaattaattctgcaagaaatgtgcttaccgcctatcctgttgaaaatccggtatacctttcctgtatttttgctatttccttagtcttattttttatcggatggatgttctacagagtatctgttccgattattatagaaagaatgtaa

SEQ ID NO: 637 - DNA, 1482 bp, Chryseobacterium sp.
atgcaaattaaaaacagaaaagatataagggattttattgttgatattgaaagcagatttcaggtcaatgattggaaatttaatgaaatccatatctggccgctgctcaggtttatgctttattttcatcttgtttttaagaccgaacaaagtgattctgaagaaaaaaccatcagctcaacggagtcttctgtacaaaaaattcatcctgtaaaaaggctgtattattacctacagacctcaaagctgtttttccggtggctttcttccttacataaagtcaaatatttatttgtaggcgcttttgctcatcgcgccgaacttgagggtatattttacaataaattctatgaccccctaattcaaaaatataacctgactgatttttcattgctggaatataccgagaataaagaaaaagagatcagtcattccgaaaagtccattaattttctttatggtttcaggttattcaggtattattataaactaacaaaaccttttaataaaaaaaataaaatagagctaaagggctattcagagtatattgagtttttaaaaacagatgaattaacgaaaggttttgcggaaaaaagaagcgaagaatatataacaggttatctgaataatcatctggatattcgataccgatttgttttaatggttattaaaaagatcaatcccgaatatcttttcctattatgctattatactgagtttggaatgcttttaaccgcaattgcaaatcagcataaaatcaaaactatcgaaatgcagcatggtccacagacaaacctacacatggcttattctaattggagcagtctgccggacaagggctatgatgtgcttccaagaatatactggaactgggatgaagcctctacagaaatcattaatcacacttttaaaagcaacgaaaattattctgcatttgtaggcggaaatccctggttatcatttaatttcgatcaaaatatgtccgagaaaggattcattctttatactatgcaatgttcccctgttaaagtttccacacttctttctcctaatatcataaaagttttaaaatattcacaccataagtggtatcttagatttcatcccagacaaagtccccaggaaaaagaagaaatatttaaaattatacaggagaacttccttaacgataaggtggaattcgaaaaagcaaacaactatccactgcctttattattgaggagttgcctttttaacgttacccatttttcgggaaccattatagaagccgaaatgcttaacaaaaaaacagtacttttaaataaaataggcaaagagtcctttgaaagcagaattattggcggcatggctgtttatatagattatgaccaacatgattttcaggatcgtttttcagagtttgaggcccaactcaataatcattctgaaaaaaacgaaaataagattgacactcaatttataaatacaatttttaatttataa

SEQ ID NO: 638 - DNA, 852 bp, Chryseobacterium sp.
atgagccaaacccactctcctcttttcagtattctcattgccaattataataatggtcgctacttcaaagactgctttgaaagtataatatcccaaacttatcagaattgggaagttattattgtagatgatcaatctactgatgattccgtagaaattataaaacaaatcatcagtaatgataaaagatttaaacttcatataaatgaaaaaaacgtaggctgtggtttttctaaaagaaaatctgcagaacttgctgaaggggaaatttgtagttttctggatccggatgataccattacggcaaacgcattagaattaatgacaaatgctcacaaacagaatcctgaagcagctcttattcattcaaaatgttatatatgtgatgaaaatttaaatattatgaaagaatataccaacggaaaaaatgtcttaaggaaagatgattttttaaacttagatggggagatttttcattttgcttcttataaaaattctttttataaaaagacttcaggtattgacccctattttcaacgcgcagttgatcaggatctttatttgaaactgtatgagatcggagaaaccatatacttagatgagtttttatatttatataggattcattcaggcggtatttctacaaataataatattaaaaaggcagaatactggcgctggatggtaaatatgaaagctgccgaaaggagaaatattaatattgaaaatattttcgcttctaaatttgcccaaatgcgtgaactggaaaatttcaaacagaaatattactccttaaaaaagtttgaacctttacagaatttttatctcaaaataaaaaaaatattcaaatga

SEQ ID NO: 639 - DNA, 558 bp, Chryseobacterium sp.
atgatgatttataaaattttaaataaaatttctaccaccatccaggatgtccggcattctatttatctgaaagtttgcattaataacggtcttaggttaggtaaaaatgtagtggtaagaaataatgtttcttttggatcagagccgtttttagtggaaattggggatgaaacaagaatcgcatctggtgtgactttcattacgcattccgggacaaccaacaatatcagaaaattagaaggttacgaagaggtaaggaattttggaagaataaaagtaggtaaaaactgtgctattggcagcaattctatcatcctgcaggatatcaaaattggcgacaactgtgtattgggtgccaattccgttttatccgaatctatgccggaacataccgtttatgccggaaaccccgccaagtatgtttgtgaaatcgaagattatgctgatgttctaaaaaaaacaacagtagactatcctatcgagttggagcaggatagaaaaaaactgaatcaatggcttattgagaatttacccgaaaagtttaaacccgcaagataa

SEQ ID NO: 640 - DNA, 759 bp, Chryseobacterium sp.
atgaaaacaaaacaagaactaaaacaatacttcgagaatggagacaagcctacacaagaacatttctgggactggcaagactcttactggcataaggatgagaaaattgatatgacaaaagtctccggacttgaaaatggaacttataccgatatctatgcaaaaacagatgccgaagggaatacttcaatggatttttataatgaaaaaagggtatttatacaatccgggactttaagaattcctgattattttacaaagggaacatttataaccgaattaaaaatacctgaaggaattgtaagcattggacaaagtgctttccagagttctggtttaacttttctttttatacctgacagtgttgttgaaattaagagtctggctttttcaggtaatataataagctctctgagactttccgaaaatatctcaaaaatcggatacggagcgttttcaaataaccagctttcagaattagacattccaaaaacccttaaagtaattgatcagtcaacattcagcaataataaacttacatctgttgaaattccaaatggtgtaaatgaaattaaaaactttgcatttggtaataatcaacttacctccgtaacaatttccaatagcgttctcaatattgaggtaggggcattttcaggaaataagctgacagaggtgacacttggatcaaatactgagtacaatatcaattctttcgatccagaagttcagattaccggaggtaaacttatcaattaa

SEQ ID NO: 641 - DNA, 1305 bp, Chryseobacterium sp.
atgtataattatagaccagtaggcatttacagtacaaaaacaatggctgatgaagaaagagaagataggaaaattgaaatcaattttgatgatgaactctatattaatacaacagagttaaatacggttaaaactctttttcaaattagaaatgcaaattattataaaaaaaatattcagaataattatcagattactattttccctaaagaaagagtttttatcgcaggtaaaattttccctgtaataaatctaatatttaaagaagcaaagaattcttataatgcctcggatattaaattaagaaactggaaaggcagtgatcccatatttaattctaaaattcacaatagacaatatattagtgtagataatgataatttgatgatattattacctatttcttattccggcgtaaactttcctgaattaatgttagattttttaactaatgggataacaactaagcatacaattggaggagagtttccagactattctacatataaattagcattacgtgaaaaagcaattgatataaaaaaatggaaggggcaagatggttgttggcttactaaacatcgagataataatagtgacgaatggcgacgaggttattcttatatcattgaacataaaattaaaggaagattggctccatttgctcaaatttataaattttatgattgtgtagattggtatattacaaatgtttacaaacatgaggtaaaatggtgtaaaggggcaaaaaagctcgttgcagctttagcatcaagtaacatttatgttggagggcttgaagggggctctagtgtaattgataatgggattgaaactattttaaatgaactaaatttaggtatttgtgattatgcaatagagaagtttcatgaactcatgtatggaaaatattctaaggtaccattaaagaatgatgatgcctataactgggatttaacatttattacttacgaacaaggaactgtagcgcccccaatttatagaaaaacaaattctgaaactttacgaatattccaaatgatgtctgataaagatggtatagatagcaataatggcattagtatacaaggagctggggcttggagtttaaataaagttacacctgcttttgatgacttcaaagcaaaagtaactgatgatcaatttagaattgacctacctttattaatgctttatttagataaacacaagccaaagtggagtggttttaaacaaaaattgaatcctgacgggacagtaaactcagatatcaaaaaaattataaagccttttgtaattaattaa

SEQ ID NO: 642 - DNA, 477 bp, Chryseobacterium sp.
atgaaaagaaacaggtttacattatatttaaaaatttggataattcatattatcatttattatttagtttttggattaattttacaatctcttgaacaatggtatagggaatggcctgtaaattgggaatttataggtaaaatatttttaagccctttaaatggtatttttggttggtttgatggattcccaatgtattttcttttacctgtaattattttcttgataatagaaacatttcaaaaattaaatacattttattcatatattatttctgtttttctatcatatattcttattaaataccttatatattatagtaggggatttcctttcaatataatattaagatcaaaccaaaaagaagaatctttagaaattagtttattatatgcaattttacctgcactttttataagcagtatttctgtttatttgtttctgaaaaaacatttctcgcagagtaaagtctcatga

SEQ ID NO: 643 - DNA, 975 bp, Chryseobacterium sp.
atgaaacattttgtttgtttaattctaaccgttgcggtacatactctctctttttcacaaaataggcaaactgtagagaaagatataaaagaaatcactaattttttaaaaaatgataatttaatttcattttttaaaaagcatcaaagctacaggcaattattggagggctatttgaaaaatagtgatacattgcgatataagagaatgtctgatagctcggattataagtataataatgcaatgtatggtgataatattgtaagaaattttcttaattgtaaaaaaatatttacggttgataacaaaaaaattaagattgattggaagcattcttttgtgaaagaaattttaatagaagaaaacagaaccacaattgataaaagtgatcctaaccaagaaatttttattccagtaaaagttttggtttctaatactcaaaacaacaacttagtgcttattaatgttagtttaatttattcaaaatcggggctgctaacgtcatttaggattttagaaaacatgcatattgggttttcttccataaaagagtatctgaaatttgaaaatgaaaaaatggaaaagatgttaacaaatggggtacagaacggagatagaaaccacctaaaaagaatagacaattctgaatcctttcctgataaacaataccaaaaaacatatatctccgaaaataataacgcctataaactaattttaaattttgagacaaaagaaaatgctacattactaaggcttgcaaccaggattataaatggtaatctaaagcataaatcatttggacaatgggaaaactgggaaggaactattacctttaatccatatggtagcgaaactacttggtatatgtatgaagatgaggggaaaataacatgcttttctattgattcctatataacagatatagataaactggaaatgattacttttaatcaaactaagaacgatgaaagatag

SEQ ID NO: 644 - DNA, 1752 bp, Chryseobacterium sp.
atgaagaagatctatataagaagcgttacactcttcctatttgtttctgcgggtgcaataaatgcacaggaggtagacttggaaaatctggggaaaaggacaatggaggagctcaaaaagaacccttttaaaataagcggcggagtttctgctaattctgttttttacagctccaatgtgtataatggaagagctccgtttacttactttctgaatggaaatcttaatcttggtttgtatcggtggtcaatgcctatatcgtatagtttgactaatcaagggagccaattagggtatcaggtgccgtttaaattcaacagaataagtattgcaccaaaatataaatggataaaggcatatatcggggacgataatatgacattttccccttatacatttaacggattgttatttaccggtgccggtttagagctgaaccccaatatgcctcttaaagtagctttgatgacgggaaggcttaataaagctgttgaagatgatggaaatccgaatacgattcctgcttacaaaagaatgggatatggtacgcatttgagatgggagaaagaaaggtataaattaggattgatcggattttatgcaaaagacgatgtgggttctctgtcatcagctcctgatgcaaagggagtattgccgcaggagaatctggtattatccatgacaggtagttttatgatcgataaaaacctggaagtattcggggaatatgccaataccgctttggttaatgatctgagagcaactgctgatggtgcagaaaaaaaaggattggcagccagttttctttcccctaattcatctatggaaaactactcagcatataacggaggggtaaaccttaagcttaaaaaaggaatggtaggagtaaaatatgaaagaatagatccgggatataaaacattgggagcctacttttttaacaatgatcttgagaatattacccttaattcttctttcacattattgaaagataggttagctctctctgctaatgtgggtagacagagagataatctggataatcagaagattaagcaaaccagccgttgggttggggctgttaatgcaaatctgaaagcatcagataaattgatgattacagcgagctattctaactttaccatgtttaccaataaacagcttaaccagttcaataacattaataataatccgctgcttattcagcagccaaaagactcgatagattacaaacagatctctcagaatacaaatattaacgttaactatataatttccagcagtaaagaaaaagtacagaatcttaatgtcaattattctttaaacgagatggtcaacagggaaaacggtatcgtaagaagaggagggatatcaagatttcataatgctaatgctaattatagtttggggtttccggaaaagaaaatgaatattgctgcctctgttaattttacccatatgtatgccgcttctcaagtatcaactatctgggggccggcattaacagtcacaaagtcttttcttaaagaagataaattgaaaacgagtgttggggcatcttataaccattcaggaagttcaacggcaaatatcaatgtcatgaatttcagactgggagctaattatatgccgtggaaaaaacatagctttgatcttgcttttattcagatgttcagaaatacagatcaggtcattgaaaatcccaatctaaatgaaatgacctgtacggtaggatataattatagtttttaa

SEQ ID NO: 645 - DNA, 1359 bp, Chryseobacterium sp.
atgaagttttataagaatctaaaaacaatatacttccttctttttgccgtactcgcatttgtattcaatgcgtgtgcagtggaagagagtattccggtagaggctgattttagtataaaggttgtcaataatgactactccgtacctgtaaaagtggaaattaccaataaatcaacaggagcggagacatacctgtggtcatttgaaggagcaacagttacaagttccaccgagaaaagtccgcagcctattacgtatgctaatcccggagtgtataaaataaaattaaaagcctccaacaaagacggaaatgttgatgaaaaagaaatagaaataaaagccgatgcttccatgaatgtagatttcgaatggcaaatgcagggaagcgatatttctccggtcaccttacagatggtagataaatcattgggagctacgcagtacctgtgggagtttgaaggaggcaatcctgcaacatcgaacgctcaaaatcccaatgtggtatttacaactccgggagatcatgtgattaaactgaccatttccaatgggctggaaacttattcaacccagaaaacagtaacggtaaagcctgcaatgacagtagattttaactggactgtggatcctattgataatgattatcaagctccggtattactgcacttgaataatttgtcgactaatgcctttacgtatgaatggatcattgctggtgcaaatcctgccacttccacattggcaagccctgatatcaacctgccgtcggcgggaacgtacaccattattctgaaagcaacgaatgataaagaaactaagatattgcagaaacaggtaaccgttttaccggatagtaatttactgtcattttcagatattaaattaggaattaatacagctcattctactgttggatgtttcttttcatctaatttaggaacggtattgaagcaaagtgatgtaaatgcaggaaatggttccaaaatagattttgctttttttggattgaattcctcctttatgtacaatcagtttgtatcgccggatgaagttcagaatacaggatttatggcaattcctaatgccacccactctaaaattatcaattcacaggagctggttggtacacagctttctccaactggttttgatactttagactcgggagatgattttaataccattaccgtaacagaaaccaatgccggaaaatcacctttcaataattctgttgttcctagggttatcctgttccagacagcagatggcagaaaaggagctgttaaggttaaaagctttgtagaaaacggtttaagctcttatattctggtagatattaaagttcaaaaacagccttaa

SEQ ID NO: 646 - DNA, 3237 bp, Chryseobacterium sp.
atgaagaaatttttatttttactattggtcacagccagtacttttctttggggacaggcaaatgtgaccgggaatgctcagtataagctttccctgaatggatatgtggggctttccggttcccaaagttgtggaacattcagagggcttcagtggatttctgtattccatcaaaatggtaacaggcaggatatttttggaacgtacaacgttagaggtgaagaattttataacgcaaatatacaatatgataatattttctacaccaagcagaatcgaataacaagtttaaacattcataccactaatagaagagggaatattaactgtacttcctatgataatgaaggaagtcctcccgtttcagtgtgtatgaacaggtattatgattttaccgagtttgattatattgaagattcaggtagacagatacccgggaatgttaccataaaatctgtaccctatgttacgctgaatactcctgtaggaaacaatgtaaatatatcaagtgaggaatttttaacgattactttacctgataatatagataatcaatactataactgggaatattctgtaggtgatgttaataactttgtgccttttcctgcgccatacaatcagcttgctgttcttcatttgagagggaaagattttcttacagataatgattttggaaaaacaatatacgtccgtatgaacatggataactgtacaagtgttcctactacctcaaatgtaattgcatttacctattataaatctgctcctagtatactttcaagtacagttacaccaaccaaatgtttcgatacaacagatggtacggcagtgcttaattttgacagaacacttgtagccggtgaaacgttgaaaatatcccttgttaataccgttacaggagcggccgtacttaatcaggatattaccaatgatctgcagactggcacttcatacaccttacaaaatttacctcctggaacttataagcttgatctattgggtacctatggaaccaatgcaacctataccgacagtccaagccacacaattaatttcgagataacaaaacctactccggttactttttccatgacttcacaaaccaatgtgtattgctttgaaggaaatgacgggattattgccttaacagccggaggagggcagaatcagttccagtatcatgttttgaaagatggacagttatttttagattggactaatttcagtaatggaaataatacttctatacaaaatcttgcagcaggcgtttacaaaataaaagtaagagattctaatctttgtgtagctaaggaaaatggaaatgaaaaagaaattacagtgaccattacgcagccttctcaggctattgccattcccactgctgaggttgagatttcacagcctacaggttatggtctaagcaacggctatatttctgtgagagtcataggaggaactcctaatgcagacggatcttacaatttcgaatggcgaaaagacagtcctacaggtactgtaataactaccggaattacaactgatttggtgaataacccttataccattaaggtagatggacttccggccggaaactattatctgacggtaaaagataaaaattacgccaatgcttccagccagttagggaactgcggaattatatcccgtgaatttatcatgccacaaccgcaacctcttgtcgttactatccaggttgaccaacagatctcctgtaatatggcaaacaattatcagtttaaaccggatttaaataataacggtgttccggatgaagcagaagacggaatccttaaagcaatagttaccggaggtgtaggaacatacacttatcagtggcaaaaattgaatggtgggcttttccaggatattgccggagccacacagcctacattgggaaatcttacaacaggaacctataaagtccttgtaaaagataccaataacaatacggctgatacagaatatacgtttgtatttcctgcagaactggcaataaccctttctgccaatactatagcatgctataatcaaagcagcggacaggtttctgttacggcaaccggaggtaccggagcatatacttatcaatggaataccaacgatactacacctactgttacaggattgtcagcaggcaattattttgtattggttaatgatgctaaaaactgtaaagtaagcggaagtgtccaaattcaagggccggatcaattattaattaatgatttatcagtgcaggacccgatatgttttggtgccaataatggtgaaattaaaatagaggtttcaggaggaaaagctccctacaatatcgtttggtcaaatggagtaacaggactgaataatacatcaattccttcaggagtttatactgttacagtcacagatgctaatggatgcagtattttcagaaattatacgctgacagatccagcacagcttaccgtagatttaggaaaagatatcacattgtgttccggggacagccagatttataatgttgccatcgccgatcccaatgctacttatgaatggaagaaccagagtggaacagtaatatctaccaatccttcaattactttatccaatgcaggaacgtatactgtactcattacagactctaaagggtgtacagccactgacagcgtaataatcaaaaactcttcagaagttttgaatccgcaacttatgctgaccacccatgcttacagagaagcaacagtagtattggtcaatacatctccaactcagcccgaaacggtagaatggataattcctgattctccggatatccaaattattaataagacaaaggatttccttgaattaaaattttctaagctaggctcttatgaaataggtttgaaaggaactcagggtgagtgtgagaaaacattctataaaaaagtgatagtggaagaaaatacttcaggagtaaacctgaatcctgaaaaagcatccaatgtaagagaatttaccattctccccaacccaaataacggagtgtttaaagtgctggtaggtttggaaaaagcagccattattaatatcagaattattgatatgatttcacatgaagtgtatcctgctactaaactgactccatcaacgtattttactgtaccattcaatacctcacttccgggaggatcttacctgatcatactcgaaacagggaatgaggcattagttaaaaaaatgcttgtacaataa

SEQ ID NO: 647 - DNA, 2121 bp, Chryseobacterium sp.
atgaaattaaaaacacaatatattttgaaaaaatatttattattcgtcatccttctgttttgctgtagcttactatggggacagcaaaacgaaaaagacaaaacgattattcctcacatccgtctgaaagtggacggtaagaaagaccgtatttctttgcgttgggcagtggacgagcctattgcctggcaaaaagccaataaaattggattttcattaaaaagattcaccctttcccgtgacggaaaagttcttccaaaagcggaagaaaaagatttagggatttttaaacccgcttccgaaaacgaatggaagaaagtggtcgagaaaaatgataatgcagctattgttgcacaatctcttttcggcgacagttttgaagtggaaatgggagaaaagcagggtaaacttgaaggtgtcgttaataaatctcaggaagttgagcagcggtttgcttatgcattaatggctgctgacctggattttgaagtggcaaaacttgcaggctgggcatatacagacaccaatgtgaaagctaatgaaagatatctttataccataagtatcaatacttccgaagggacattgttagtacaaaaaggagatgccttagcgactgtttcatcaaataatgatcttcctaaaccccttgattttatcggaatatttaaagataaaacagttaccctttcatgggaatatttacaattaagagatacgtatacagcttattatgttgaaaaatctcagaatggagccagcttcaaatctttaggagaccttcctgtgatgaatatgaatgacaatgatggacgacaggtgcaaggaatgacctttgtggattctctggctcaaaatacttctacattcagctaccgtattcgcggaaagacaatctttggagattacggtccctattccgatgttgtttcaggagcagggaagaaaagccttgaggcaacaccaagaatctcagattttattatcgatgaaaatgaagagatcaaattggaatgggaatttcctcaggaagatgaaaaaaatattgcatcgttcgaattattacattctgaaacagatctgcagaacacctataaagttattaaaaacaagatcccggtgagcagcagaagcataattacaaaaagtttggcgccatccaattactataaggtacaggccgttggtaaagccggtgataaaagggaatcgttttcggttcttgcacagcctaatgatacaacaccgccggaaacacccctgcagtttgaagggaaaatagattcactgggagtagcccatttgaaatggaaagccaatactgaaaaagatctggaaggctaccatattttcagaggaattcaaaaaggagacgaattggttcgtgtaactcctcaggctattaccaaaaatcattttgaagataaggtcgttttagaaaaccttaactcgaaggtatattattatgtaacagcaacagacagaagaaaaaatcaatctaaaccatcagtcattcttgaattggaaaaacctgataaagtgaaacctcaaactccggtttttacagaatataagctggaagatgatggtaaaattaccattaactggatgagaagccatagtgatgatgttgaagttcaccaattattccgtaaggcgaaagatgatgctgacaaaagctggaaaatgatttatgagactaaagatataaaaccggactatacgtacactgataaagaggtagaagctgataaaagctacacgtattatttgttggccattgataaaagcaagctgaaatctgataagtctcaggaaatgactttgagaagcaacaggattgaggctttatcactattgaccaatctttcaggctcagcgaacaggaataaaaagcagattgagcttaattggaagatcaatgggaaagataccggggaaattttagtgtaccgccagagaggggcagagaaaccttcgctatggggaacattaacaggggctcaaaacttcctggaagatcaatcggttcaggtaggaaattcatatacctatttattaaaaccaatgttaaaaaacaatcaggttgccaagactgaaaaaatcacagttgaatattaa

SEQ ID NO: 648 - DNA, 1401 bp, Chryseobacterium sp.
atgatgaaaataaaattattaatagctacggctatgttcgcaagtatttccgcattctctcaggaaataaaaataaaaaaaggagagttacttttagatgataaagtagttgctaaagtagatgataaaaaaaatgtttacagttttagtgatttgaatggtcagccaaaatttaatgtcaaagtatttccgacaataaatactgagaaaggatggattgaatttacaggacaaaacggaaatgtaaaagaagtcgattttgcagatacaggctttactttaagtgaaggaaaacttatcgttaaaaacgctttggcgcaagggcttcttacaaaagatggcattaatgaagaaaaggtgaaagaatttttccaaacaactgaccgctctctgacagaaaacagagaaaagactaaaaaaatgcagcaagaagtaaatgataaagaagatattttagccaatgagatggggataacaatagacaattctggaaaaatttggaataagaataaagaattgcaagggtacatccaaagagttaatacaggaaatcaaaccataatattaaactatgaatatcgtgtatatgacatcaataaaattcagattgccaagcttcagtgtaccaacagtgatacttataatagtaaaaatggtctgaaaatcaccacctatgataataaggaagctgaaatttttgttacaagaaatgattacagtggggcattatcacaggataaaatggcagaaagaatggtgagaaaactatttgcgaacggatatactctaggagatatgaaagatactgtcgtagaccatgccaataataaaaaccaaactgcagaaaatgatgccaaagccaattccaaaaatatctacaacgttcccggttatgttattgacaaaacaggtgctaagaaagaaggtagcattactatagagtttgaatctataggtgctaagctaggaaaagaaaaaggagtggcggatcttaccaattacggaggttctgttacagtgaatgttaatggtaaagatgagtttttcaaagctaaagacggggtgaagttctgtgccggagaaagatgctttattggtgttactggtgtaaaattgtttggggaaaatacatttgcagaaatcctttcagaaaacaatggaagctatgttctcacggacgttaaaggtccggatgattactatttaaaattagcgaatcagccaaaagctgtttacttaggtgaaaaaggaggatttgggaaaagaaaaccggaaaaaattaagaaggtatttgatgaatatgtaagctgtccggctttagatttttcaaagtatgataccagaacaaaagaaggactcatcaacgttttgaatgattaccaaagcagttgtaaaaaataa

SEQ ID NO: 649 - DNA, 342 bp, Chryseobacterium sp.
atgggaatagtattaaaaaacaatatagtttggggaccaaaaaaagctatttcagaagccttttttgaagatatatctaatattatcaaaggtagtaaagaagactatgaaatattaaaggtagaaatagatgaagcaatattttattatacatggacattagattatagaaaaaaatcactatcagatttattgcttttattatctctagtagaaatgttaattaaaatatttgatgatatatatgcaagtcgtttaaatgaaaatataattcaagtatataaaaactcaatattagatcttcaaaacattttaataaattatattaaaagttatcaataa

SEQ ID NO: 650 - DNA, 291 bp, Chryseobacterium sp.
atgggattgaggatactgggggagaagtttattaaaaatgaggctaatgatataattgcagaaatcaataggatcaaaaaattatctaaagaagataggatcaaagaaattggactagatccaataaaaggaaaagttgatttatatgaaggagaaataggacaaatcgcagaggaaagatttggatattttaaaagatacacagaatctgctgaaggtgattttgtatctattagtggtcaatacaaaaagggaaagtatttgacgcatttggattaccagaaaatgtaa

SEQ ID NO: 651 - DNA, 243 bp, Chryseobacterium sp.
atggaacaaagtaaaataatatttacagtaatatgtaatgatgaaaaatatttaaatcaaattattgattggtataatgaatcatacaagaccgattttaagataattaatcggattgaagatgaagtcaatttttcggaaattgaagtttctaaatataaaatgtcagatatattcgatcttgggtatcaatttggtgttagagaacaaaaactaagagatagcggtgaaatagattggtaa

SEQ ID NO: 652 - DNA, 240 bp, Chryseobacterium sp.
atggagctaaataaaacatatcaagtatttgaaattatatgtgatagcgaaaaaattataaaaaaagctatatatatatataataatacttgtaacaaagatttcgaattattagaatatattttagatgaagtcaattttgctaaaattggcggacacatcactttatcagatgtttttgatttagggtgtatatatacgaggttactcaataatgaaaataatgaggatgtaaattag

SEQ ID NO: 653 - DNA, 246 bp, Chryseobacterium sp.
atggaagaaaataaagaattaatttttagaataatggttacatcttctgatgtactagagagagagattgtaagttataacaatttttttaagacagattttgaaattattaaagtaattgatgatgaagtacctttttgtgatatcaaagtgacaaaatggaaaatggaaaatatttttggattaggtttttcattagcaagattggagcaaaaacttcgagaaaaaggtgaaatagactggtaa

SEQ ID NO: 654 - DNA, 1038 bp, Chryseobacterium sp.
atgaatgagaagcttaatgaattaggcggtttagacgggaatgaatctgcagagcaaaagcaaaccacagaagatagtggcgagttttgggtacgtaagatgaatggcagaggctggctgaaaacacttggtgagcttgggggaagcgtttgggaagaagcagcattaccaaaaaattattggaataaagatgaaggctacagtaattctaatatccatatcccgcctacctttgcaggagttggtgatggggtaattggggaggttacggactatcctcaattgataaaattaggctatgatgtttctacaaaacaagaagtaagaacagggttatggaacagcgttaaaaaattaacaccaacttctgtgtatattatggcacagaaaggaattaaagagaaaataagcaaatacaatttctctgataaatcttatattggttatcatgaagtaggtaaagatggtgttatggtagtttctatggcgatgggagctgggttctttaagaaaggagcagatggattaaaagatggagcaaaagaaaccgcagaaaccgttgctaaaaaagtagaacgaaaaagttggaaaggagcaacaaatatttttgaagcaactgctgaagagattgcggaagccaaatataaaattaaaaatcatagaataagtacggggaatacatctggaggaaattatggttatttagatggttctgttaatggtatcacagtagataataaaatgtggagaagtacatcgcaagaaattgcgaaagatgagatacatatatttaatgcaattgaagttgcaggaacaggaggtaattcttggttaagagtaacggatagcgaatatagaatgttaaataaattagcagaagatttgggagcagtaaaaggaggaaaatatccaagtatagtaggtgaattaaaaattgcttctgaattgccttattgtgcatcttgtacaggtgttattcaacaatttaacgaaatgtttccaaatgtaaaattagtattaatagatggagctaaataa

SEQ ID NO: 655 - DNA, 1884 bp, Chryseobacterium sp.
atggatattaatcaaactaacataaaacaggagttttggataaaccagtgggagtatttaatcaaaaattttttaaataaaacttatggactttcgatgtatagtccacacatcttaatcgatgatataataactgaaataaatgaaaataactttaagaataaggataatagaatttttttttacaaaaaactgaatgactattttaataatgatgaaatcattaaaacaaattttaattctatttttaaacttcttagggcaaattttgatacagataaaattcaattattattacatacttgcttaaaaattaagtctgaatttcaaaaaggggtgtattttgataaaaacttggagttattaaatctacttatttgtaataatgatgaaataaatccaattaactctgaaaaaataaaatttatctcccaagttttaattgttgaatttattaagaaaggttatgcattagaagatataaaggattttgcaaagaatgtcttcgatgatttccaaatgcttaatttcgatggcacagaaatattatcaacaaagtttcctcacaacataatttcagaaaacaatagtgaaactgatgagtattattctaaaattaaagagtcaataaataatttaaatttcagtgatcgaataaaagcattatcaagatattattataaaaattctgaaattgtcaaatatttgtttgtcgttgaaggattaaaaggttctgctgacattaaaattggtaatattacattgtattctcttgataaaaaaaagtttattgacaatgataaatataatgaagaaaacattttagaaaggtcagttaaaggaactcacaattttatacaagctgctgtagaagttgattatttaatgccaaagtcttctttagcaatcgcaataaatacattagagaatatattagacttgataacatgtcattataacctgaaaaccccattagaaattgatacatcaagatatattattgtcaaaaacggtaaacgtataacatcaacattttcgagggaaagaaatgacaaatttattaaatatcatgattcattgaatctaaatgaaaatgctttgagtttagaaaaattaataaatttcgataatatatttcaatctaaagaatcaatgactctggcaacatcaagaatagtaaacgcagttcattggtacagtaaagctgaacaatcaacaagagaagaagacaagatgctcaattactggattgctattgaaaatttatttaattatgagcttgatattaaagatgacattttaaaaaataataaaacgaaaactcagctcatccaagagataatctcttcatctcatatttttacttttaagtatcagtatggttgggaatttttcaatatttattatcatttaatattaaataataaaaggccacaaattcctcaacatttaatcaacaaatctggtttaagtggtgaagggcctatttatttaaaagattttgtcaattctttagataatttgatgacatatgaaaaggatattttatattctcaggaaatgaaaaacatactaaagttttatactgaaaatagatttgctttggacacaattaattcccaaatagaattaattaaagacgatattctaatgatttatagatttagaaatcttatagttcacaatgctcattttgataatgcacttttaccatattatgtattgaaaataagaaattattctggttacttaattagaaacttattaccaaagcttaatgaaaataaatctactttatctaaagaaatgataaacttctatattgaaaaagaaatattcttaaaaaaactagaagaaaataaatatattttttttgaaaattaa

SEQ ID NO: 656 - DNA, 1437 bp, Chryseobacterium sp.
atgaagaaaatgaaattagtaatagctacggctatattcgcaagtatttccctattctcacaggaaataaaaattaaaaaaggcgaattgcttcttgataataaagcagttgcaaaagtagaagataagggtagactttataagtttagtgatatgaacggtaagttacagtttgatgctactattatcaatggaagaaccattggaacgcaatcagataatggatgggtagagtacacaggaacaaacggacacgtaaaagaagctggtcatacagaaggaacctttacgctgagtatggggaaattaattgtacaaaatgccatagcacagggtcttattacaaaagacgggatcgatgaagctaaagtaaatgaatttttccttactgaagaccgctctctttctgatgcaagaaagaacggtattgcttcccaaaaaacagaagcaaaaaatgaagatgatcttggtgtttcgatagattttaacggaaatatcaagaacaaaaatggggaatttttaggatttataacaagggcatatattgatgcttcccaatcacagttttcaagtacagcaatgatggataagtatttggaataccgagtttttgatatcaataaaatactaattgcaaaattgcagtgttcagacagtgatatcacaaatgaatccaaaggattgaaaatttacacctatgataataaagaaattccaatgacagctaaaaatggcatggactttaaaaaacctttagctgtcgataaaatagcggatcgtatggtaaaaaaactttatgccaacggatatactttaggagatatgaaaccggtttttgaaggcatggcaaaagaaaaaaatgatgcgatcaatcagaaaaaacaggaagctgaaagcaatgccaaagccaattccaaaaacttatacaatattcccgggtatgttataggcaaagacggaattaaaaaaaatggagaaatcaccatcatgtttgaatctattgccgtaaaattaggaacaaacgatactaaagtttatggagatgcagctaccctgcatagtagtgataaaactgaattcctaaaagcaaaagatggcgtaaaattctgcgcaggggagagatgcttcatcggagtagagggaacttccatgtttggaggaagtgtgtttttggagattttagcagaaaacaacgaaagctatgttcttaatgacgtaagaaatcaggacgattattatttgaaattggctaaccagccaagagcagtttacttaggtgaaagaggtggatttgggaaaagaaaaccggaaaaaattaagaaggtatttgatgaatatgtaagctgtccgtctttagatttttcaaagtatgataccaaaacaaaagaaggactcgtcaacgttttgaatgattaccaaagcaactgtaaaaaataa

SEQ ID NO: 657 - DNA, 504 bp, Chryseobacterium sp.
atgctaaagaaaaaaataagcagagaatatgcaaaaactcagttagcgatttataaaattataaactccaatgaagaatatttaaggcaaatcttggatgcggattatatttacagaagtggtgaaaatgaaggagaaaatataaaatataatacaatttatgacaaagccgtttcaaaatttcttattaaatattttaaagaaataattttaaaaggcatttctaatttttatttaaaaaaaattatggaaacgtttttcgccaattacgatattgaaatagttggtaaaaatgaaaagctctatagatgtagttgttgtgaatattttactttagataatattagtgaatatgatgtttgtagattatgccattgggaagatgatggtaccacatctaatgaactaaataaatttagtcatgtaaatggaagtactttaaatgattataaaaattattttgaaaaaaaactaggcagtatggaaataatttataacaaataa

SEQ ID NO: 658 - DNA, 570 bp, Chryseobacterium sp.
atggaagactttaaatatatttctgataactactctaaaatgagtgattggcaacttcttaatttatggaatgaaaaatataaattgagaagtgaaattgttccaatattaaaactagaacttgaaaaaagaaaaattgaatttgaagagtatatcaatacttcagtgcaatctaataaaaataaaccttcagaattaaatttagtaaataataatataaagcagcaaaataacttgaaaaagaaagttgttactgatattgaatactatattgaaaggaatcaaagcaaaaattttattattaaaatagtaagtgataaacatgatattgggagtgagtatatcgaaaatatatttttagaattcaaaaggaaaagtagaatatttattttattgggattagtttttttgatcccaacgataataaggttagtcattttaacaaatactaactataattattcatatagtcctccgcttttacccgatttactgtattttttaatctttgcggtaatatccctttacttagtatacaagggttttcaaataggaaaaaaatataagtaa

SEQ ID NO: 659 - DNA, 813 bp, Chryseobacterium sp.
atgaaaatctataatgtaaacaaggacttaacaagtccatcaggaatgagattatctataagtccatctgatgaagtgcttgtaaattttctagaaagtttaagaatcgaagaatttcctatatatatacatgagttacttgaaaatataaattttggagtacaaaactcttcattcattttttatgagcaaatggactgggaagacaaagcagattttttaaaatattatggaagagaaatagaatcagatgaaattaggatttatgtgtataatgggaacccaaatttttcagcaataaaaaaaaatgacttttttaatattttttacgattattcattaaggttattaaaggcttatagacttgacaaaactctccctgcaaattgggctgagtctatggaaaaagaattatatagattgaaagacaaattaattatttctcctgtaaaacaatattcattaataaaaaagattttgctaagtcaggaaacatttcctattaattattacgatgacatagttcctcttacattttatggaaatgaatgtggaaaaattacggttaatctgtctttaaaagaatcacaaccactttctgatcttgtagaaaataatcaaacaacttatgaggaattatcaaaattaggtgtagatagattagaaaatttaaaaagcgaagaaagaaaatatgaatatcgatatataataatctccggagattgtaataaagattttcttataattttcaatttcaaagaatatcgagactactacagttgtcgagtttttggagtaatcgaaattatttaa

SEQ ID NO: 660 - DNA, 3000 bp, Chryseobacterium sp.
atgaaaaaaaataaatttaaattaattgtacttttctctttttttatttatacagaacacaaatcacaacaaaatttattagaaaagcaattatataatgtcgcatcaccagaagtagcaaatttgatgaaatatagcgacttttctgaacttgactatattgggaaaacaaatatttctgttcttatttataatattaattttggaagtataaaagttccagttaatatttcttataacacaaaaggcaataaagttgcagatattgccacttcggtaggattaggatggaatttaaacgcaggtggaaacttgactgtaaaagtaaatgatcagaatgattttacagaaacatattcttactatactacctctacttttgaaccagagcagtctttatcatggcatagacaatcaaaagggtatttatcaacagcttttcctgaccagctattttattctaatattcctggacaacaattatgtataaatagtagaattgaatggagtgatgatactatgatagatgcagctccagatttttactatattaatgctcctggctttaatgataaattctatttgacaagaattaatgatactcaatttaaggccaatttttttaactctactaatgcaaaactgaacaataatcttattttaactattaggccgacctgcagtgggtatgaaagtacattttggggtaatcaaggaaaagcaagtgttttttatcaagttgataaatttgaaataacagccgaaaatggatatatatatacatttaatgattatgaaatttcaaagctaactgaatatccacaggattttttcagtcatgatgctattcaggtcaacaattggtatctcactaagatgaaagatccaatttcaggtagagaaattaattttgaatatgaaagctatacgaataattatgaacacccatcgctcacaacgttacaatatgtaggttttggaaactataatgtagcttacaactatgcatcaggaagtaattcaacaatttatgaaccttctccagtattatggaatagggctaccacatcaaaattatcggctaaaagattaaagaaaatttcaacagatcaagaaactgttgaatttatttatgattttaataggattgattacccaggtaatggtcttactaatattcaggtaaagaatacaaatggaaatattataaagtataccgatttcacatactcatattttgattctggaaattgttctttaggaaattatgaatgtaagcgtttaaaattaaacagtatatatgattctacttctggaatgcatactttttattatgatgataataattttcctccgagaagttcttcaaaagttgattttttgggatattataataataatagctctaatattaccttttcaaaaacagactttcatccttatgaaaataactattttcctgttgcaaaaacttatttctatcctgatctggtaaacgataatattttaccatttaaactaataaataaaactccttattttgagtcgaataatggtatagataaaacaccctcaattatttctaagctaggtttattacaaaaaatagtatatccgactggaggatttttagaattaaattatgaaaatgatgattttatgtatgaaggagccaaatatattttgggaagtacaagaatcagtaatgtgaaattatatgattctcaaaatataattagtaaagaaattaaatacaaatatattaatgatgacaattcttcttcaggacaaattaattttataacaactccggctagcataacaaggacaaatgtttcacctggcattggatttaataccaatgcaattgttggatattctagaattattgaagaaactacaggaaaaggatatgttgaaaaaaaatatagtaatttcagtgattatcctgatacatttatgacatctgatactaattttactgatcaaggagttaaaaaccttttaaaatttctaaaattccctcaatcttatgtacaatcatttgatgaaagaagaggaaaattaatttctgctaactattataatgaaggacttacttctccaattaaacgagagaaatatacttatgattataatgttaaagatgcacttaaagttcaaaaaacattttcatcttattatccaactggcgggcaagagctatctggaagttatactgcttcaaattatttactaagatattttaataatatacactctgatagcagagaagaattcttttcgggtaatattataaaagaagagaatttttataattatgatgatgcaagaatgatttataaaaaatcaatttttaatgatgatattatagaagagtattatagaaatgccaaagataaatctatacagaaattgattgatgtaaatattttgaataaacctatagaggttgagaaaaagaaaaatggaaaaacactcaataagcaagaagttaaatatgaaaattcaactaatatatttccaacttcagaattatcctatgatttaaagacaaacctgatgggagtagagattatttatgataagtatgacaataacgggaacttacaacaatatacttcaaaatcaggtattccaacagctattatctggggatataacagaactcacccaattgcaaaaatagaaggcgcaaaattatcagatatttcacagtctgctattgatgctattgtcaatgcttccaatattgatgcaagtgcggtttcaaataatgatgaaactccatttttagatgctctaaaaacatttaaaaatagtttgccaaattatcagatcaccacttatacttatgatcctctgattggcgtaagaagcatcacccctccatcagggatcagagagctttataaatatgatacagccaaccgacttgaaaaggtgattgacatcaatggaaaagtattgaaagaattcaaatacaactacaaaaactaa

SEQ ID NO: 661 - DNA, 213 bp, Chryseobacterium sp.
gtgttagatttgttaacaatgaattggttgatcagaccacaaaaaatctttaaaattgaggaaattaactacgctacggataagaatttgggtggagaatatagtttagaagatagaaaaaatttaaaattttattttttggttcgcgaaggggaaaatgaaacagcatattacattgacgacaaattaaaaaaatataaacctaaaaaataa

SEQ ID NO: 662 - DNA, 411 bp, Chryseobacterium sp.
atggatcaaaagaaaattatagcagcaattatattaatagcaggattcttgacctctatttatgtaggaattaatatatcttcaaaaaacaatattgttttgtatgactttgttattaacaagcgtttctccattattgatattgcactcggcacgtcagaagaaaccgttttcaaatctcagctaataagtatattgctatatttattttttataatcctggttttgagattgagaaacaatggttatttgaaacacattttctgtggcgtaattctcttgaatattatttttgaaatttactgtatttatttagtatttggtgatacctattcaggccaacaccttagattgaatacagttatgtttgtattaggattattcttattgaaggaaaataaaaattcttaa

SEQ ID NO: 663 - DNA, 387 bp, Chryseobacterium sp.
atgaaaatttcgtattcaaaaaaaatctatgctaatttaatcattggtattttatgtattagctgggggatatactcatatttttttaacgaatcctccggagattattttcctatattctttggatctctttttattgcagtatttattaatcagtatgtttataagtacgttgaaattactgatcaggaaataaaagtaaactcatttccatcaaaaatacttgctattgaccaggtaaattttattggaaatttcggcgatgattatatactaagaacttctgataaaagcttaagaatttcaaagtctcaaatagatcataatgatttgcccaaatttgagacatttattcaaaaacttgaaataagcttgaaaaacagttaa

SEQ ID NO: 664 - DNA, 420 bp, Chryseobacterium sp.
atgaaagataaaaagttattttctaaaaaaattgtatatgttgttagcttaatgttgacctttttttcggcaatgctatatttaatggcgattgttgtcaggataagtaatgaaataaattttttaggtttaactttaatatttcttattttgagcttatcattatttcagtcttattttcttattgtaaaaaatagaaagggtattttacttaccaacattcatcttgtattgttactttgttttatagtctttgaactgatcacttatctgattgcttacagaacttacgatcaaggtacaaacggaatggttacgggaattctttttttattagcttcactttttattgttaataaatttaaagtttcaaaagtggaatatgaaggtttagaaaatttaggaaaacacacagattaa

SEQ ID NO: 665 - DNA, 390 bp, Chryseobacterium sp.
atggatatcaccaaaagcatacgaaaggcagttaattcaaatacctattggaaacacggcatcttccaatcagtagtaaacgctttatcaattgattatcaggtcgatattgaaatatatgcggaaaaattcgccactttaatttcggataaacaagtgataggatatatttatttaaattatcccattatcttcttggaaagcaaatattcatctcagatccattctattttaaacaattttagtgatatacaatatattatcgtcaacacattatatgatcaatgcttatcaatagatgaagatatttatgctacttattttgattatatgggaaatccggaagccttttccgctgaagatttttacttttataatgtgagagaataa

SEQ ID NO: 666 - DNA, 126 bp, Chryseobacterium sp.
atgcctcctgtaataggaggcatttttattactgagccaaacttactaaaatcattctttacaagttacttattttctgctgagtttaaaaatgcacctgctggatttcctcttctatttccttag

SEQ ID NO: 667 - DNA, 165 bp, Chryseobacterium sp.
gtgtttaattatgaattcattgaaaataaatcacgaaatattgataaaatcgatttagccctggcttatgttgctaaacctcacttcaaactgagttctgagatctttattccggtaagaaacaagaacattactgcaaaagtagtgaaagatccttttgtatag

SEQ ID NO: 668 - DNA, 159 bp, Chryseobacterium sp.
atgcgtagtgaattaaattatgaaaaattttataaatattcacaatatagggaactattattgtttgatactgctgatgaacacattattttctgtatgtgttatatgagaattaaaataagtaaaaattcttcaattagtgataatattttcgtttaa

SEQ ID NO: 669 - DNA, 3471 bp, Chryseobacterium sp.
atgaaaaaaaatacgatagctgtatttctattattagctacattaaacaatacttttatatttggacaaactacggtaaatcaatatgacccgagtgtaaaaagtgtccctacgtcccccgaagtagcactattaggtagatttggtgaaataccagtaggacactatacaggaacagcagaagtttcaatacctctatatacccttacaatagacaatatcaaaattccattagctctaggttatcacacctcaggtattaaagttgccgatgaagcaacctgggtgggcttaggatggaattttcttcctgaaggaacaataacacaggaaatcagggggagcgaagactttattacaggaggggatggtttttctgcttcttcaggttatgatatttttaaaaaccatttcccgacccttttctctgaaacgccaatgtacaggcttcaatatggatcaaatgactacaattcaggaggaatatctggaggagcacagccaactacagatgactcttttgagattataaacaggctaaaagagaaaaaaggccagccggatatcttctcctacaatttttacgggttttctggtaagtttttctataacccggaaaatagtaatgaaattctttttttagaaagcaatgatgatgttaaattttcaagaaacacagacggatggatagctacaactaacaaaggagataaattttatttttatgctattgaaaaatcaagaaccgaccaaaccaattatgtggatttaggatatacttttaaagtaagtagaatagaactggtaagcggaaagattattacattcgcttatcagaacgagaacacataccaacaataccctacacaaattgctcatttaactaattttacaacaaatgctaccataaccagtagttctaatgctgttattaatgataaaaaaaaattggttgggatagagacagaagatactagaatacagtttaatttagataacagagaagatattcgtccatatttttcagctaatccaatcaaaaaattgagttcaattgatatcttgtcaaaatatggcaataagaaaattaagagttttgtttttaatcataattattttccaattacttcaattaataatacaccagaagagggatataagaataaaagattaagactaaattctatccgggaagttaactatgatcaggcaggtaatgcagttcctcagtctattcctccatatacttttgattacgacactactaatataatgccggataagatgatgagctccgatttttatggctataataatggtatgggaaatgccaaccttctccctgatctgacctattttgactacttcaaaaaagctccttataaaaattatggtttgactcccagttcgtatgcgagtacagtaaggtataccgatgtcaactatcttactacaaatattctcaagaaaatttcttaccctaccggaggacgcactgaatttgcatacgaatccaatacttttagcaatcagtttgttccgacagtaaatcaattgcaaaccggtaacaaagggcaaactataaatcatagagggactgaacctaatggggctatttttaaccaaagccttccattcaaattgccaaacagaacaataaagttttataatacgatatatgatggttatatgggccctacttatccggaagtccattatgaagactggagagagatggctaaatgtaaaatacagtttcgtaaaagaaagacagttaacgggcaacaggtagaaacggttattaaagaatggaaagtggatgtcccaggcagcatttttgagcaaacccatcagctaatttggaatgaagagatagtagtgcctgaagatacagatcttaccacagaatattatgtatatgtggagaatggaataaattaccgcagcaatgatggaagccaccgtgccatagtagcaagtgatttcagatattttgatgatacaggtattgacacttctacatcctacggaagcggtttacgggtaaaatcaattaagaattatgaaaacaataaattactgtcccataaagagtatagttataatggtggaaaattaatttataaattcaaccctttaaatcttataagtggtgcgacatataaatctcaaccttcaacaataaccggcggttgtcttagtgagtctatttctatttttaacgacctatctgtgaattcaagtgactttggagtaggcgggaataaatcttttggttatagtgacgtcacagagaaagatataagtgtcactgatgggacagcgaaaggttctacaaaatattttttcaccaatacagaaggaacctacttgaaagggatgccaaaggtagatgtgccgtccaatggagagaatacgttgatagaagtctttgatcaaaatcaaaataaactttcttcaaaactaaacacctatgataatttgcccaacacctatggagtttatccatcatttggtattgtaagaacatctaccgccctctatgatccaagcacttatttctatccttatcaggtaagtggctgtcctgcaataggactatcttacactggtgacacttatcaaaaccctcttccagtcacaaagtataaattcatgtttagtcctcttattacaggcaaacgaagacttaaaacaatgattgatacctctttttttggcagttcggctttagttaacaaaacggaattcacctataccggttcaggtaatttagacgtaagtaaatctacaacatctgatagtaaaattatatatactgattacgactatgccaatgattggggaaacagtcgtttaattaataacaatatgactggaattcctttatctacaaaagtcacctcagaaaacaaaacacttagttttttacaaaccaaatatgacagccaagtcaattatcttccaacttctgctcaatcattcgatattgggacaagcacttgggttactgaaattacatatgacaaatatgataataaaggtaatctaatgcagtatactacaaagagcgggattccagtttctatagtttggggatacaacggaatccatcctatcgttaaaatcgagggtattacttatgaacagcttgaaacaattgctccggcacagcttacagatatactttccgcttctgaaaaggatgctaatcctgcattgtataatctacagccggaagaggcagaaacacaacttatcaataagttagatatattccgaacctattccagattaccagactaccctatcacgacctatacttatgacccgctaattggagtaagaagcatcacccctccatcagggatcagagagctctataaatatgatactgccaaccgacttgaaaaggtaattgacatcaatggaaaagtattgaaagaatacaaatacaactataaaaactaa

SEQ ID NO: 670 - DNA, 3219 bp, Chryseobacterium sp.
atgaaaaaaaatttattactactattgataataaccaatgttttcctttgggggcaaggaggacaagcagaatataagattgaattgtatgggcttaactatagtgttaatgccggagtgaaaaacagtacaagctctcatgttaccattacagttatttataatgataattctacggaagatttgtatttcagacccattgctaataatggagataatgagaataactggacattaagtcctccgcaaacttcatcaaagcttcctgttactgcccatactgagggatttgtgaacttcagaaccggaacagatgccaactacgatcagtatgatgccatcaatatatgtaatgagaacaattacaatgttgatacccattcaccaagaatgacatggatatcgtataagatgaaggtaacccctattcatacattagtatcattaaccgatgcaggagctacaaatacggttttgccttctgaggataaaattaatttatatgcgagacagggatttgctgctaatttatataactatcagtatagtttagataatgtaaactggataaatatttctccatcattatctaatctcaataagttgagtgtgtctgcaaaagatctgtttgggaacaactattcccagtatattggacaaaatatttacttcagggtggcatcctgcttgtcaaacggtgcctatcaatccgtttcttcacctgtggttttaaccatgataaaatcggcccctcatatcttgtccagtacagtaaccccgacaaaatgctttgattcaaccgacggtacggtaaccttaaactttgacagaactctgataacaggtgaaactttaaagatatcattggtcaataccgtaacaggtgctgcgggtttaaatcaggatattactggtgatctgcagtctgctacttcatttacgttacaaaatttgcctccgggaaactataaattggacttactgggaacttacaacggaaatgcaacctataccgacagcccaaatcacaccattaattttgagataacaaaacccgctccggttactttttccatgacatcacaaaccaatgtatactgtttccagggaagtgacggggttattaatttaactgctgcaggcgggcaaaaccagtttcagtataaagtaaccaaagatggacagccatttttggattggacgaatttcagcagtggaaatactacccagatacagaacctttcagcaggaatttataaaatcaaagtaagagattccaatctttgtgtagctaaggaaaatggcgcagaaaaagaaatcacggttactattactcaacccagcgcagcgattgcaataccaactactgaaattgaaatctctcagcctacaggatatggattaagcaatggttacatctctgtaagggtgattggcggaacacccaatacagacggatcttacaattttgaattgagaaaagacagtcctacaggctcggttatcactacgggaattacgactgatttggtgaataacccctataccattaaaatagatgggcttccggccggaaactattatctgacggtaaaagataaaaattatgccaatgcatcaagtcagttgggtaattgtggaattatatctcaggaattcattatgccccagccagagccgcttgtcgttacgatccaggttgaccagcagatttcatgtaatattgccaataattatgcatataaaccggatttagataataacggcgttccggatgaagcggaagacggaatccttaaagcgatagttaccggaggtgtaggaacatacacttatcagtggcaaaaattaaatggcggacttttccagaatattgccggagctacacagtctacgctggggaatcttaccacaggaacctataaagtattggtgaaagatgccaataacaataccgcagatacagaatatacgtttgtatttcctgctgaactggcgataaccctttctgccaataccatagcatgttacaatcaaagcagcggacaggtttctgtaactgctacaggtggaacaggaggatataattacaattggaatacaggtgccaccactcctactgttaccggtttatctgcgggtaactattttgttttggttaatgatactaaaaactgtaaagtaagcggaagtgtccaaattcaaggaccagaccagttattaattaatgatttatcagtgcagaaaccgatatgttttggtaccaataacggtgaaattaaaatagaagtttcaggaggaaaggctccatacaatattgtttggtcaaatggaataacagggctgaataatacatcaattccttcaggagtctatactgttacagtcacagatgctaatggatgcagtattttcagaaattatacgctgacagatcccacgcagcttattgtagatttaggaaaggatattacattgtgcttaggagatacccaaacttataatgtagcaatcagtgatccggcagcaacctatcaatggaaagatcaaaatggaaatataatttctacaaatccgtcaattactttatctaatgcgggaacttatactatactcattacagactctaaaggatgtacagctactgacagcgtaataatcaaaaactcttcagaagttttgaatcctcagtttatgctgaccacccatgcgtacagagaagcaaccgtagtattggtcaatacatctccaacacagccacagactgtagaatgggttattcctgatacaccggatatccaggtgattaataaaacaaaggattttttagaactgaaattctctaagctaggtgcttatgaaattggacttaaaggaactcagggagcatgcgaaaaaacattctataaaaaggtaattgttgaagaaaatactacaggagtaaacctgaatcctgataaagcctctaatgttagggagtttactattcttccgaaccctaataatggtgtgtttaaagtgttggttggcctggagaaagcagctatcattaatatcagaattattgatatgatttctcatgaagtctatcctgctactaaattaaccccatcaacctattttaccgtaccgttcaatacgtcacttccagatggatcttacctgatcatactcgagacaggtaatgaggctttggtaaagaaaatgcttgtacaataa

SEQ ID NO: 671 - DNA, 441 bp, Chryseobacterium sp.
atgtattttgataaagaaatcgaatatctaaaaattgttgaaaatcaaaaagatgttagtagagaaattctgacagaagaacaagtcagagaaataaaagaagaatatcctaacatttctttttattatctggattaccttcagagtattggagctggaagtattaaagactgtagttttaatatatattccggtttaaccgatttttatgacttaggattgaatgatatttacgttgtagatgataatatcaagttttttggagacaactttgccggagattttgtcggttttgatctaatggatgataatgatgaagttattgaattttggcatgatgatgataaaatttttagaacaggaaagacattccgagaatatatgataggtaaaatttataacggaaattgtcatctggctgaatgtaaacagtcagactaa

SEQ ID NO: 672 - DNA, 600 bp, Chryseobacterium sp.
atgagacagattataaaagattggtgcaacttctgtgaaggtaaaaatgatttcgacaaatctcacttctatactttattttgggatgattctgaaaatgaaaaattaacgccaaaagatttagaatttattctttcttattttgaagaaaaagatagattgcttgaaattataaataattatttatttgatgatgagaaaaagataagtgtttctaaagaagatttggtttttcttgcaacagaagatataaatgagaaaggtaaattgtctgaagaattgaaatacatatttacaaaatcaataatatttgatgaggattttaagaaagtggaagcgagtagaaatgaaagtgattatttaaatttctatgatgaagtctctgatgttatattggatagttggaagttagaagatggaaaggcgtatgctttatatgaggcattatatggtcttacgacggattacgaaatggtttggtatctattcagtcctttattagatttagatattaacttttacaattattttaaaatgaaaataaacaatggtatttacagtataataaaaaataatattgttgtttcaagggagccctaa

SEQ ID NO: 673 - DNA, 1023 bp, Chryseobacterium sp.
atgaatgagaagcttaatgaattaggcggtttagacgggaatgaatctgtggagcaaaagcaaaccacagaagatggtggcgagttttgggtacgtaagatgaatggcagaggctggctgaaaacacttggtgagctcgggcgaagcgtttgggaaaatgctgcaatgccagagaattactggaatcccgaaaaaggttatgacagcgctaatatccacgttccaccaatgtttgcaggagttggagatggagcgatagatatggtaagtgactatcctcaactaataaaacttggatacgatgtagctacaaaacaagaatttaggcaacaactttgggatggagtaaaaaacattacaccttctaaagtttgggacatggctaatcaggcaacgaaaaataaactggatcaatatcttaattctcctgcctatgttacgaaccatgagtttggaagagatgcagtaggaattgttaaaatggtaacagccgggggcctagtaactggaatgaaagatgccggagaaaagtttgttaggaaaaccagaagaacattagatgaattggctccaaatggaaaaattcctaaaaatctagaatttaatagctggtttgatggtttggatcttgatgagcttgacttagtttggagtgatcacaagcttagaagacaatttgagaatgaaataaggaaaccagggggcttacatgaatggtgtatggtatgtgaagttcatcaatttaagaaatggaatataagtatggatgaaattaaaaggtttagaactaaaacaacagaactagttggaacaaatccttatgatgggactgcttttgcacattcaataaaaagagcagacggtagaattgtgtctgggccatcctcaaagacatttcatttggaactacaaacaattatagcaaatagtgataatttaaatgattttaatagtaaactacaggagttagtaactaaatggaaaattgatccaaatttacttcctccatttattcaacattaa

SEQ ID NO: 674 - DNA, 1905 bp, Chryseobacterium sp.
atgaaaattagatttttactattcgtatctgtttttattttttcatttggtatcagtttcgggcaggtaaaacattccactgttttatctgaaataaataatcttaagaaacagcagagaggagaaataaaaactgaaaaaatactatcacgcatcgacccatccctggctctcagagggagtattgataaagaaatttccggagcagtttatttggatcttgataaaaataaatctgatgcttttcgcagcagaccggataaggtaatttccttggaaattccattgaacggatcatccctgatagttgaccttatggaagctcctgcttatttttatgaatatagcataaagtcgggtgacaggaatgaaatttctaaaagtgatcttgtagcaaagcactacagaggagttgtccgtggaaaagaagaatccagtcttgttgctcttagtatttttaagaatgaaatgatggggattatttctgttgaagggataggtacttataatttgggcaaattggataaagaggataagcatatcttataccttgatcggaaccttaaaaataagcctacatacagttgtggaacatctgatgatgtacagccagatcaatcagtccagatgcagaatattgatgcttcacagtccagaatacaaacccagcaggtagtaaaagtatatatagaagcagattataaattatttgttaataaaggaagtgcaggtaataccgagcaatacattaccggtttatttaatcaggtagcagctttataccagaatgaaggaatagagacaggaatatcacaactaaaagtatggacaacacaggatccttatagaagtgataattcaggaaatgcacttgtggattttacaaatgccctgaataataattttaatggagatttggctcacctcatagcattaaacagtgtaaatggaggtcgtgcatattctattggatctttatgtagtacctaccgtacagcttatagcggagtatatagtggttactcagatgttcctttatatagttggtctgtatatgttatgacccacgaaatggggcacaacctaggttctcgccatactcacgcctgcgtctggaacggaaataatacccctattgatgattgtgcgagccaatattatgttaccaataatattgatgataatggagatggcactattgataatttggttgaagcctcagaagctagtgcgtgttttgataatgttaacaatgcgattcctgctaaaggtactattatgagctattgtcatttactttcagctgtaggaatagattttacgctaggatttggtccacaaccaggtaatgttatccgtaatcatgtcgctaatgcagtatgcctgcgtccttacacagatgaatgtttgccaacagtaaatattacaggtacggtttctaacggttcgcaggatcttgctcaggcttctaataacatcattgcatccaatactgtaaaatctgggactagcgcttcctatcatgcaggctcggaagtattgttaaaaaatggttttttagcagctaacggatctgtgtttagaggatatatagaagcatgttctaacgtatattcaaaaactgtcactgtaagtgttgagaagaataagactgccccgttaagggatgaagggatcagagtttttcctaacccgaattcgggaatttttactgtggaagtattacaaaactcagtattctcagaattaacaattgtatctctagagggcaaactgatttataaaagtacgcaaaaagaaaagcaggcaaaaataaatatcagcaatgttcccgcaggagtttatttgattaccgtaaaaacagaagaagggaaatattatactaaaaaaatagtaaaaatttaa

SEQ ID NO: 675 - DNA, 576 bp, Chryseobacterium sp.
atgaaatcgaatgaatacatcaaaaattattttgaacaaaacaattttttaaacgatacggataaagaaaaactattggaaatggtccagatagtaacttatccgatgaataaagtgattttacacagaggagaacagatcagtcaggtaggagttgtcctaaaaggcctgatccgggtttatgataaaaacaataaaacagtctggctggtttctgaaaataatgtctacggttctatggagattttagctctccagcgcccttcttcccttacttatgaagcattagaggagaccacaatgtttttactaaattatgatgatctggaaaactctataaaagaccatcccaatattgccaccttacttttaatgtattggaaaagtactgctatggatatttatggcaatctatattctttcctgcatttaacacctgaagaaagatatcttcaactgcttcagcaaaattctaaattaatattacgggtgaaatctaaagaccttgccacctatttaggtatgcatcccgtatcactgagcagattaaaaaagcgctatttcaattcaaaataa

SEQ ID NO: 676 - DNA, 684 bp, Chryseobacterium sp.
atgaaaaagaaaaaaattatttcagtattactattctttttaataggaattaaatgctttagtcaggttggtattaatacagcggatccacaagctatattagatattaacggagaccttcgtgtgcgcattacagaaaaatgtctcggggaaccttgtacagattttgttttggtccgcaataatgaaggatatgttcagactatttcaaaagatcagctgtttagttcaaatcccaaatcatatgttgccggtacaggaatgagcagtgtcattttagtctctatttccgggacatcagattgggggaaaatcttgtttgacaaaaaagttattgatgaaaataatgattttgatataacaaataatacatttactgctcccacagatggaatttatcagctatatgttcagtacaaagtttcttcagcggtttctgctggcgaattagggattggaatttttgtaaaaaaaggtacagatgaacccgaattagttgcagaagagagttatgtaaatataagcgtcttaggcattcctgtatctcctgctacaagaaaaacccagactatggtagcactgaaatccggtgatcaggtttactttggcgcgaaagcttcaataccatcattagatttattatccggaacatcctcattatttaccattcatcaggtaaagtga

SEQ ID NO: 677 - DNA, 753 bp, Chryseobacterium sp.
atgctaggctataccaacataccagccacattatgcgagtatgcactggtcaatcgaaagattaaccagctaaagctgtatatctacctaaaattaagttgtagtggagagataagctataataataggagttatagtaaatggtcaaaggaattggaagtaagctcaagaacaaccaaaagttctttaacatggttgatagagaataaatgggtaactgttaatagtaaaaaagaaacattaaaaataattagctataaaaagctatcgaaaaagttaggtttaaagttcaagaccggatgtttatatgaacctacaaattataaatattttaaagccatgtgctgcggggtagttctcacattctacatggggaaaaaacgttatttcaatagacagtcgggagatataaagggatctgccagattaaagaactgtaagaaaaataacggatttaccccaatgccgaatgactatctggcaaaatgcttagatgtgtccactgcgaccgcataccgttacaaagaagaggcagaggaagcaggctttatagaaacaaaagcaaatttcagttatgttctgaataaggacgggcaaaaaataacctcggaccactactataccttcattcttgccaatcagcaggaaggcaagcctaatactgtaaaaaaatctaaaaagtatttgaagacagtagaagccgatctcatttgtagtcacatatctttaaagaaaaagaatgtgggattttaa

SEQ ID NO: 678 - DNA, 606 bp, Chryseobacterium sp.
atgagtcagaataaaccaagaagcagatcatatacccaagctgaaatcacaaaaattataaagaaggtttgtgagaattattccacaggagaatatgtgctggaaagctgttgtgagaacgcaggagtgccttccagaaccattcgtaactggttcaaaacttatgaagatttcggagaagacatccctgcaaaatggaagtactttgccgaacttgccgctctatacgcacgtacgaaggagaacgtgagaaaaatggaaaatgagatgcttgtagagaaagccatgagttctttgatgaagctggtgtctggatttgagaaagaagatacaattatggtctacagggagaagcaaaataaaaatggggagaaatttcttgaacttatcaatattaagaagataaaaagacagataggacctaatgtaaaagctgtaatgtttgttctttctaaactctacccagaggtctacggagataaggctacggttatttatatagatagctttattgagaaatacaagggtgtgtctgatgaagaacttgaagaggaattcgctagattaagatcagatctggacaaaccccaagaagataaaaagtaa

SEQ ID NO: 679 - DNA, 285 bp, Chryseobacterium sp.
atgaaaaaaagaagtttttttttattactgatcttattagtttgtttgttagtaagatacagactatatgttaatctaatacctaattttgtttatgatgtggtaaacccaagacaaatacagggaatttttaatatagtattttatttaggaataatatttcaagcagtaataattatttcaatagcagttaattataagaaaatgaaaattcaagattttattattgcagggttatccctgatattcctaatatcttttattgttttagtattaactatatga

SEQ ID NO: 680 - DNA, 888 bp, Chryseobacterium sp.
atggaaaatcctcaattagactttttagaatcagtaaaagaaaacctctcaaaaataaatcctttattaatagaatcagcgataaaagatttaagaaataagcctattccaatagcaattgttcataaagatattgctactatcgatagggttgccattcatgacaaggattttagagcactaaatattcagaggttatcatataacaataataaagtaattttagaaagtcagaaagaaagaaatatttatgggagagctaatcttcccggtcagtctatattttatggagctttatccactcctgaaatccctatgaatagagctactgcatttatggaaactacctctatgattaaagatgcatctataaaagaagaatattttacagtatcaagatgggtattgaaagataattttaaagtttttgaatgtgtttttcaaaataatgaaaatgtcaatagtgcagtcaatagatcacgagaaaaacaaacaaaatttatgcacgaaattactgacaatgaaatgttgaaaaatgatgctattagacagctttcattttttagtgatgaattttcaaaatatgttgatcgaaataagtctcacgaatatttaataacagcacattttagtgacatgatttttaatcatccagaaaataagaatttagaaattggaggaattacctatcctagtgtccaatctaatttaaaaggtcagaatattgctctattacctgatacagttgataaatatttaatttttgaaaaagctattgtgatgaaagctgaacgccaagatgatggtggaatactaatagagaagtcatttgaaattgcagaaggttgtgatgaacaaggaaatcttacttggactccaatagaataa

SEQ ID NO: 681 - DNA, 189 bp, Chryseobacterium sp.
atggaagagtttaaattagaaaaaattcatccattgcatcaagccataatggaagaatgttgcgaacatgcaataaacaatcctgagaaattaaatgaaagagatttaataggtgctgttaaaattgcattttatacttgcaacgagacactaagaggaactttacgtggatcgttagaaggctgctaa

SEQ ID NO: 682 - DNA, 2178 bp, Chryseobacterium sp.
atgaattttactgataacacttttatgataaaagatggggtttattatcctcaaatcattcgtgaggtaaaaaaaagtccgaattcacttcaaccaatttacgaagcgtttacaaattctttagaatcaatagaattaataaacgcttctaattataaaggtaaaataattttacgctcattttttctgaaagatttatatggagaattagaatttgaaaaaattatcattgaagataatggaaaaggttttgatgatacagaatttgatcgatttctaacttttaaagattcaagaaaaggatttaataataaaggctcagggagaatccagtttgtacattattttaatgactgtgaatttcttagtactttcaagaatggtaagggatttaagcaaagatgtttccagatttccaaaagtaaaaaatacattgaaacaaataatactcttacctatcttaaatcaacagttgatattgatatagattcaacaggtactactttaaccctaagtaaccttattgatcaaaaagataaaatccactatctttttcaagttgaagagttaaaagaaaagctacttaatcattatatacaaaggttctgtttgataagagataatcttccggagatcattctcgagcaatatattaatgaagaatttgataaatcagtttctataacagaagaagacattccttcagaagaaaaaacattgacttttgaagttgattattataaacttagtatggattcaagaagtattgaaaatgcttctaaaaaagaaatttttagcgtgaaaccatttaagatagaaaaagataaactatctgaaaatgccataaaatttgttagtaaaaacgaaattgttgaactggataaacagaaaataaatttaaccagtgtttcaagtaaagataattttgaaggtaatagatttttatttcttgtatcgagcgattatattaatgatagagattcagatgtaagaggagagctgaaaattccaacaaaggaaacctttaaaaaagatttcaatttgtttcaagaagaagaaattatgctggaagatattgaggaaaaatctaataatgcaatacgtgaggcttacccggaaattcagaaaaaaattgaagaaaaggaacaacaaattgacgaacttagagaaatgttccttctgaatgatgatgttctaaaagaaatttctatatctttaaatgatactgaggaaagtattttagaaaaattttatgttgcagaatctagacaaattgcaaagtcagattcaaaaataaaaaaacagatagatcaattagataatttagatccaacatcaaaagattatcaagaagatcttaattctcgtatcaacaaattagtgaaggaaattcctcttcaaaacagaaaagcattaacccactatgttgcaagaagaaaattagtactagatttatttgataaaatccttaagaataaacttgctatacaaaatggtgaaggacgtactaaaacagaggctttaatacataatttgattttcaaacaacatactgcacgtccagattcaagtgatttatggttattaaatgaagattttatattgtttgaaggctgttctgaatcgacattagaaaatgtagaaattggaggaaaaagaatttttcgaaatgaggaagatttgacaccagaagaactgaactttaaaaattctctgaaagaagacagatatgggaaaagacccgatattttgttatttccaaaagagggaaagtgtgttataatagagttaaaatctacagaagctaaagtatccgactacataaatcaaatacaaaattatgctactcttataagaaattttagtacagatgattttgagtttacaacattttacggttatttatttggtgaacaaatagatacttttgatgtaagatcaaaagattcagatttcaaggaagctaccttttttgattatgtttacaggcctgctaagtccgtatcaggattttttagacatagaaaaaatcaagatggaacaatgtacatggagataatgaaatattcaaccttacttgaaagagctcagaatagaaataatgtatttattgaaaagttgactcaaaatttcatttcagatgattatatagctgacgatgagaatttacctttttag

SEQ ID NO: 683 - DNA, 798 bp, Chryseobacterium sp.
atggggttagatatagaaaaagcaaaacaatggcaagatagacttaacgaacagtctataaaatatattttaggagagtcaccactagaaataataaactctctgcaagacaaagttcttaactattgtttgcaggaatataagacaagtattaagtctgaacaccctgtgcgaattgttaatagctggctttctcaggaagttatcaagataaaagaaggagataaaggtaaaatacgcaggtttgatcggttggaaaacatctggcttaacattgtctttgatgctcgaaaatttggtattccgatagaagatctaaaatatacaaggaaaaagttgctggaatctccggttaaaaacttttctctgtttaagcttggagtgattaacacaatattctccatgccgcaaattctggtatttactgcaacaggtaagggaactttattttcaatggaagcttatactaaatggttctctaaaggtaggtttcctgcacatgctgctttcggtttagaggactatattgcattagaatatccaaataatgctcttacggcagactttagcatcgaaaaacctcttgagagcagaaataaaatgttgcttctttattttcttaaaacaggagactatcaacatcttaaagtgcatctaaaggagggggacataagatttattgaaaactcacaaaccctactcaagaatgaagagataatgaaggcaatcaatagttggaatttttaccagattgatattgctatcaataatgaaacgcaaacaatcatacgtccttaa

SEQ ID NO: 684 - DNA, 177 bp, Chryseobacterium sp.
atgattacgaaagagaaagccagaaaaattgtggaaagtgaaggtgaaactttctcagatgaagaaatagaaaagattattgaatttctcgaaggatatgcagatattttaatagaagtatatgacataaaaggagaagctttaaaagaacagaaagaagacaatgaaaaatcttga

SEQ ID NO: 685 - DNA, 477 bp, Chryseobacterium sp.
atgaaaaaaataagcttcatctgtttggtttttttagtttttgcaagctgtaaaaatgaatcagaaaaagcagcgaataaagtcacaaccattaaaacagatagcattcccgttaaaaaaacggttgtagaaaatacatctgaaaacaaagaaattccgactcttaaagaatgcaccgaaaaacagattgaatacgaaaccgaacaggaatgtatctttaaaaacgtaagtattgatgaagtatatgaaagaacgattaaagataaagacattgaaaaaacagaacttctattaaccgttttgcctaaagaaaatattacgaaagaaatcaatgaagatggcctgatttccatcaactacatggtaaatcctaacaaaactgacattgaattcctgtttgccggcggtgtaaccactttaagtctggaacagcaaaataaagacgttaaaagaataattatccacagtgcggattaa

SEQ ID NO: 686 - DNA, 1041 bp, Chryseobacterium sp.
atgatgaaaaaaacactacttattctgggcataatctgctcaattttctgcctttcccagaaaaaagaaatgaccacagcatttaaagcaaagaattacaaagaagcagtttccttagcgcaaaaaatacttgaaaataacccgtctgattttgaagctaatcttatcacatccgcatcctataacagccttggagattttcatcatgctcttccatattcaaagaaacttgaaaatatagcggaaaatgacgaacagaagagttggacattcatgcagttagtggtagccaattttgggttgggcgataaagaaacctcaaagaagtattacgataaagcaaaaaggattaaagcacctgaaaaagcagtgctggaactgagctctttaggaaaagtactcgggttcgacagcttttataatcagtggatcattgtagaaactgaaaatataatatttcattttgacagctctatcaatcaggaaaccagaaacaagatagtcaggaccaggcaggacgcttttgtgaagatcagtgaatttttccagtcagatttacctaagaaaattgatttttttgtttggggttccaatgaagtttataatcagtttctgaaaacaaatctgggatttactgtacccacctattccgtttctcataatcgtttgaaccagaccgacggccatgaaattgcccataatctgagtttttggaagggaagcacagcaaaaatcaaaacacaattcattaacgaaggaataggagtatgcttcgatcaaagtggcaatgataaactggagactgctaaaaaagcttataaaaaatctccgattgacatcaaaaaagtatgggcagaaaaccggaatatcagcgatgatgctttataccctgtttcaggatcatttatccagtttttaatcagatatgataaaactaaatttattgaactgaacaataaccaaacctatgaaaatgcaaagaagatctatggagatgaaatagatattctgatccaaaattttacggataaactgaaatag

SEQ ID NO: 687 - DNA, 495 bp, Chryseobacterium sp.
atgaaaatagtatttttgtcaatatttctgttgtttttgtttggatttggaggtggatcagcctgtaaaagccttcctgctacaaaaaatgttgttgaagcagaatcggtaatgagtaaaaataatgatgaaataaaattttcagaagtacgaagactgaataaaaacataccgttaaaagagtatacaattttacaatcttttgaagaaacactaaaattatacagtttaatggaagataaaaggttttcccggtcacaaccaattcctacactgtctgaaaatgagtttcttcttgtactgaaacctatattgaaaaaacagcaatacggagatattgaaatagagaagatagaagaagatcaatctgtgttaaaggtttattataaagaaattaataacgaagaatatttattgaataaagaaaagaatcccatactgattcttaaaatagaagggaaagttccttcaggtgttaaactaataacctcttaa

SEQ ID NO: 688 - DNA, 2319 bp, Chryseobacterium sp.
atgaagaaaaaattactggttctgagtaccttgctcatgttttcggcagtggggtttgctcaaaaaaatcattggaaaaaacttgattcaaaaatcaacactgaaattcgtgaaagtaatgtaagaattactgatttcgttttgtttaagcttaatatcagtgagattcaaagtcaacttaaaaatttgccggacagtgacctgcatttatctcaaaaaggtgtgcttttgaacttcccaaaccttgaaggaggttttgatacctacgaggttttcgaatcatcaaccatgcatccggaccttcagaacaggtattctgaaatccggtcttatacaggtttcaaaaaaggagacaaatcagcaactttaaagtttaccatagatccttattttggatttaacggtatgatcagaaatactcagggaatttattatattgattcttatacaaaagataataaggtttataagctttatgatagaaaaaatgcttcatctcctggtcagtttgaatgtctttttgaagaaaatagcgaacaaaatgaatctgctttaaatgtccagaaaacagttgttgacggattaaacagaaagtacaggcttgctattacaacgacaacagaatataccgcttatattgcagggcaagccggtgtaggttcaggaacagatgctcagaaaaaaatggcagttcttgcagctgttaacttagctgtaacaagattaaatgaagtttttgaaaaagatatttcagtaagactgcagcttattccgaatacggattctttgttctttatcagtacggatacttttaatgcactgaatgcaagccagatgttaagtgaaaatatcacggttaccaataatattattggtgctgctaactacgatattggacacttgttctttcaggccaatgcaggaaatgataatggtttagcagctaccccttccatttgtggaaacagtaaagcgggtggagttacaggttctgcagttccggtgggtgatccttttgtaatagattatgtagcccatgaaatgggacatcagtttggtgcaaaccatacacaaaataatagctgtaacagaaacacacctacatcggtagagccgggaagtgcaagttctattatgggatacgccggtatttgtcctccaaatgtacaaaccaatagtgatgcttattttcatgcagtaagtattgcagaaatgtataccaggttaacctcaggttctacctctaactgcggtgttaaaacaccaattgcaaatgcagagcccattgtaaatgccggcctggataaaagcatcccgaagagtacaccatttatgctgacagcaaatgcaacggacgcagataatgatgctcttacgtatacctgggaacaaactgattttggggctgcagctatgcctccccaaccggtaaatggagtgggacctcttttcagatctgtagtgcctacaacatcaccttcaagatactttcccagactgtcaaccattgtttcaggctatgatccttcaattgtagctcctacagatgtaaaagcatgggagaagcttgcttcaagaggaagagatcttaatttttcagttcttgtaagagataataatcctttgggaggccagacagggcgtgatgatgtgaaacttaccgttgtggatgctgcaggacctttcgtggttacttcacaaaacaccggaggagttgtttggagtgaggggcaatcatatgcaattacatgggatgttgcgaatacaacagctgcacctgtaagcacacctaatgtaacgatcctgttgtcaaaagacggcggtcttactttcccgactgttttggttgcaagcacccctaataacggttcttataattatactgttcccggaggccttggaacaatttctaacaatgccagaattatggttaaagctgtggataatgtatttttgaatgtcaattcgcagaattttacaattaattcatcaacggtaataactcccggaggtggaaatccggtaacagtccctacaagaatataccagggtcttatgatatatccggtgccttcaaatgatggctatgtttacattaaagctgactttcctagacaggttccgctgcgtccttacgttattacttacgaattattttcaatggatggaaaactgattgttcctaaaaaaacgaaatatatatttgatgaacttctggaacagattaacttaaaacatctgcctactgaatcctatatgattcacgttaccgtagatggagaaaagattgttaagaaattaatgatgatacctaggtag

SEQ ID NO: 689 - DNA, 615 bp, Chryseobacterium sp.
atggctaagagaatcggaaactattcaattgaagaaaatgaagcagcagtttcattgcattattccctttcaaaaaaagattggattgattttgtaattaaactggtaaaagctttaatgccactggcaataggttccttgttcctgtatgggggcatttataaaaatatgatatgggagttgattataggaattgtatttatccttgcgggcggtcttttttttattgatgctgtttctatttttatcagtaccaaaaggaatatcatcagaattctgaaaaaagagaagttacttattcatagaaatacactgttttcatctgatacctataaactgcaggatattaaagcatttattgtatccggtaaagatgaacaggcccgttttaataggaaatcaccgcgaaggctttatggaacgatagaaataaaacttggtaatggtgttttaaaaccgattctgatcatcaatccgagaaagatttttcggacctttgatgatatatcagataaagctgatctgcgaaatgaggctaaagatatagtgaaagaattaaacaggtgtattaaagcagagtatcaggttaaagactttacaatagaaaatttttaa

SEQ ID NO: 690 - DNA, 576 bp, Chryseobacterium sp.
atgcaaacaataaattatataaaatcaataattgaaaatcctaaaattgattatactgaaaccctaaaagattattttaaaaacgagacaaaaagtactaaaatagcggcttttataaatgcaacaaatgaaggaataattacatccatctttcaatcaaatcaagaattatggatagattttgacaagtcagattggatagaaattttaaaaacaaccaatagaacaagtgtttctgaagtttttgatgttaaattaataaacacaaattgttttgatgatttaaaattgcttaataaatatttaaaaatcaatccatttgaattattatttgaggcaaaagatacaattgcaaaagaaaatatattaaattgtttcaaatttggaatgcaattttctggtttattttttgaagatgaagctttttttaaggaaacctatgatgatttttggaatataccttataataaacttaaagaatactttcaagatctaattgcacaaggttgtgaaaaacgattagagacatcggaggagctatattcttggttagaagaaaaaataaaaatagtctaa

SEQ ID NO: 691 - DNA, 1470 bp, Chryseobacterium sp.
atgaatttaaaattttattttcttctttttgttttgcttttttctaaacagattaaggctcaaaaccacaaaattaatgatcctttggaaaaagctgttttagcagcaaatgaaaaccctaaagaaagtttagaaattgccaacgaaattttcaaaaattcaaaaaaaacagataatcgtaatctgtatgtagacggattgtctatcatagattactattaccaagtaacaggagattttcataaatccatagaaactgcaaaccagacaagaaatgaagcccatgaaattaattattatgaacgggaagcagaagctttatcgcggatttcgtatgcatatacacaattagggttatataccgaagcaaaagaaaaaattaatgaggctttaaaggttattaaaaagtttgattataaaaaggacatagattatgagatcagtggaaaaacctatatgtattatggtgaaatttataatgctcaggagatggacaaagaagttacttattatctcttaaaatcatatgatgcttattcaaaaattaaagaccccacaacgaaaaacagaaacttaatagataccttcaataatcttggaatggcttatttgtttcaggataaattaaaagaatcagagtattactataacaaagcactgaaattaataccaataactcccaaatattttaagagaagcgaagcagcaatctatttaggattagggtatggagagtttaaaaaggggcatactgaatctgcactagaaaattataaaaaatcttatgatatttctaagaaaaataaaatcacggaaatagaactggaatcactggataaattttccgaaacctataaagtattaaataacaacgaaaaaagcgactattataaatcattatttgtcaatattaaagacagtttatccaaaattgaaaaaccaaaagtagacaagacagtttcagatattatcactgagaaaacgcaagaaaaagaaatagaaaataccttcttaattattttaactgcagttgtttctttagtcggtgtcctattgttttttgggtttaagaattttaagacaaaatataaagaaacccataaggcaaaatctgaggtagaagacaatcttcaaaagaaaacggaaaaaataaaaacattagaaactaaggtaaacgatgcttttgaagaggtattagaattggcaaaaaataatgattcaagttttttaatgagattttctgaggtatatccggattttacaaagcttataaaacaaagataccctgacttaagcgaaggacaaataaaaattttggctttttcataccttaatttttctactaaagatattgccaattgtaccaatacagctataagatctgtacaaacaaacaaataccgactgcgcaaaaaaatagaaattgatccagaggttgatttgactgaatggactaaactgtttttgtaa

SEQ ID NO: 692 - DNA, 156 bp, Chryseobacterium sp.
atgaaactacctactgaattaggagatgaatatgtaaacacagtcctttccaatctttctctgaaagatcttccggctgaagaatggaagttgatagaagattttgagaattatgctatttctaactatggtagaataaaaagtttggagcggtga

SEQ ID NO: 693 - DNA, 975 bp, Chryseobacterium sp.
atgaaatattttgtttgtttaattctaacctttgcggtacatactatctctttttcacaaaataggcaaactgtagagaaagatataaaagaaatcaccaattttttaaaaaatgataatttaatttcattttttaaaaagcatcaaagctataagcaattactggagggctatttgaaaaatggtgatacattgcgatataagagattgtctgatagctcggattataagtataataatgcaatgtatggcgataatattgtaagaaattttcttaattgcaaaaaaatatttacggttaataacaaaaaaattaagattgattggaaacattcttttgtgaaagaaattttaattgaagaaaataaaacctcgattgataaaagtgatcctaaccaagatatttttattcccgtaaaagttttggtatccaatactcaaaacaacaacttagtgcttattaatgttagcttaatttattcaaaatcggggctgctaacgtcatttagaattttagaaaatatggatattgggttttcttccataaaagagtatgtgaaatttgaaaatgaaaaaatggaaaaaatatcaacaaacggggtacagaacggagctataaacgacctaaaaaggatagacaattctgaatcctttcctgataaacaataccaaaaaacatatgtttcagaaaataataacgcctataagcttattttaacttttgagacaaaagaaaatactacattactaaggcttgcaaccaggattataaatggtaatccaaaacataaatcatttggacaatgggaaaactgggacggaattattacctttaatccatatggtagcgaaaccacctggtatatgtatgaagatgagggaaaaataatatgcttttctattgattcctatataacagatatagataaactggaaatgattacttttaatcaaactaagaacgatgaaagatag

SEQ ID NO: 694 - DNA, 255 bp, Chryseobacterium sp.
atggactttaaaacaatatcgacagaattagagaatgaaggttattctactcaatttcataaaagcattaattctttagctatctggattgatgagaatggagaacctaaaaaagaatcctattcgagagtagaacaaattgacaataaaatgttctttgtatattttattgctcaaactcctgtagaaaaagaatttaaaactattgaggaactcatcaagtttgtaagacaagtgtttccactagaagaataa

SEQ ID NO: 695 - DNA, 297 bp, Chryseobacterium sp.
atgaaatattatacttttatattattcgctttattctctttattctctttattctcttgttatgaacacagaatgtcagataaagagcttgcacttactatagcggaaaaaaaatggaaagaaatttatggaaaatcagcaataaatcaacaaaaaccatttgttgcagaaaagaaaaacgatagtatttggattgtacatggaaattttccaaaaccagcagtaataggtggggtcgcttatgcagaagtcaatataaaaacaaaagaggtggttaaatacactcacggagagtaa

SEQ ID NO: 696 - DNA, 483 bp, Chryseobacterium sp.
atgaaaaatttatttgttttacttcttgcagtattaggatgttcgggaagtaatgaaaacaagatgaagatgaaaatgcagaatgaaaataatatttttattaaaagtcccgattttaaaaccgtaattaagaatttttataaagatgctctttattacagttcatatgcaaaaaatgatactatttcagtatcattctaccaatacgatagtcgtgataaaaatgtaaatgtagggctttattcctttaaaaagcttgaggggaactatatcggagaatcaagtttagataacttaaagattttattttacgcagacgatataaaaattactaaggattttatcgagttgaagtctgtcaaaaaaaaacctttaaaaaagcagaacgataagcaatctaatcgtccttcagtatttaaagaaacctacgaaaaattttacacctataaagatgggaaattaacatcaatgaaattgaactaa

SEQ ID NO: 697 - DNA, 945 bp, Chryseobacterium sp.
ttgcggtggtttacaataaaaaattatttaggaaatgcaaggataagctttggaagaaccagtgcaagtgctcttgaaattgtagatagcaacgattattatcctttcgggatgaatcatctgaaatctggcaacagttattttggggcgggttcgtataaggcatataagtttcaggaacaagagctacaagagactggattctacagttttaagtggcgacaatatatgccggatgtaggaagatttttcaatgttgatccattggcagaatcattcccgtataatagtacctatgcttttgcagaaaatcgagtaattgatggtagagagttagaaggtttagaatgggttcctgttaaagatgacaaaggagcattaactacaagacaattaagtgtttcaataaccaataatgcaaagcttaacgagaaacaacttactaaagtaacagaatcttttaaaagtgattttgcaaagacattctctacggaaggtgtaaaggcagaattagtagtttcggataaagctactattaaagttagtttagttgatcaaataagcacaacgataacagattctgacggaaatgaattttcaaaatttaagggaggcgtaactgctactttgggagaatcacaagaaaattcattttctgttacagcaacagttgatggaagcaaaagagataatagtgatattaccagatcatttaatcacgaagctgcccatactgctggtttagatcatccgtggggtaaaagtgccgtttcagatatgaatcaaagttctaaagatgtcaaaagttctgatgttaaaaagaatctacttaattcaggtgcaaaccctactgaaaatcttagaactggagctggttctaaactaacacaaggacaagttaatagtatggataaattaatagaacagcaacaacctaaaaaataa

SEQ ID NO: 698 - DNA, 501 bp, Chryseobacterium sp.
atgaataaattgatctgtgtattcttatatttagtcttagtcgtgagttgtagagctcaaataaatataagcaataatgattaccaaaaaatgaatgaagtaataagcagttatataaaaaatactaaatattatgaacttttaaaagaaaatggcatacaacctaaattctacattacaaatttatcttctgatgcaaaggaaacgataaaagctgatgctttaaaaaagaatataacattaacagatggtgtttatgctttttatataaaagatattacatactcatatactcatctttatataaagcataaaggaaaaataaagatatttgaatctattaactgtcctaacaatgatttggtgcttaatcaagcaattaaatatgttgagaacaattttgagaataacaaaagtatagttaataacatttataattatttaaagtatattcattatttaaaaattgatcctcaatctagttttaattgtacgcaatag

SEQ ID NO: 699 - DNA, 3558 bp, Chryseobacterium sp.
atgaaaaaaataataatcccgatcagtgccttatttgtaacagaattagcctatgcccaaaccacaccgagtgtcacagaaaattatgtctacacaaaggcatatatagaagatccgtccctttcgacccccaaaaccttagaaactgttcagtattttgatggattaggaagacctaaacagattgtgaacgtaaaagcatcacctactggaaaagatgtgattacacacatagaatatgacggatttggaagacagcttaaagattatcttcctgttccacaatcaggaacgcaaaatggtgctgtttacacctcaccattagccaatgctactcagtccagcttatatggttcagaaaagatttatgctgagaagacattagaaaactctccattagatagagttttgcaacaaaagcaggtgggaaatgactgggctaataagcctattcaatttggttacgcctttaatattgatggagaagttaaaaagtatacgacttcaacaagctggtcaaataaaactacgatctcttcaataagcttttcaggaacatacggagctaaccagttgtataaaaatacagtgaccgatgaagatggcaatacaaccatagaatttaaaaacggaaggggacagataattttagtacgtaaaaacgatggcactcaaagtgttgatacctattatgtttatgacacctatcagaatttagcatttgtagttcctcccttagcgtctgcatctgtttcattggatcagacagcattggacaatctatgttatcaataccgttatgataattggaacaggcttgtagaaaagaaactgccaggcaaaagctgggaatatatggtgtatgataagcaggacaggctggttgctactcaggacactgttttaaaagaaaaaggacaatggttgtacaccaaatatgatcagtttggaagagtagctattactggaataggaacaggtggtacaagaagtgctgaacaggctattgttgacggatataactccaataatgtaaataggttaaccactgctctttttgaaagacagggtatggaagtatattatggaaatcaagataatacctatccgaactctacaaagtgggtaacattactgtctttgaactattatgattcctatccagggtacagtttcaatccctcttttccatcaacaatccagggagcatccgttttaactcaaacaccatcaactgatggaagaagcaccaaaggacttcctgtaatgagcttggtgaaaaatattgaagatgataactggacaaaaaattacacctattacgataccaaaggccgtgcggtaggaagtcattctattaatcatctgggaggttataccaaaacagaatctaaactggattttgcaggagttccacaagaaacctatacgacccatttaagaaaacctaatgaaaacggagtaatggtaaaagaacgttttgtatatgataatcagaacaggcttttacagcattaccatcaggttgacagccagccagaagaattattggttcagaacgaatacaacgaactttctcagctaaaaaacaagaaagtcggaaataatcttcaaagtattgattatgcctacaatatcagaggatggatgacagacattaacaaagatcagatggctgttcccaatttaggtggaaaattattctcttacaagatcaaatacacccaaaaagaaggaatagaaaatccagatcctgcacagttcggaggaaagaatgtaaaagctaaatataacggaaatattgccgaagtagattggcgggcagtggaaacattaggcgttaatccatcttctactcccaaaagatatggctatgcctatgataatctcaacaggcttacagcgggatattaccaaaatccgaacaacccttacagcaaagaaaatacagaatctctggcatatgatcccaacggaaacattaccaatctttacagaacatctgtaataggaggaaataccacggcaacggtgatagacaacctgcaatatacttatcagggcaacaggcttacccagctgaatgacacatcaggaaacccgagtggttatgaagccgcaagttcattttctactgccataaactatgatgccaacggaaatatgaccaatatgcctggaaaaggtattatggagatacagtataattatctgaacctgccgaagcagatagatcttgatcagggcggctcttttacatccagttatatgtatggtgcagatggaacaaaggtgaagaaaactaccgtaagtacggtttcaggatatcagacctctactaccactacggaggagacggattatctcgatggcttccagtaccttcataaggaaaccgtaagttcgggcggaggaaacccagatgagatgtaccctatggctccaccagaaagagcaatggaaatggaagcttactctgtccagcctgaaaataccgccaccatttcccttaaaacccaggatttacaatttttccctactgcagaaggattttatgattacacaaaagatcagtatatttacagttacaaagaccaccttggaaatgcaagggtaagttttggaagaaccagcgcaggcgctcttgaaattgtagacagcaacgattattatccgtttggaatgaatcatctgaagacaggaaatgcttattttggtcaaggaagttttaagaattacaagtacaacggaaaggaactacaggaaacaggaatgtatgattatggggcgaggatgtatatgcctgatctgggaagatggggagttgttgacccgctggcggaaaagatgagaagatatagcccgtacaattatgtatttaacaatcctatcaggtttattgatccggatggacgtagtcccaattattttattggaacagacggtaaaaaagttgatgccagtgttataaatggtaaaatagttttaggaagtaatgcatcaaaagatttacagcgaatggctgctatgacaaacgaatcaggtagttccatagctcaagaacaatttatgggtgttgcttataatgacactaaagttcattttaaaattgaatcagaatttacacggaatggcttactaggactacaccaagcacatgatagcaatggcgatgctttaaattggaatagggaaacaaaaacatgggatggagaggttgcttacatgatcgacgcatgtggtgatactgtttacaaagaagcaaccattacaatttttgaaggcaatttcacacccgaagaagttgatgctttaaacattttaggtgtcaataattttactagagatgatgcagttgtagctgtaaatgcacatgaaaatgaacatgacttaaacaaagaagatattacaacgattaaagggcgttcggaaggaacacctagttcaagaaatcctgaagaagctgccacaagtataactaatagaacttcaatacaaattggaaataaaaaagatcccaattatgctggtaagatattaaattctaaatctaactaa

SEQ ID NO: 700 - DNA, 3045 bp, Chryseobacterium sp.
atgaaaaaaataatactaagtgtttctttactactgacattgatagtaaatgcacaggataacaaatcattatcctattatttcaaaaactttcccaattctccatctactgcaacctttttgagatatggagacatacagaactccgaatttacaggaaccaatgctcccaaaatcccattatatactgtaaaagaaggcgctatagaacttccattgacgttagattacatttcaggaaatggtgtaagggttgctgatgaagccaccaatgtaggcttaggttggagtatcgggcttcctaccattgtacagtctgttcaagtttataatgattttgacagcggtaagccaaacctgaaaattgatttgcattatcaatctaataccccgtggccagctacgaattataccgagaagtatatggaatcagcagaagtcaacgaacctgctggatatattaacactccacaaagaggaaaatattcttatcaatatgcttctcactataatttaccagttaacgggcgattccaaaaattaaataatgctgttcaatatgatacttcaccagatattttcacgatgaatttattaggtgaaaaaattgaatttatcattagtaattttaaagaaattaatgatacttcggtggttcctcaatttacctgtctaagtaatcacggttataagatcagttatgataatactaattattttagaataattgctccgaacggttttacctatgaatttggtcaaatggaggatgtaagaatatatgagaatgtaagccgaaattatgtacttacaaaaataaccgataccaataacaattccgttatactagcatacaataatacccctaatatcacaaatttcattccattttcaaatacacttaattataagtacggggaaaccaataccagtttgacgtgtggtgggatacccgtcgattatggaggaatatatgtatatgcttcaagacataatggaacttttggtaatccaggcaataactttttcccatattatgcaacaggaccaaatggcagttttactgttccttacgctacattttcgaacagctcccaaaactaccttttattatcctccatatcaggaaacttcggaaacctcaatttcggatacactacaagagaagattccgatttaggtaaattatccaatattaccctgaaaacaccaggtaatgttactactaagactattgactttacgtatgaatactttaattccaatcaggcttcttctacggataaaatgaagaaacggcttaaattaaaatccctacttattaatcagactgaaaaatatggatttgagtattttgaagataatccccttccctcaaaagattcttatgccgtggattattgggggtattataatggtggaacagctaatgtaagctatttccttaacccaaatgattttaatttcgtagcttataatattcctgtcgataatacctataacaacaataagaaaaatgcagatattaatttctctacttcggggactttaaaaaagattatttatcccactcagggatcatcagtttttgaatatgaattgaatagttccgataatttgtttgtcaatgagtggagtcctaccctcaccagtggtaaaggattaagattgaaaagccagaccaactatgattttaataacacttttgcagggaaaacagagtttacttatgaaaacggctattctaccaatcctcttaaccttatcagaaggtatcagggaagttatattgactggatgttacattcatttagtgttatttctatgaattccaccaataattatagtgcttctccgctatcttcaggagattatgtaggatacagaaaagtaacaaaggtggaaaaagatcaaaacggtcaatcaaaaggaagtattatttcaacatatagtattactcctgatatttattacaaatattatgatgaccaattacctgtaatgactccttcaacaaaaggtgaaggaatggataatggaaaacttcttacacaggaattcagagataattcaaatactcttttaagatccattataaaccaatatacctatacctattcaccaacattgtatggcacttcattttctatgatcagtgagagtttatatgtttgcggatgtgttaccaatggggggagttgccctggagggccacccgatcaggcaaaagctattgaccaggaggtggtggcacattttcctatattttctaaagaaactttattatctcgatcaatcgtaaaagaatattcaaataacaatgaatttattacccaaagtgattatgaatataacagtaataataatttatcttctaagaacacggggtttcctgatggaggatatgaaaatatgtcattaatgtatgcgagcgcagggacacagcaaaaattatacaatgcgaatatgttgtctgttccattacaaaaaactgttaccagaggctcacaggactactctatggttcttacccgatacgatgatccgattcacttaaacccaacttccatacgctcttacagtcaatactctaatgtaggtaatgaatatcaggcggaagtaacctatgataaatatgacagtaaaggtaacctacagcaatacactactaaaaatggaattcctataaccatcatttggggatataacggaagtcagcctattgccaaagtagaaggagtgaaattatctgatattccccagtcactcattgatagcattgtaaatgcttctaatatagatgcacaagctgctcctaataatgatgaaacgaatttactgaatgctttcaaggattttagaaatagtttacctaattatcaaattgcaacttatacctatgatccattaataggggtaagaagtattatccctccatctggaatacgggaaatctataaatacgattcggccaacaggcttgaaagggtaattgataccaatggaaaagtattgaaagaatttaagtacaacttcaaaaactaa

SEQ ID NO: 701 - DNA, 129 bp, Chryseobacterium sp.
atgggaaggctctggaatgcaggatttataagcaggcaacttaaaaatatacatagatataatgcttttgatgaaaatgaaaaacagctgtccagtgaagaacagctgtttacaatcattaatttttaa

SEQ ID NO: 702 - DNA, 840 bp, Chryseobacterium sp.
atgatcaaagaaaagctaaatgatatcttatttcccaaaccatttttacgctgggctggtggaaaaagatggtttattaaatacctcgaacaattaaactcttttgaaataaataattatcatgaaccttttctgggaggaggatcagtttttttcagtcttaataattataaaagtgcattcatttcagaccttaattttgatctaattgaaacatatattgctttaagggatagtcctattaaagtaatagaagtattaaaatgtttgaagaatacagaggaagaatattacactttaagatctaaaaaatttgaaaaccaaattgaaaaagcagctcaatttatttacttaaatcaaacgtcttttaatggaatttatcgggttaatcgtaatggagtttttaatgttccctatggtaaaagaaataaaaaagatttaattgaagagtctaatttgcttttggtaagtaagaaattgcaaaaaactcatatagaatgtaatgattttgaaaacattttatataatgtaaataaaggcgatttagtttttcttgatcctccatatactgttgcccatgaaaataatggctttattcaatataatcaaaaaatcttctctctagacgaccagttaagattatctcaatttattgaaggtattattgaaaaagaagcttattatattttaactaatgcaaaacataatgccattcttgatatatataaaaatatcggaaaaccagtatcacttacaagaagttcaaccgttggcggtacaggagcgagaagggaggaattcaatgaatatgttttttctaattgcttaaatttcaaataa

SEQ ID NO: 703 - DNA, 2292 bp, Chryseobacterium sp.
atgacagagaataagagaattgaattacttggaaagttaatttctgaaaaagatatccaaaaatatttacgagttaaaaataaagatcatcattatcaaagtattaaatattcacaaaaagacgaattcattaatgatggttgggaagttttcagagaatttaaaacaacgcttagtgtaaggaagaaaaaaagtgttgatatagaatttgaggataaaatatggagccttttcgcacaattaggttacaagtttatgaataaggataggtatttttctttatcttatgataaaaataatgaatctttatcacaacaaatagatgtatttgcaaaagatgacgagacaattttgttaatagaatgcaaatctgcactagaaaataaaagaggtgattttaaaaaggaattagaagcaatgtcagggaaaattgaaggattaagaagatctattcagttactattcccaaatgttaaacataaaataaaatttattttagcaactagaaattattctatatcacaggaagatttagataggctaaaaaatattggtggagttcattttaatgaagaagtcattgattatttttactctttacattctcaaataggcgtttcttcaaaatatcaattacttggaaacctttttgagggacaggaaattccagaattagataacctagttccagcagtagaaggaaaaatgggagggcacacatattattctttttctttagaaccagaaagacttttaaaaataagctatgttcttcatagaaacaaggcaaatataaacatgatgcctacataccaaagattaattaaaagatctagattaaaatcagttaatagttttattgaaggtggagggtattttccaaattcgattgtcataagcatcgattcgaaaaagtgtaattttgaaagagcaaacactcaagtaggatctacactgtctaaggttggaatattgcatttgccaaaaaaatatcggtcagcatttataattgacggtcagcatagattgtacggatatactgattcagagtacagaaagactaatacaattcctgtcgttgcattcttagggttaagtagaactgaacaagtaaagattttcatgcaaataaatgaaaatcaaaaagctgtttctaaagatctacgtaacactttaaacgctgatttattgtgggattccgagaataaaattgagcaaatgcgagccttatgtgcaagaatttctatttatttaggtgagaatcgaatctcaccactttttaacatgatttctattggtgaggataaaaaaattataacaacttcagctattgaaaatgctattaaaaaaggttattttctaggtaaagtttcaaagacagcgattgaagaattaggcacattctatttcggtgacatcgatgaagcatatgaaaggttaagtagttacatatgtgaagggttgaggtatatttctgagaatttggatgatgaatggagaaaaggtagtgaaggaatattacttattaataaagggatatatggttcaattttaattttaagcgatctagtttattttttaagtaataaagaaattattaactcaaaaaaagattcaataagacaaattttttcagaagtaaaatcatatttagaccccattattatatatattaaagaattagatgataattctagaaatgaattaaaatcgtcatatggtactggtggtgaaaccaaatattggagaacttttcagaaagtaattcaagaaacttatccagaattccagccagatgggcttgaagattattttaaaaaagaagctaaactttacaatgacaaagcaatatcttacatcagagatatcgaaacagaatttaaaattgacttcaaagaaagattaaaagaacatttcggaaaaaaatggttcgaaaaggggttacctccaaaaatttcagataaagcaactgttgatgcattagctaaaaacagagagcttgaagaagatgatgaacaggtgcatccttgggattgtttaacaataattgcttacagagaaattgctcttaaaaattggcaaaatatttttgaaaaggaatacaccaaacctggagaagaaagaattagtggtggaaaagaggaaaaaactaaatggatggtaaaacttgaaagaattagaaatcaaaatttccattcttattctgtcacagaagaagaacttggatttttagaagagcttcatgattggaagttaaaaaaaacactaaaaaacaaatttcaaagcgaataa

SEQ ID NO: 704 - DNA, 5079 bp, Chryseobacterium sp.
atgaaattaagaaaacacaatacaaataaggtttatttaaaagtcagtagcattctattgttttcgatctttagtatgctacctgtcttacaagcccagaacctcctttcggagagcttcaactattcctccggatctttgttgacgagcagcaactggaccgcattagcagggacggggattaataatataacggtttccaatggtaatcttgcttatcccggttctattggtaacggaatggggaataaagtctctttagccaataacggacaggatgtttaccgtactttcaccagtaccgcagctcctgtatattcttcattaattgtaaatgtatcggctgctaatgcaactggagatttcttttactcaataggtacgagtggagctcccgctacaacggtaggagccaaactgtttgttaaatcgaatggatcaggtttcagttttgggatcctgagaggaaccggaggaacacccgtttatgaaactacagtaagaccgtttaataccaatataatggtggtcttgaaatatgaagtggtagcaggagttacgaacgatgctgtgaaactgtatgtaaacccggcattggcttcagagcctgcaatagcagatgcggcatatacagcagctgtcggtgcagatgcaggcgcattttcagctatagcccttcttcagggtacagccgtggcggctcctacgttggaggtagatggtattaatgtaggcagtacctgggcaagtgtaacttctcctgtttatgattatggagatgcacctacaagttatgactttacaaaagacggagtttatgctcctgcagcacacggcctgttgacaggatttggattaggaagcaacatccctgatcttgagctttccccattgagcgtaacttcaggcgcagataataatggaagtaacggagacggcacagatgaagatgctgtcaatgctgcagtcaatcagatgagaaaggggatcgtttacagcttaagtataccagttgttaacaatactttatcaactaaatacttatacggatggattgattttaataatgatggaagattccagcttggtgaggcagcacctgttgttactttttctgcagctggaagcagtactcagacacttacttggactgcagcccaaacagcgactgttgttgcaggaacatctaatctttatgtaagattaagaatttcagatcggttacttgctgattttaccactgcagcttccggaggcgcccttattgatgagcgaagcgttggaaatggagcagttagtactgttaatgctgctgacgctcctacagtacctgatggcgaggtggaagattaccagatagccgttgtagatacatatgaatacggagatctgcctatatcttatgaacagccaggaggaacgcccttacctgcacgccagctgttgagtgcttccttaaaaattggagctacaacagatatagagttggcggcccaaagtgtatcatcgggagccaataacaatggaacaaacggagatggattagatgaagacggcatagaccctactacggtttcgattacacccagcaccatctttacactaccggtaaatgtgacgaatattaccggtgcagcaagtacattatatggctggctggatattaataaaaatggagtacttgaagcaggagaagtagcaacagttgctgttaatacaggaaccagtaatacggccgtcaatttaagttggacatcagcccagactgcaaatatttccggtacggaagtttatttacgcctgaggcttgcaggaacagctttggcagataatgcagctactgccgcttatgatgaaagagcatttgcggatggacttaatacaggaatttatggtaccgctccaggtattggagaaatagaagattacagaatttcagtaaatccagggtatgactttggggatgtgcctgtatcttatgaccagccggcaggagtcctaatcccggcacgccaggttcctgggattactttacgaattggaactactattccggatatagaatacaatgtagaaagcgttgccgctgatgcagataacaacggagccaatggggatgggcttgatgaagatggtgtcaatcctgctctgcattctgtaacacctacttctgtatttacactgcctgtgaatgttaccaatacttctggaactggacgtacattgtacggatggctggacgttaataacaatggaatctttgaagctggggaagtggctacagttttagtggctaataacgctaccacagtaaatttagcttggaccgcagcggttacgggtaaacttgcaagttcatatgtgtatttacgtctgagacttacaaatacgggattgttagacaacggaactactaccggatatgatgaaagagcttttgcagatggacttagtacaggaatttatggtacagctccgggtattggagaaatagaagattataggcttgctgtaaatgcagtttttgattttggtgatgcacctgaaagctttgagattaataattccatagatgtagtgccagcgagacatattcctgcatccactttatatttgggaagtatatatgatacagaatcttctaataatacggtatctgcaggagcaaataacggcgggcttaacggagacggaacggatgaagatggaatatcagggacactgccacagttgaattctactactacaagttacaccgtgaatgttaatgtatataagaccattgccggaactgctacattgcatggctggatcgatatggatggagacggacgtttttcggcagcagaatactcgtctgtagctgtaacaggaaccgcaggtgcacagactgctgtacttacttggtctgcaccgttctattttgatacaggtgcttcaacaagctatatgagactgcgttttaccacgacagtactcacagataatgccgcgacagctcttgttgatgaacgttccatagcagatggacttaatacgggggtttacgggacaacatatgctaatggggaaatagaagactatcctgtaccattacctgcccctgtcattattgatcctaatttagattcagatggagacggtgttcgtgataccttggatcttgatgacgataatgacgggatattagattctactgaaggtcccgtttctttgaacgattctgcatttaaactttataatactccaaatgttcagggaactactgcttatcgatggaatttatatattactggagcagcgggtacttcggtaacctatactccttatggcggaacagccacgccggctgtaattccagcctctggaattttggtggttaatctactgccagcacaaataccagactggcctgtaaatatggtaaccagcggaaagtatgtgcaggtatcttcttcttctcctgtttcaattctacaggaaatacaaggagatccggcggcagatgatgctacagtagtatatccaccttcagtatggggtacaaaatatactgtcaatgcttacccgaatgccagttatactaatggtgtacagattttcagtgccacagataacaatatggtggttatcaaaaataaagctggagcaactgttgcatcttttaccctgaataatggtcagaattatgtttatgacaatggtgcaccagactctacaggttttaccgtgacctctactaaatctgtaggagtaatgacatacacaagatgtgcaactagccctacaggcggaggtgcctgtgataacctagtagaatacttattgccggacaggctgctggggactaaatttttaacgagaagtgctgcaaatacaggaaggatgatcattacggcaacccaaagcgggaccgcagtaaaagtagatggggcggttgtagctgtattaagtaatccaggggattcttatgcttatacgcagaacatcaatacttctcaaattattgaaaccagtgtaccagtacagtttaccaaagtagtaccttataactatgatccttcagtaacaaccatacaggatgtaaccaaagccacattaggacccgctgtaatgtcgattccaacgacaatgacaacatcaaacagcttaacaatctttgttaaaacaggaagtacaggaaaaatgctctacaatggcagcccgatcatcggatgggcaccttttagctatgattctacatattcatatgttacgttaacaaatgccaatggtatcacagccggttctttagttaacataagctctaccacgggggatgttccatttatgaccgactggtatggagtagggagctttatcactgccgcaacacccttatcaataggaggtgtaagtgtagtttcaggtacaaattctgctaacagctataaagatacagatggagatggaataccggattatctggatctcgattctgataatgacggctgtctggatgctttggaaggagatgaaaatgtaatagcaaatcagttggttaatgctggaggaacacttactgtgggtaccggctctacagcttctaataaaaacctttgtgcttccggcgtatgtgtagatgagcaaggcgtaccctcagtcgtaaacagcggcggagcagcagatgtaaatggaagtcagggacagggaattggagattctgaaaattctttagtgcaagatgcagtctgtctgcttactccattctgttacaaaccgggaatcacaagtggtactgcactgaatagtaaaataggaattacctctctgagcagagccggagcagcagatcctgataactggccaatgatccgtaagggagcatggatggtacttgaatccaagaccaaagggtttgttgtaaacagacttccttttaatggaagtggtaatcctgtaggaattcctgctgctgattttgtagaagggatgatggtgtatgatacaacaaacaattgtctgaaaatgtatacatccacagatgctgggagtacattcagctggcagtgcttaaatacacagacctgtcctgattaa

SEQ ID NO: 705 - DNA, 555 bp, Chryseobacterium sp.
atgaagaaaaacaaaaacaaggcaattgctttttttgcttgtttgtatatttttctatgtccccttcatctgatttttgcacagattaccatagtgggaaatgcaaaaatgtatataggttcccgggcatctatatatattaacgaagacaattcttcggatgttatcatatacaatccctctgaaaaatttattctaaaagaaaaaaataagagctcaaagtttaaaaagaaaacgaatagaaagaacagtaaaattaagacggctaatacatataagacggttccggtaaaatataaaatccagtccagtccggtaaagtctgcttatttttttaataatgatcctgaatatgctattgctttagcacaatcaaactttcactcaaaagcatcaggaaaatacttaaaagtagattacttcttttattttaatgtttcctgcagaggagctataggaataggtgatgtaagctatactaacaaaactataaagttcacttatttaattcggccgcctccaaagtcaataaaagctatgcagtattttatttaa

SEQ ID NO: 706 - DNA, 1146 bp, Chryseobacterium sp.
atgctcacagactatagaaaatattatttattgttatgtattttcagtattaatttatttggacaggaaaatccggatagtcttttgagtgcagttcgattaaagctatcaagtaatccggataaggttattgaagtggcagaaaaagttctgcatttaaataatataaataatgaaactgaaattgatgctcttttttccctggccaatgcatacactgcgaaaagaaattataaaaaagcgttgcagtatggtttgcagggtaaaaaaattgcggaagaaaatcattatataaatcatcaaataggagctctaaatgttattattcttcaatattatcagttaaaaatgtacgataaggctctttcatatttagatatagctgatggtttggtacagtcttaccctcataaggattccttaagaggattaataggaaacaattatgctttacgggggatgatttataattatcaatttaataatgaattggccattaaatttcttaaaaaatcaatagctgaataccaaactgacccaaataatctatacatgaatgcaaatcaatgtatttctatgcagaatattggattttgttatttaaatcaaaataaaatagactctgcaaggatcatattttctgaagcaatagcattaggaaagaaaataaataataataatgcattagggtatgcgtatttggggctaggacaagcaaatattcttacatctaaaacaatggaagcagaaaacaatcttaacaaaggtttattactttcaaaagaattaggagatccttttttagcaagagacttatataagtggatatcatataacagtatttctaggaatgactggaacagatatcaggagtatttaaaaaagtatgtaggagcagataatgaaatacaaaaatttgaaaaagattttatgaacgatataatccgggtatccgataaaagatctacagagaaaatagaggccaattcgcaaagctttttttataaaatttccatcatacttatcttacatattcttgctatctattatcttatttttatgataaagaagaaaaaaagcatcataaaatcacatcagttagtaatagatgatcatttgaaaaaaaacgccaataaaagcaattaa

SEQ ID NO: 707 - DNA, 1563 bp, Chryseobacterium sp.
atggaaaaaaagatttttattttaatagactatatgaagagatttaaaacaacttcacctcctcctctgtataggttgcctgcagctttatttatcctattttttttgatttcaacagacattttattttctcagcaaaaaaaagaaatgaaggttttattatataatgcgcaagatgttttgtattctaaccctcaacaatgtttaaagtttgctaggcatatcgtaaaaaattctaaatcttcaaaagaaattatacaaagctatttgcttatctcaaaaacttatcttattgagggtaagtatgatcaggcaatagaagcatctgaaaatgcaaaacgtatagcagaggaatcaaatgaaaacagtttatatataagttcattattgttgctgtcagaaattatgaattttttaaacattactgatctttctgtaaagtatgatgatgaagctaaacaactaataaaaaggaatcctaaactttataacgaatttaaagagatacagatttctgagatcataaaaaaagaatcaaagctttcttctgaaatggatttggcatatgcaaaaattactcagggaacattatttacacaaatagcaaaaagacatttagaaatatccaattataatgatgctctttattatttctccaaaagtatggagaatcttgaaaaaaaaggcaatatggattattgggaaatgttgaattttatttattatagtgactattttttcaataacaaacaatatgaaactgcagttagtattctatataaagctgttgaaaaacaaaaaaaaattaataatcctttttatgaaaaagaaattaatgaaaaattaatgaaaagctttattgctctaaaggatgaaaaaaagtctcaagaatattatcaaaaattaaatattgcagaaataaatacccaatcgcaacttagtcttactaatgagtggtttgtcaataattatgaaaacaagaaaaataatactgcagatattaaagaaagaaaacaaaaaaatattatatatatatcaattacttctttactgataatattaatagtattgttattatttcaaaggagttataatttaaaaataaaacataaaaaagacttaattcatttttttgaaataatgaataagtctgatgatcaggaacaaaaaaacaaatccttaaaacctatttcagtttctcttgaaaccgaaaaaaatatacttgccgggttagacaagttcgaaaagagtaataagtttctaaataaaaatatgtctcttccacttttggcatcacaattaaacaccaatacaaagtacctctcgaaaattttaagtgattataagcaaaaaaactttaatttctatgtaaacgaattaagaatcaactatattattaataaattgaagacagatcctcaatatcttaattttaaggtaagctatttagctgaagaatgcgggtttgcttcacataacagttttacttttgcttttaaaaagcatattggtatgtccccgataactttcatagatttcattaaagaagataaaaaaggataa

SEQ ID NO: 708 - DNA, 150 bp, Chryseobacterium sp.
atgcatataaaaatatttgaaaaatttaaacaggctcttaatcaacatgagcataataaatgtaaatttgggatatatatgagtctacaaaatattatagatgtgtatccaattcaaggagtagttatacgtgcggataaaaatgtatag

SEQ ID NO: 709 - DNA, 1938 bp, Chryseobacterium sp.
atggcgcatatcgacaaaataaagctgtataattttaaagctttccacggtgaagaaaccattgaattgaaaaataaacatctgttactgtatggggaaaatggaagtggaaaaagttctatttattgggctttgtatactgtcttacaatcttccacaaaaatccaaacagaaatacagaaatactttgatccaaggaatgatcaaaatttaattaatactcattatatagaagatcaggcatatattgacgaaaatagtggagaaaaaatctatccaaattctataggtctaaatgcgaatgtggaaatttatttaagtgatgaaaccagttttaaaattgatagtcgtggtttaactttggataacacaacattagatgtacttcaaaattggaataggcgctgcgattttatttcacatcgtttgttaatcaatttttataattatagaaactctaagcaaataaatctttgggaagttttcgtaagagatatgtttccttttttgaagaccaatagaggaaataatgacagaactttgtccgatgaattaaaggaaattgaaaaaactcaaccttttatttttagagatccttattttaaactaagcagaagtcaagatttacaaagaagatttgaaataaaaattgatagtttcaataatgacatagactattggattaatgaagttaacagagaggtaaaccaattttatgagaatcattttaaaaatagtggagatgaaactattcgtattttattgaattatgatataaagctgcagtttgataaagtttttccacaattttttgaaggaagagaacgatggtataattatgttggatttaataatcctcacattggtattaaaatagaagtaaaaaatgatgatgatacttttaccaatatttctaaacctcaatcctattttaatgaagctaaattaacttctatagctttagctgtgcgatttactttattattagattttattcgtccagattttgaaggtaaatttttggcgttagacgatttgttagttagcttggatatgagtaatagggataaagttttggatattatcttaaatgtttttgcacctaagtataaaatatatctgtttactcacgaaatggaatttttcaattattgtaagtttaaaatatctcaaaaaggattaacaggaagatggaaattaagtgaaatgtattttgatgatgaagataaaaaaccaataattatagattctgaattagaatatttagataaagcaaaaaaatattttaaagcaaaagactatgtagcttcagcagtatacctacgcaaagatatagagcattttataaaggttagaattcctaatgaatttaagaaaactgcagaaaatgagtatcataacttagatcatttttggaatttatttatagaaagatataaagcgttaggaattaatctagatgcaaaatatcatcaatggttcaaacagacaaagttggtagttttaaatccaagtgctcatgccaatatctctcagcagatttataagactgagttagaaaaagcatttcaatttagagaagtaatagaacagatttgtcccattaatgaggagattttggttattgcagaaaaaacacaatttgtttttaagcatccatcgcaaaactatgtatttgagttttattttaaaacagcatttctatgtgtaaaaataaatcaaaattatgcggaaattttacctaaagtagttatagaagaatattcgcataatgatgcaatacgagttttaaataaagaggaaaaatttgagaaaatgctgacaaatcttaagcgtgatactactttagctataactgatgacatgttttttgaaaacacgtttgtaaaaaactcaactttaagtttagatgaaattctacaaaaattcaaagtatga

SEQ ID NO: 710 - DNA, 282 bp, Chryseobacterium sp.
ttgaataatgacggacaggatgaaattataaaatattacacacttgctcctaaagagggaggctgtatgtatgttggtagaggaattatagtgtacgaaaatactaaaattggtattattgaaagcagatatgatccgaactacgcttttgaatttacaggcattgaaaatggaaaaataaccatatccaaacttgaatttagtgaaaatgatatgtgttatcctacaattccaacaaagggtattttgaactttagtaatcaccagttattttttgaataa

SEQ ID NO: 711 - DNA, 207 bp, Chryseobacterium sp.
atgaatacaaaactaaaagttattattttaatttctgcttttctctctatgtcttttgtggggttatttttaaatatgtatttagaatttgaagatactccttctgttaatttagaaatcttcaataaaattttattgaagtcagtaacaatctcttttataatattattagttattgtttttatgaacagaaagaaaatattctaa

SEQ ID NO: 712 - DNA, 771 bp, Chryseobacterium sp.
atgacaaaaaaaattaatttactttctattattttgcttctaattgttggtatactgtattcttgcgcaggaactgaaaatgaaggtgaaacaaaccttacttctaatgtcgcaaatagtagtaacgccaagctttatgcaagagatggatatgataaaactcagagaattcttaccttagatgctaatgcattagcaaatgaacacaatgatgttttaagaagactatacagtatttcaaaaacaaatgcatataatacaaaggatgatatttatagaactttaataaatacagagctaggaattgatgcaactatgaaagaagaagtattcaattttataaatgaaaataacaatgttgaacagaacatcttatcagttgctagtcaattaaatactacagaggcgaaggatttatacataagtattaataaccaacttgactcaggaactgactacaattccattctgaatatccttgatgccaacacaaaaaatattgatggtattagtgatgacttcgacaaacaagttttaagaatatttgttgcaactagtagatcttcagcacattattggtatgttgaagctgaaaatacaacttcaattactagcagagccactccaaaatgggttaaaaaagacggtaatggaattgctcaggctagcgttggatgggctattggtgcagcttttctaggaggaggcccagctagttattttattgcttgtggtgttggaggtgcacttgcttcagtatggccagattaa

SEQ ID NO: 713 - DNA, 600 bp, Chryseobacterium sp.
atggatgttaatgtcattattcaagtaattgcttcgatttttacagttataataactgcaattttatctccgcttatttcaaattattacataaaaagaaaatttagaaatatgcaatatttaattgattctcatcagatattacagtatttggcagaaaatttcaggaataaatttgtcgaaccaacaatacaggaaaacttatttttagttatgactggtattaaaacaaattataatagtattggttcatacattgaattaaagaatttattaggagaaaattttaattgggaaataataaaaaatgcaaaaccacatttaaaatttgataatgaaaaaaagattcatgtaagacttcgcagatttcaaataatttttatgaattgttcattaattctagcatttcttttgacaataatagggtttttacttttaatgtatttttctcaatttgaaattaataatttctccgaaactttattaggatatatattaatatttccattttttttgcttgcatatcttttaattagttcgatacaatcaattgtaagtgccaatattataaaaaagaaaattgaaaaaatggaatcttaa

SEQ ID NO: 714 - DNA, 480 bp, Chryseobacterium sp.
atgcaacaaacagaattaacattaacaaaatttaaagaatcattcttgtataaaatccaacatatgtcacttgatgagattgatgaagattgggcagaagatctattagcagaacgagattctaaagattttgaaccgaattggaccgaattacatgaaaatcaaccatatgataaaatttattctgaacgcattaaaaaagatgcagaagatatttataataatctccccgaagaactgcatcacgaacttaggtttgcaatatctgaagattatgagctaatagcaacttatctgattaatggagaggataactggcacatagcatcaatgatttcatcttatacaaacgatgagattcctctttcgctgactgaatcaacagcaattagtcatgcgtttacgaaatttaagtcatctgtaagcagatcaaaattaagaaatgagcttaatcgtaatcataatcattatggagagtaa

SEQ ID NO: 715 - DNA, 519 bp, Chryseobacterium sp.
atggaagaaatagaaacaatattaaaacagtttaaagaggcattcattttctcaattaagaaaatgcatttagaaaatgcaggtgaagctaagataaaatctataataacagacagagaacatgaaagctttaagtccattatggatgaattaaaggaaacctgtccaattatcgaagacgattattttgagtgtctcaaaaaagacatctatgatgtctatcaactattaccaaaaaacctacattataaatttataaacgctatatgtgaagactacttgttaatggcagcttatttaatttgtgaaaaaaatgattggcgtgtttcagccatgtatctgtcatattcaaacagagatattccaaagcgtacttttttacccgctaataaaaatattaaatacgcatttaggaatttactatcacctgtaaatgtagcaaaaatgcaggatagaataaaacaaaggcgtaactcaaatatgctaaatcagcaaatagacaataagaagaataattaa

SEQ ID NO: 716 - DNA, 243 bp, Chryseobacterium sp.
atgcttagtcttcttcagacaaaaaatgtccttacaacagaagaagccagcttgtatcttaacataagcatacccactctccgagaacttcgtcgaaacaagaaaattgcttcctaccaaccaagcaggaaagtcttttacaagcgtgaggacttagatgactggcttcttaatagtaagcagtcggatgaatctgcaatccaaagccgtgtttcagggtatttcttaaaatcaaaattttaa

SEQ ID NO: 717 - DNA, 1197 bp, Chryseobacterium sp.
atgcacaacttcgaagaagaccatccagaatttgaagccgactattttgatgcggaaaacttttttccccttgaatattatagagaacactatgagaaagcagaaaaagaaacaattcagtactttcaccataataaacataggtatgatgaattacaaaaaggattccccaaactttcagtctcaacactgaaaacaatggcttggaaatcatatagtcccaatatccattatgaagaaaaattagccgtatgggaagaaagtaaaggatcgccctttaatacggaataccatttcaaattcaaaattaaaagcaaagaaaaacctttgactattgtagccagtatccatcccaacaatgagctgcaaaggaacctatatctacaattcctaattgaatataccagcgaaaaatatatccaaaataatgaactcttcggagctgaaatcttcccttacgctgatttaaaaaataaattcttaaaaaataaaccagacgccataacagtagaagaagaaaaaacatccattatagaaaagtgtaatcaaattaagaaagactgctcattatccgtagattttaccgactatatccactaccaaaaaagccattacaaaaatctatcattgttgaagataaaacaacttgagagaatagaaaacctttgggcgttggcaattgaactttctttttaccatcactatgcaaaatattacttgtttttggcatcctatgagaatagtgataaaaaagaaaaaaaacgatatatctccgaagaattaaaaacttttaaaaaagcagactactttgatgatgtcaagctattcaaattgcatacatcgcttgtggataaaaattatatctcagcaattaaatatgaagatttcaaaaaagtgtttaccgaaaccgaaatcaaacacggactgtaccgccatccgaaaataaattggaatctgatcaatagaggaatggataaacagtcattattaaccctaatagaatatgtagtaagccctgaatatacagatgaaaatgtagctataataaatagaattataggagcttgctttacctttgaaaacaccggtatttcagataaaatagaaaaatcatttaatgacgcgtttaaatcgtttaaaaagaaaaactacaaaaactctgaaaaaatagaagaaattatagataaaatactatag

SEQ ID NO: 718 - DNA, 402 bp, Chryseobacterium sp.
atgcattattggagagatcactatataccacctaattacaaagaagaaataagaaaaattttaattgacttagcaagaaaaagggggaaaataacttatcagaatttatgtaaaaaatcgggaatatcagataataatcatattaaacctgataacaaaatgcctctattatttaaacttttaaaggagattatgatagttgaatataaaggtgaaagaccctgtttaacagcaattgttattaattcaagtactgataaaccatccctaaatttttatagcatagcagaagaaattggaattaaaggtaaagatattgataacgaaacatttttaacaaatgaattggagaatgtttattctgtatgggaacacgaacatttctatagaacttttagataa

SEQ ID NO: 719 - DNA, 378 bp, Chryseobacterium sp.
atgagcagtaacatcaggattaatcgcatttgtagctattgtaaccaaacattcgtagccaaaacatttactacaaaatattgttctcacacctgcaatcaacgggattataagaagaaagccaaagaggaaaaacttcgtcaatccaaagaagaatttagtactgattcaaaagttagtaaactcaaaaagactactgctacctttgatatagaacagttaaaagcaaaatcttacctcagtatatcagaggtctgtgtccttttgaatatgtgtgattctacggtaaggaaacttattaaagaagacaaaattaaaacgctacggcttggtaaaaaacatattatcccaaaatctcagttagagaatttcatttaa

SEQ ID NO: 720 - DNA, 750 bp, Chryseobacterium sp.
atgaaaaataatttattatttgggatttttctatttcccttatgtgcctgtgctcaagtaggaattaatacatcgacgcctcaggcaaaacttcatatcaataacacaggagttctggctcaggcttctgcattgaagatagaaggtgaaattcaggtgcagtcttctgcaattactcctgcttacagaaagctcctgttaaatgctaataaagatgtggtatctgttcctgctgatgcggtaatattccgattgctctgtgcatttacaccttcaacagatgccggaaccgcttatacgacagccgatttaggaaacgaaatccgtagggtactctttaatagtgttaagtatgaggctgatgcaggttcttttaatgcggtaacaggtgtttttacagtgagtgaaacaggtttttttaaaattgaagtaggattattggttaggaatgccaataatatcgcagcgggtactgctcctatgcgtctgggagtctctgtggccaatgaaacaaatttccagaatggaaatgcaagttttgcctttttgacgcagagacttaaccaaagtactggttctaatattcctgattgtattcaggtatcaggtatcatttatcttaatgcaggtgatcagattgctgtaggaacaagatatatgaatccaacagcgtggccgataaacacggaattgattaattataaaagagaaaatgtgaattatttaacaatcacttatttaacacagtag

SEQ ID NO: 721 - DNA, 516 bp, Chryseobacterium sp.
atgaaaaaaatatttatccttactttatttgcttctattagtttgattgctcaagaatgcaaattttcagaaatgaaaaacgttactggacgaggaaagtgcaattcttatgaagctagtgacggctttgtttataaaccaggtgataaaattataattggtgtaccttcatcgaacaaaacatttgcttttattgacttgtcgagtggacttcaagtggaaccattagacgcaaagtcaagtggtaatgaagttgaaattaaacgaatttatattgcaggtatgtctagaactggttattacgcttctttcgaaacaaaaggttccacattcctacatcattatttcataaaagctgaaaaagctttagaaacaggagaacttagagcaaatggcatttcaagtgatgccgcattagctgaattaaaaaagctgaaagataaacttgatcttggcctaattacaaaagaacaatttgatattaaaaaagacgaattgagtaaattcataaagtaa

SEQ ID NO: 722 - DNA, 987 bp, Chryseobacterium sp.
atgaaatttattaaatacgagatacaaaaaggagatacattagagtcaattgccgaaaagtatgcaagaactgtaaatgaagtattggattttcataatagtcaatctttacttactcagcaaatacatagcctatctattcccatacatattaaaacagttttattaaacgccgaatataaaaagcctgattctttaagaaatataaatatttataaaataatttcaaaaaatgaatattttaattttaaaaatctggtgtattctacaacgaatgagattacagttgagattgaaaaattagataattataaatattttgttagtcaaaagtctaaaaaaattgaatgcagttcatcacattatgataattatttggttttattatcacttcttgatcagccctttgaagatattgttttaattactgatgatttcggaaaaattaaaaaaattggaaaccaaaaagaaattaaagaaaaatgggatatgataaagcaagacctatcacaggttactgataataaggaaatgttaaatagacttattaaggacggagaaaaagtttatagggattctttgccacacatcacggctaacctccaatataatcttctttatccggggaaatttagttctgatagtattcgtaaaattaatgaaggagattcgatcaaactttattcttcattgttttcaggctctaaaattttgttgaaatttaaaaatagaattgttgagaaaaatgataagagtataattgtagaaaataaatcctttttagaaaaaataaatatagaaattctgaaagaattgtataatgtaacttttagagaattattagggaataactttaattacgatttcagtttgatatctaattataatattaaagataatatcattgatagctgtaatgcagattttattgaaaatattaatgatactattgtagcaaaatcaaaatacgaaattaacaaaatataa

SEQ ID NO: 723 - DNA, 510 bp, Chryseobacterium sp.
atgaagatatttattattataatttctgttataggaattttatatgttcctgccaggttagtaattttaaagaataaccttaatctcatccagggaactgttaaaaacgtagaaaaatcatctgacagattttcttattatcaggttcatattgatcaataccccaatactttttataattcaggaactggtttgttatctttttttaaagatgatgaaaagatattgaaatttaatataaacagagaaattaggttttatattaattctgaagatattgagaaattaaaaaaaggagaaaaagtcatttatattggtttacaaggtaaaaacatcatcattgatatattttattatcatttttcgaaacttagtaaaatgcccttttttttattttgtattctaatgatgtgtttaaacttttatggagtatttatattaaaaagtaagacctttgaaattttacttacagcttatttatttttaggaatgttaattttgatattatga

SEQ ID NO: 724 - DNA, 738 bp, Chryseobacterium sp.
gtgcgtttaataataattatcatagttttattttcaaacaatttcttttctcagtttggatcgccattcaaatttgactgtgataatttccggcaggaaattaaaactaattccaaagaattctccgtagaatttttaagtaaagaaatttatgattattattcaaaagatagcattcagaaaaatgaaattgtgatatctgaaaatttaaatcttaattcagcatttcaaaaaaaatttccagggactattactgaaaattgtgtcaatgcaaaattcttgaataatgattttattcaaaaaataaaaggatgtaatagtaatatgaaaattaacctccttgataaaaaagatagtttttatatttttaaagtatcaggttttgaaataagcggttattatgcctttgatgaaagaaataaagtgattatcacaacacaaaatttcccccagattattaatgatgaattgattattgatgttgggaaaaggttttcttacaaaaaatcaatttcatattataaaataaaaggtgggaaaatagactacattaatattgtttaccccgctttatatgaatacaaggacctcaaaattatcaaatccctaagtggcaaaatacaggcatttgttgaattaattaattttgatttcattgaagttcccagcaataatggcggagaaaaatatgaacgaaatcctaacaaatattgtattaaaagaatttcaatttactga

SEQ ID NO: 725 - DNA, 717 bp, Chryseobacterium sp.
atgaaagcacaaagaatactctgtatacatggaattggtggaaaagatgcacaaatgaacaacaaccaaggatgggtgagagattggcgccaggcattaaaagggcatctacagctcaacgatcaggctgtgcagtttatgccattcgattcattttttaagccatacaatgcaaatgcaggtgactatattgagtttttagctgaatcttttctagggctcttgcgatggagaagaagtcagaaaaacttttttaaagattggatggataactatccggatatggtagtcgaatttctaaaagagccgaaattacgccaggatcttcgaaaagaactgagaaaatatttagtagacatcaaccctgatgttatctatgcgcacagtcttggatcattgctctgttatgattatttttctcaacctgaaaatcaaaatggatatggccatattagtcttgtaactgcaggttcccaattgggaaatccttttttgaaaggccatgtgccatatcccattgttcgattgccattgaaacgatggtttaatctcaataataacaatgataatgtctttgccagatataacctacctgccaactatgataattttaagcaaattgaaacattatttgatgacaatgactttattaatcataacggattaagctatattaataatagcgaggctattgcaaaggtttggcaatctctataa

SEQ ID NO: 726 - DNA, 1425 bp, Chryseobacterium sp.
atgaaaaaatcatctaaaaccacagtatccctagatacgtttacgtacattcagggaaccggtaaacatctggaatttgcaagcaaagccatcaacatcctcacagaggttgtcaaccatgcagattttgagaagaaagtcttacaggctaaattttcctattgtgtactaaccaatgatcaaggaaaaaaagttcctgcaactaacgaacaagttattgcgataatcaaatccggaaaggaatggaacaaaaccgccgacaataacattaatttacaaatccaccttgaaaaactacgcaggaaaaaagtaggctatgtgacgggcacccagcctttgattacaacaaatacacgtttttttgattattggcttgttgaagatatgtttctttctttggcagcccattggatgcacgaatggcttcatgttgcgggttttagacatgaagatagctctgttgatgaagaagatatgaactataccgttggaaaaattgtaatggaggtaggtaaatcccttctttcttcaaaacaaggtaaaaaagaaacttcagatactatgggatatgttgaggctatggaagaatattaccgcattacaagcaaccctgcttttagcccactcgatcttaataaatcaaaccaaaatgcccttcttcttggatttgtggatacaacaaatcaatctgatgatgaaaatcagccgctgccgatcattccggcaagcagcaaaaaaatcggtactatccctgttacaaatacagcccttaaaactcttaatcttgaaacactagccttttacaatgatcatatgcctgatttttttggtggaacaaaagaagggatatttaaggtttctataaatacccgtaatccacaggtcccgacagatggacaacaggatgttactatggcggttaattttaaagtaaaagatggaaattatgcgcagggctttttgcatcggggtttatttagaaatgtacttattaccgatttcatcaaccttagatttgatctttacgaagtcgataaggatgctgttgtatattatgaaaaggtgaaaaatgtggttgattcggtaccggaaatgcgcacattggatatcgcaagcgggatcccatatcttaatcttgcaaccaaactattcgaaggaataatcaaaacttttggaaaaaacgccaatgatcaggtttgggacgagatgcctcagctggaagtatcagcatctacaggtggggcttttttaagaagtggcatctatgtcatttttgagcagaaaaacagcaaaaatgaagcagtttcttatgaagatctaatttttaaaaacaatttgctgcaaatcaatggaaataaaattagtaggatgtcaaaccatttactgttaagggttaccataaatccagcattgcaatccttctga

SEQ ID NO: 727 - DNA, 1740 bp, Chryseobacterium sp.
atggacaacaacagcaattttcaaaaccaaagcaatacagtaccaacttcagagagtattcaggatgactctttacataatacatgtactccatgtgaaagcttatataatgacagtcagtcatccgtggcttcggacattataaaaagaatcgataaaaaaacaggtgaaaacgttaattaccgactattcgataattctgtttataattttccaattgacgataatatctttaaaatatttgatcagaatacctatataaaaacatcgtttattgtcaacaacactatatttctggacgaaatggatgatgtgtatgacaattttaatgaaaaagatgatgctgcaaagtttgaaaaagctatagattatcttaaaactttcaaagggggaactatcaggttttcaaaacctttatcctttaatagaaaagtagaagtttccgatttagtgggaattaccatcgagggtgttcaatctccatattctttacagggtgccaattttaattgtggatacatagagtttacaaattctgataagattggtcttgttattaatggatttagagatctgactttaaaaaacataaattttgtctacaaaaaagatacaggttcaacagattacttattggaaatatttaaaggatatgattttgaaataaaaaatctgaaatttagaaatacagttttaggggggaattgtttgaaattaggtagagatacaggggtattatgtgcttttcagggggatatatcaagagtaaccactgtacaaaatggcggaacaggtatatataccgggcaaactaatacttctcttaatttcagaagctgctatgtaggaggaggaagatggcatataaaagggacggtatattctgcttttatctcctgtgcctgtgatgggtcaaatgataacggctatgtaatcgaaggtggcgatcagtcaagagcccatactttaacgtttatatcatgtggagcagaagctgccaatagaagtggtttctgggtagggtcgtatgtctataatattacttttattgcccctcattcaggattaaataaccaaggtcttcatccgggtatcggagagctattaatgcttgagaataatggaatcggcgagcaagaatcaataagagtaagtaatccggtatcattgaataaatcagggaatgctgatatctatggcaccagttcaagatgtgcttttttaatattagattcagtttataaagcatcgttaggtaaaggaattgatggagccagtgactggcggtataataaagtactccagataacagatgaatcttcatttccaaaaatcgcatccaatacaattaatcagtatggcagaatttcatcctataccagaaaatcagcaaatataacaggaaaccttagtggaactgaaacttggttttacttacaatctgagggaacatatattggaaaagatacaaaattacttggccttacaatccaggtaaataaaacgattacttcttctacgggatcatctggaatattaacttttggtgatggaatgaatacaagcagtgatattatttctaacataggattagtagctggaaacaaaattttccacacctttaaaaacaatgaatttgtagactttgatcatcttggtataaaatttcacatgaatgacaattcaatagtaaatgatggaaacattaccattgagctattttatgaaaaattatattaa

SEQ ID NO: 728 - DNA, 1725 bp, Chryseobacterium sp.
atgatcaaaaacttacaatacgttacttcctttaattcgaaagaaactaagaaagtaatgattatggagattattcacagcatcttcattgcagccccttcgggaatcttactgattatcatctgggaattattttcatctgatccggatacaaccagagtttggtcagttgttgctgtaatggctgttatgctggtcatccagttttttgtggcatcacgttcaatggttcggtcaaacattttggtatatgatctctctaccaagctgcggatcaaactgggaaaccatattcagaagttctcactgggatttttcaagcagaaagatccgggagaaattgcttcggtagttttacaggatgtggccaattttgaaggaatctttggccatagtattggaaatcttgcttctgcagcttttgggacggttgtactgtccgtatttttattgatttacgattggagattagctttatgtctgctggcagcattacctctggtatatccatttttgaggatagccaattatttggtaagccgcctggggaaaaaacagattgcggcaagaaatacagtgggagctaaatttttagaatatgtccagggaatccgtcatttaaaatcttacggtttaacgggtgaaaagtataaaggactggaagactcatttgaagatctgcggaggaagtctattcgcctcgaagcagttcccggaccatttattgttacggcgtccattgtgtttgagattggatttgttctgacggtggcccttggactatactttctttttagccattctatcacaattcccgttctgattacctttttaattatggggtataatctttataatccattgaaagtggtcatggttgattatctggtattgcggtatatgaatgaaagcttaagccggatcatcgggattttggaagaacctactatggaaaccggagaaaataaacttcctgaacactatgaaattcatttcaataacgtcagttttggataccaggataaaatgaccctgcaggagattaattttacagttccagaaagatctatgcttgctttggtaggccattccggttcgggtaaaacgactgtggcctccctgatcgccaggttttgggatgtcaacaccggaagtataagtattggaggagtagatatcagagagatagaccagagagaattttataaactcatcagtgaagtttttcaggatgtttatctttttgatgataccatttataataatattaaaatcggaaatcccgatgccgcagatcatgatatctataaagcgatggagctttcccaatgtatggaatttatcagtgaactgcctgaaggaatcaatacaagagtaggagaaggcggaagcaaattgtcaggtggacaaaagcagagaatcagtattgcaagggctttgctgaagaatgctcccattattctgctggatgaagcaacggcaagcttggatcctgaaaatgaaatttatattcaaaaggccattcaggaacttgtaaaatcaaaaacggtggtggtgattgcccataagctttcaacgatacaaaatgccgggcaaattgttgttctcaacgaagggatggttgctgaaaaaggaaatcatcaggagcttctgtctaaaaatggaatctatcgtagaatgtgggatatccagcatcagtccaatggatggaaggtaaaatcataa

SEQ ID NO: 729 - DNA, 558 bp, Chryseobacterium sp.
atgataaaggattatataactcctaattataaagaaatgatgaataaaagattgaaaaagtatcctgagagaatattcctgtttattggtttattcttttgtatgtctgccaggtcgcaggtcgccattggaaaaacagaggtaaatggagatgggatactggacttcgggaatctcccaaaaggaatagtattgccattattacaggtacttcctgataatcctgtgaatggaacctttgtcgttgatcgtaatgataccaaggtaaaggtattcagtaatggaaactggttaatgttaacagatgttacagggaatagtacaggtcgtgtagagaacctttcaaatgatgtgggaaagggggtgattattggtaatcctttatcaactgcagatggagtattgatattggagtcacaaaataaagctcttattcttcccaaagtagaaaatccacacctcaatattcctaatcctgcgattgggacaatatgttatgatagcataagtaaatctttagcagtatatgatggtaatgagtggcattactggaaataa

SEQ ID NO: 730 - DNA, 1650 bp, Chryseobacterium sp.
atgaaaaatatctatagagtagtaacaaaaattggagtaatattttttttgttgttttttaatttttttaatgctcagtgtggaggtacttctcctgtgctgaatccctcaatagtcaaaacctttgttcgttgtcctggaaaaaatgtatccataagccttagtgttaattcaggcttaataccaccaggagcagaagttagatggtttgataattctacagcttccggagttcctttggatccagataatattgagcatgatggagattactatgccttttattattatccgcaaattgcatgttacagcgagcctacagcacccgtaacagtgaaacagcttccgaatgttcctgcttatcttaatagtgagcctcggtattttgcacctgggcaaatctataacctaagaaaactggaggagccttatccaactgcagctggactagaggtaaaatggtactctgatgcagcagggactattcctgtatccaatcctcaaacagttgattttgccgggcctgcaaaccctggtcagcctccggttgccagaactttttatatccgctacgaaattaaactaaatgcatattcctgcaatgggcctttgcaggctgtagagataaaaaaaatagcaccatttccacaggtaagactatataccgatgcagaatttgatgatcctgctgtaacattgggaatgggatacagaattacaatatgtgagccaattgatctgactttgttagaagtcccggcagctccagctatggtaaccccgggaacattcgtaaaatggtattatgcgggtagtgttaatgctgattcacagattaatgccaatgttatagatccttcttactggactactataatcgaagttcctaatccttactttgctggtggtggttctgcttcccctcgctattatgatccggcaattgattattatggcccccaggggtaccatgatacatttagagcctatcatacacccacttcaacttatagaaaatatgcaactccaagagtaacaattaattttgataattcacctccaaatccatgtacaagtcttccaaatgggggagaacctaatgttcttaataatatgctgaaaatatgttcgggagaaacagcagatcttactgccccaggaatcatagaaccctggacttccggtggagtaaatattcaggctcctgttttatattggtatactaatgagtatcatactaattctcctgtaactaacccttctgcagtaggggcaggaacctattaccctttttattattattcagcatatcagttattccggccaataaaatctgtaacaccggtaacagtgacagaaagaccaaactgtaatgaatgtacacaacccgggaataaaatatcgcctgctggtaaatccttaatgggtatttcaactatggaagaacagactccgggatggccacaggatcacagcgcttttcttttactggaatccaaaaataaaggatttgtaatcacccggacagccggaatatctcagattataaaacctgttgaaggaatgctgatctatgatactgtagaaaataatttgaagctttataatggaacgatatggaaagctattgaaaaaagctgtaacgaatag

SEQ ID NO: 731 - DNA, 513 bp, Chryseobacterium sp.
atgagaaatgattttttccaagattattatgtttggaccaaaggtgaaatagaacagggaaaatggatggtaaccgctgcggttcttctggttcctgtcctgatactgctcgtgaaaaatagtaatgtaattttgcgtgggatgaccctgccgctttttctactttttgcagttaatattgggtacggaggctatttactgatgaatagaaatcaacagggacaaaaagtggaaatgaatataaaaccatccgctgacgaatctcttaaaaatgaatcccaaaaactaaaaaaagatcacactgtctttttattgctgaagaaaatctgggttatattaattattacttctttaatattatatctggtgatgcctgatggttattataaaggtttaacgcttggttttgccataatgtttgttggtcttttgacagttgatactttgcttcaccatagattaatgcaatatcttgagagtattgatttaaaaatagaatcaatatcaaaataa

SEQ ID NO: 732 - DNA, 1632 bp, Chryseobacterium sp.
atgaaaaattttatcttcctcatattatgtttcttttttagcagtatctattcccaggctttatctgaaaaagatctagacaaagagattaatgaactaggggagctaagcagtgttaatcctaaaaaagctattcaactttcaatagaaagttataattcagcaaaaaaaatagactataagaaaggcatgcttagcaatcttatgatccagatggcaaagtattttgatcttggagattttaaaaaggtaattgaaatcagcaaagaagcagaacttctgtcaagcaacctagataatacggaagacttatcaaataccttcagactcagagcttcagcctatactgagctgggattcaatgatgaaagcttaaaagactttaccaaagctttagaaatatctgaaaagattacatcttctgattccaaattttattatagagctcttatctttacagggataggaagctatatggcccatatcaatgctcccgtagattctgtaatgtcttatgaaaaaaagacattgactgaagctttgaagatgagtgctgataaaaactttgtaagtaaaaagtattacctgatttccaatgtttatacgaatttgggaatgatgactgtagcgaaggggtaccctaaaaaagcagaagagtattttaccaaagctttagaaatttgcagaaataaaaattacttaataaatgtacaaacagagatactcgttttaaacgaatttgcgtggctttattttgatcagaaaaactatgacaaagctatacaatatgctagagaagcggctgttatggagaaacaattcagttttccatacatccgaagagatatatatgaaattctgtttaaatcccaagtagagaaaggaaataaagaagagtcttccgaatacatggcgaaatttaccaagttgaatgatagtattgtaaatgcagaaaagaaaacgattaatactccgatgaaacatattttatctgaaaaagagagtgataaccatgattcaatgaatagaatattgataacaggggcagctttatttgttctttcaatatcaggaggatggatctattggaaaagaaggaataaaatcttacatcaaagttatgaggagatcatcgaaaacttaaaaaaagcagaatctgtatctgctgaagaaaaggatgttcatgctgatactctggtcatagaaaatgctggaaatattgtctatccccatgaaaaaacatcaaaccttattattaaaaataatactgtagataatattttgtcaaaactgaagaaaattgaaaattcacagaaatttatcaaaaaggattttacactcacatttcttgccagtgagctgaatacaaatcccagatatttatctgaaattataaaacaacataaaggaaaaagttacaataattatattaatggattaagaattggctatattaccaataaactctataaaaaccctgtatacagagagtataaaatcagttatctggcagaggaatgtggttttacatccagggaagtctttgcagttatttttaaaaaagaaacggggatgactccttcttattttatcagccagttaaagcaagaagaggtaatgtatttacaatag

SEQ ID NO: 733 - DNA, 420 bp, Chryseobacterium sp.
ttgcctgctattattttaggtagccttttcttaggagggagcaatgtaaaagcacaatcaaaacaagaagtaagttcagcagtgacaagaaaagtatttgagcatcatatgatggcttttagtaaaggggatgttgatgaaacattaaaagactatgcagaagatgctgtaattattgtggaaggggtcaatgaaaaaggttatgtaaaaggactgaaggaaatcaaaaagcaatttgaaacagtatataaagattactttcctccagctactaccaatctgaaagtaaaaacggttaccatagtaggtgaagtagcatatctgacttgggaaacatccaaaacagatttcacaacagatacctatatcattagaaatggcaaaattgtagctcagacgtttgctgcaaaatttaaataa

SEQ ID NO: 734 - DNA, 720 bp, Chryseobacterium sp.
atgtttgaaaatagagttgtccttattaccggtgtaagcagagatactggtttaggatatgaaacggcgaaaaggctaaaggaattaggattaactgtaattattacagctcgtaatctaaatgtagtatccaatcttggggaaaaactgggtgtagaggccaaacagttggatattactgataaagaaagtgttgagaatcttgtggcatcaattacgcagcagtatggaaaattggatgtattaattaacaatgctggcggttattttgatcaagatagtgatctcctgacagtagatataaattttatgaaagaagcactggatttaaatctttttggtgcgctaagaatgatacagtcttttattcctctgttgaaattagggtctaatggaattatcgtaaatgtaacttctggtataggatctttcagtgaccccatatttggtctggcaaactattatgcggatgtaccggcttttgctatctctaaattagcattaagtggactcacagtgaaattagcaaagagattgaaggaagatcaaataaagataaatgctgtttgcccgggatttgttgctactactcctgggttggaagactatggagcccgatctgttacagaaggggctaatggaattgtttgggcagcaactttaccaaaagacggtccaaccggaggcttattcagagacggagaagcaataaattggtag

SEQ ID NO: 735 - DNA, 375 bp, Chryseobacterium sp.
atgatggagcaaaaggatagaaaaaatgaaattacagaacagttcttatttgaactggataaacatttatcagaattacaatcgggtgaaatcgatgttgcttacgaaattaatgagtttgcaggactactattcataaaccccaatcacttaagtgatactgtaagtgcagtcttaggaaagtctccttgtgcagtatatgaggaaaaaattcttgatattgcaaaagaatttattatacattctgaaatgccaatcaatgaaatagcccaaaaactggattatgacgcctctaactttacaaaattttttaaacgacatacaggaaagacaccgatccaactaaggaaggcatttcgtaagaaaatctcataa

SEQ ID NO: 736 - DNA, 1425 bp, Chryseobacterium sp.
atgatccgttcacttctttttatggtactgattattttagtttcatgcactcccgattataagaagtatgaaaagagttttgatattcccctgatacacgacaatgaaaaattaaggttattaggcgaatatgatgctctcattaatctgaatacagactattatagaaaagctgatgagataggatatcaggagggtaaggctttgtgttatatgaacttagcgagactaaatatatcaacagaaaattaccagaaagcagatgttctttttaatcaggcggaaggaattttaaaacactcaaaaagtaatcttcatcaagctatattttataataattacagcaagttgaatgcagagatgcataaccttaataaatcactcgaatataatagttctgcattggattacataaaaagaattgatgagtccccccaaaaaaaagaattactgtcagaaatatatacaaacagggccgcctatttggaccttaacaaacaacccaataagtctttaccttatttgcgtgaagcccaattagtacatgaatcaagacgtttgaatgtaatattcggtgaacattatgtatggttcgaacagagactggactctgctgaaatatacttaagaaaagtagttgatgatccggataaggaaaaggcaatggatattgatgcccttactgcccatactattttagctgaatgttatatttgggataaacagtatgataaggctgaaaagaatcttgagcgtgctttagaaattgataagaaaacaagagatgtttatacctattataccaagtatatttacaacgattttaagtggctgtataaggagagaaatgatgatgccaaagcgtatttttatctgcagacctttgctgatgcaaaacataaaacgactgctgcattattagccacgattaatcaggatatggaatcttttattaacgaaacaaaaaaagatgctaaaagacatgatgataagatacgatgggtgatccttttgtcgggaatctgtttttctgtactggggatatatgcatggagaattatagacttattgaaaaagaaaaaaggaacacttaaaacagaaacagaaaaattaaaagcgagggtggaggataaccagcaggacgagattttggaattggcaaagaaaaatgatcctgagttttttaaccggtttaaagaaagctatccgcactttatcataaacctcttcaccatcaatcctaatcttgaagtttctgagcttacattctgcgccatgctaaagttacattttacctcaaaagaaattgccacttatacacttatccaacatcggaccgtccagcagaaaaaatatagaatcagaaaaaaactcaatatccctacagagatggatatttatcaattctttgataatttggggtaa

SEQ ID NO: 737 - DNA, 288 bp, Chryseobacterium sp.
atgatttgtcatttaaaaaaaattccaaaaactgatattgataaaatacagaatagaaccatcgacgagtttaatattaaactgaacgagtttaaaacttcacctgacagtttcattgaaaggaacaattacaatatcgataattcaagattaaaaagttttttagcgaatcattatggcattaaagaaaagaaaaatcttcaaaaaaaaattctatcttctctactaatgtcaaaattgattgaggattatatagaagtaattggtctttttatatgtataatatag

SEQ ID NO: 738 - DNA, 132 bp, Chryseobacterium sp.
atgtattttttattaagtaaacattgtaattttgcaaacagtttgctgaccttgaatgataaactttataagtttttaaattcaaaaagtcagtttttattatctttttatattaacgaatgtcagaattaa

SEQ ID NO: 739 - DNA, 1230 bp, Chryseobacterium sp.
atgtcagaattaagatttatagatttattttcaggtgcgggagggctttctgagggttttgtgagagcaggtttcacaccgattgctcatgttgagatgaataaggatgcttgtgaaacaatgaaaacaagaactgcatttcattggctaaaggagcatggacgggttgaagagtactatgactatctaaagggaaatgtgcaaagagatgaactttgggcaaaaatcccaaatcatctgataaaatcggtcattaatacagagatttctgaagaaacattgcctgatatttttgaccagattgacgctgaattgggaacaaagagtgtggatttggttattggcggaccaccctgtcaagcttattctgtggcgggaagagtgagaaaagatatgaccgacgatccccgaaatcatctctacaaacattatgtggagtttttgaaaaaatataaaccaaaaatgtttgtatttgaaaacgtaccaggaattctttctgccaataatggtcattatcttcagttgatttttgatgcagtacgggaagctggttatgaacttgataaaaaagtgttaaatgctcaggattttggtgtattacaggataggaaaagagtaatcataattggatggaagaatgatttggaatttgaatatccacaattcaaaaaaactgaaatggagtttgaaataggaaaacatcttttctctgatttacctaaaataaaaagtggagagggaagttggggtgttttgaattatacaagagctacaaattcttatctagagaattccggtatcagaaacggaattgattttatgacgcaacatatttcccgattcaataatgaaaacgatttggaaatttataggattgcagtagaaaagtgggtcaatgaaggtaaacgtttgaactatggagaattacctgatcgattgattaaacacaataatgtaaaagcctttaccaacagattccaagttgtaaatcataaaggagtttctcataccattgtagcacatatttgtgctgatggacattattacattcatcctgatattaatcaaaaccgatcaataactgtgagagaagctgcaaggattcagtcgtttcctgatgattattttttcgaatcaagcagaacagcagcatttaaacaaattggaaacgcggtacctgtattgatggcagaaggtattgcaaataaaataaaagaaatgattaaatga

SEQ ID NO: 740 - DNA, 1458 bp, Chryseobacterium sp.
atgcacgaattcaaagctgaaatagcccaaccgaatccaaaatcgactataaattcttatcgaagttttggatataatttgtctactgctattgctgatattgttgataacagtatttctgccaattctggtgaaatttcgattttgtataaatggcaaggtcaagattcttttatttccattaaagataatggagacggaatgaataaagatgaattggtattagcaatgactccaggaagtaaagatccgggagatgaacgctcggaaaaagatttgggacgttttggaatgggattgaaaactgcatctttttcgcaatgtaaaagattgacctgtgtatcgaagcgagcaaatttttcaacagttaaaaggtgttgggatattgattttataaatgatgcagaagaatggcaacttcttgattatatttctgattcaaatttgtttgaagaaataaatgagcaaaagtctgggactttagttctgtgggaaaaattagatagaatagtggggaaagccgaaagcaaaaatgaaagtgtaaagaatgctttttaccaagaaatggaaaatgtgcgagaacatttaagtttggtttttcataaatttattgaaagtaaaagaataaaaattttttttcagaatgaagaaattgaagcatacaatccttttctattgaatctcgatccaaagcctgaaatgggattgcctgaaaaatttgacaatgtagaagttatttattttattttacctcatatgtctgaaattggcaaggaagattatgataaaacgggtggttcccttggttggtttcagcaacaaggattttatgtatatcgcggagacagattattagttactggcgattggttaggattggagaagaaaagagattatgcgaaacttgcaagaattgcagtcaatttttcgaattcaagcgattttaattggaatcttgatataaaaaaatctaccgcaacaccaccgatcgaaattagacgggagcttttaaggattgcgaaaatggcgatcatgaaatctgctaaaatctataattggcgaggacaaaaaacggtatgtaaaatctcgaatttaaactttgagcctttatggaaggatgaaattacaagagaaggaataaagaaatacaaaatcaatagaaaacatccgataattaattcactgctgacggacaataataagttaatgtcaaaggctttgaaacttctcgaagaaaatgttcctgttgaattaatattaaacaaccagaatgaagatcccgcttttcacgaattagaaaaacattcagaaactccgagtgatgatttactgaacttagctgttgaattatataatatatatattcagcaaggtattccagaatctttagccaggcaacaaattatgtcttcaacaccatttaatttatttccactaatcaatgactatttgaaatga

SEQ ID NO: 741 - DNA, 2835 bp, Chryseobacterium sp.
atgagtacattactacaatcagcaagagcaatatcacatactttactatctctacatcagggagaaatcactgatgaagtattggtgaatataattgagaaaaccaaagcaatgaatattgttgaaggacaaatgtttgatgaagatgaattatttgaaattcttcgtgcggattttagtattggcaaaggggagataacaatattatccgacgaaattacgccttggctcaaagaagaaaaagcacatatcgactttgaattatggaataggtacaaattggatatgcacaaaaacgatccctcgtttcctgtaaatgatttggatgatttcacagataaaattttggataaatgtgtaaatccaaaaaaagaaggttcgtgggacagaagaggaatggtagttggtcacgtacagtctggtaaaacttcaaattatgtcggtttaattaataaagcaacagatgctggttataaagtaattattgtaattgcaggaacaatcagttcacttagaagacagactcaggaaaggattgattccggttatatcggcaggaacagttctgcattcatcagagaaaaccaaaacaaaattattggcgttgggaaaattaatgtcgatacagatatttattctttaacgtcctcttactacaaaactggagacgagggagattttagccaatccgttgcgaatagattaaacattccaatcggaaaaaatccggtagtctttgtcatcaaaaaaaataaaagtattcttgaaaatcttattgactggttttctaaagatatcaatgcaaaaatagttgatggttcgccgaaattatttgatgttcccattttagtaatcgacgatgaagcagatgctgcttctgtaaatgccagtaaaagcattgaagatattaaaactatcaataaattaatcagaacattactgaatttattcaatcaaaacacatttattggttatactgcaacgccttacgcaaacttgtttatttcacaggaacacaatgaatatgcaacgacaataataaagaacagagaatataaaattggcgaagatttgtttccccgagattttataatcaatataaaagcaccaacaaattacattggtgcagcaaaaatatttgggtttgaaagtccgaatggaatagaaaatgaaccattggatatttttagagcaattgatgattttgatccgccatttttcacaacgataaataaattcaacaaagaagatttaccagaatatcttcctaagagtttggaaaaagcaataaaatctttcattcttacttgtgcaatccgcagattaagaggtcacgaaagcaaacataattcaatgcttattcatgttgctttgttggtaaaatggattgacagagttgcttatttagtaaatgaaaaaacaaaagaatatgccaatgcgatcagaagtgaagatgctgtaatgttacaagaattgcaagaattatttgaatctgattttaagcctacgacagaaaatgttttggaaaatttagattacaaagacatccggataaaacagcattcctgggaggaaataaaaggtgagctgaaaaaggcagtttcaaaaattgatgttcgttctgttcatggaactcgttctacaaccaatttagagtatcacaatattgaggaaattgattacaacagacacgataatggtttgtcagtaattgcggttggaggaagccgattatcgaggggaattactttggaaggactatcaataagttactatttgcgaaccacaaaaatgtacgattcattaatgcaaatgggtcgttggtttggctatcgtccaggttatgttgatttatgcagattgtacacaacagaacaaatttttgaatggttcaatcacatcacaatggcaaccgaagagatgcgaaatgattttgatgaaatgaccgcttcgcatcaacggcctaaagatttcagattaaaggttagaaatcatcacggtttgatgacgattacgagtttagcaaaactcaatttctctacgaatattgaaatttcattctctggaactaacccacaaacttatcaattgttgaaaataaaatctacaattgaaaacaattttaaagcacttaataatctaatttctgttatcggatttcctgcggctgaaaacagaaaggagagtagaggtaaaatcagatatttgttttatccgaatcttgaaattgacccaatttgcgattttattgatgctttcaaaattgaacaacctagtattagaaatgcgacattgagcgattatattaaagctcaatctaaaaataataatataagtgaatggaatgtttgtattgtttctaatacagatgaaaaggtatttatcgattacgttggaaatacgcctttaaatgaaagacaggaaaaagaagatgtgatgacatatgatttacattttaataatgaatcaattacattaggatgcagtgtccgtaatcagcctaaaataacacgaacaagtgattattatttaattgccaaaaatcaaattgatgatttgaaagacagacaagtagatttatcaataaatggattgaaaacaaataaggaaataaaagaacagagagcttctgagaaaaaaggcttgcttttaatttatgccttagacgaaagagcaacaccaaatgtaaataacggaattccaataattggctacagtcttcactttccaaagattgaaaacgaagtgaaaacttcgtacaccactacgattttcgacggttttgatgaagacccacaagaagatgatgattctccaaataatgataacgaatag

SEQ ID NO: 742 - DNA, 966 bp, Chryseobacterium sp.
atggttaatataaaatcaatttgggaatcgcaaaagccaacgggcgacatcattataaaaacaagaattgtagatattctgcatctcaattgctacgccgcgaccaatcacatcacaggtcagcatttatacataatgtctgtttccaaaaatgtggaaattccagaactgaaaaattatcgttttaaaggtattgagatttttccggttgaaactgatgatttttgcgaactgaatatctatttattagacagtgatttaaaagatattttctcattattcatccaaaatgttctggaagatattgcggaaagtgtgacggaaaatgaagcagttacaaaaacgctgaatgttatttcaaaatggaaaaaactttttgataaaattaattttaatggtttaagcattgagcagcagaaaggtttgataggagagttacttttcattaatcaacttttagatgataaatcgtcctcagccattttgaacgcttggacaggacccgattttgaagacaaagattttgtttttggagcaacaggagttgaaataaaactcacttcttcaaaatatccaaaactgaaaatcaccaatgaaggacaattggatactcaaaatctgaacgatttgtttttgattttatacactgtggaagatgtaaaagaaaacggttttacactcaattctttaataggccagactcaacaaaaactggttgaaaatgttgatgaactcaagtttttcaatgaaaggctaatgcttttgggatattttgacggcgataaagaacattatgacaaaatgtattctttaaagaaaatacattcttattcagtatcagaacaattcccaaaaatcataaaaagtcaccttccacttggtatttacaacacttcttactttatcgaactttccgctgtagaaaattttgcagtagaaatggaagatattatcaaaaacatttaa

SEQ ID NO: 743 - DNA, 2385 bp, Chryseobacterium sp.
atggaaaaggcattacaaaattacattgatgaattaaaatctgacgtggcttcattggtttattcagacggagaaggagcaagttttgaagataaatttacagaatattgcattgaggtttttgaatctatcggaaagtctgagggggcaagagtgctgtcttatattcatccaaatagtaaaggaggaatcgattggaaaatcaacggttattgcttgaaagatcaatttaaggatgaaaataataaaacatattttgagactttagatttgtttataacgaatttcagaaacgatgactatggttatagttttaatgacagtagtgtttatgatagaactatcaatcaaataaagaaatttataaatgatgcttataaacggcatataaattacatagaccattctcattcagagctgtatgaattaattaaaataattgaaaagcaaggaaaagattttgatagaattaatatttatcttcttgtaaatggcttctcagaaatagaaaaaaacaggatagagatcaaaggtgttgatattgatgttttcgttcacacttgggatattgcaagattgtttaaaataaacgaaactaacagcgcccacgaaccgatagaaattgagtttgagaaatttactgaagaaggaaaggggttgcagtgtctgcaggttccaagcatcgacgaaatgtatgattgctatttggcaatagttcccggtgaagttttagccaatttgtacaaagaattttcaaatgagttgttggaaagtaatgttcgtgcttttttaggtcaagccggtaaattcaacaaaggaattcgggatactattcgtgcaaagccccagatgtttcttccttataacaatgggattactgctacagctgaaagtgtagtgacaaaatcagttgatggacaaatgataatcacccgactgaatgattttcagatagtaaacggtggacaaacaacagcttccctgtatcatactcaaaaaaaatataaggaggcagatttgagtaaaatttttgttcagatgaaactcactgttatcaaagataaagaacagaaaaatattgaagttcctaatatctcacgctatgctaacagtcaaaataaagtttctgaactggatttatcatctaacaacccttattttgttcagattgaaaatttatcaagaaagaaatatgtggtaaatccccagaacaaaaatcaatcacttctgtggttttttgaaagggcaagtggacagtatcgtgaaacgctgaataagcaaacactcagtcagcaaaagaaatttaaagaacaaaatccatctcaactgaaatttgtaaaatcagatgtagccaagtttataaatctttgggaattggaaccgtattttgtatctcaaggttcacaaaagaatttcatccattttacaaaaaaaataaacatattggtcagtaaaaataaattgcctggcgaaaatctatacaaaaaattaattgctaacgctgttttattcaggtccgttgacaaattattcggtcgaaaaaatattgatgcaattggagatactaatttgaaatcttttacagtggcttacacggtttcctatttccactatcttacagataaacgattagatttatggaaaatttacgaggatcagaaaattgatgatgttcttatgaatcaattcaaaaaacttcttgtttttgtgtatgatcatttgataagggaagctaataacagtttgatttccgaatatgcaaaaagagaatcttcttggaataaattgaaagactcaccttataacgaggatttaaagaaaattgttccggattatttgatttcacccgaagaaaaagaaaatagagaaaatgagaaggaagcggataccaacaatgaagaaaataggctttttattattagtgaaattcataaatttggtttaaagttttgggatggtttatttatatacctcggcagtaattccctggatggtttcattagaaattcagttgaagaagttttaaaaactattcaaagaaataaaaaccttctgccaagagatataacagttggtagaaaagtgattcagttcttatcagaaaatccatcgttttatgaggaaattaagtatttgtcaaaatttgaaaatcaagaatccgtagaaataaaatttatgtttgaccgattaaggcttctgtcaaaagatgattggaagaagataattgacttggcaaatcaaaccagtatttttacgattcctgaattaggtaatgtcaaatctatacaatccacattggcgaagaatgagcagataaaagaacagtctttgatgaaagcttatgagtcaataagaaaattgaaacggtttgggatcaacatctag

SEQ ID NO: 744 - DNA, 2175 bp, Chryseobacterium sp.
atgccacaaaatattccatcgggaagcttgtcaacagctcccgacagcaaagggcttaacgtacggcctgatcttctgccggaatctttcttcttcctggagaaagggcagataattaatcaggaagtgagcggaaaatttggagctaacgggactgtattcaggaccacctccaaagtaagctttaccggcaaagtatatactatttgccaagggcaggtatttttacaaccttgtggtgcagataccactaaagtaaatgcgatcctgaagccttttaatcagccgattaaaggattagcgatcaaatatatcgtatacagaggcctgaacagatcagacttctttgaaggcgatctgatcaaatcgacagctaccacaggttttgtagacgttatcagaaaagaattcacaggactctataatatgctgggaattactgtgcctccgtttaccgctcagcatatcgggtttccggcaggaactactcagtcagtagatgatcttattgatgattatttccttaagatttctaaagttgaagtcacgggaggtactgctactgaacaacctaaaaaagcttttgaactgcctatgatcccaagaggaacgcatcttggaaatgtcactggaagtataggaattgatatcgtattgaacgaaggagattatacgatagcaaatgatcccaacccatttcagttgaatctggcttttgcccgaagtgctgatcatgtcttagatcaggctattggtaatacagcttttaaaaagaaactgatcagggaaacagctacccagttccttgatattgccgccttttatggcttacatactcagggaaaaggaaaaattcatatgagtgacaattctgtcctgcaaactccagatgaaatttataatcaaattcagaagtttctgacagcacaaactacatatctgtacatccagggaagcagacaaagatcctataatttctacggaaatcagaacctggaaggaagtacccataatattaaaatcggaccaacagctagcaacctttccttagagcagtttgaagcaggctggccggtaaaagagcttgctgcacaaccatcattggtactgcagcttacaactgataacaatgatgccgctgccatgtacgtaaaacaaggtgttttacatgcagatacagccaatgaagattattttatcagaggtaaaaacttattgcaggaagaaggaaatggagcagataccaattttacgaagcctattactttcagtttaaataaaacaagtgccaataaaatggttgcttcgtttgtacagttgatttatgaagggaaaacagtgaaaatcacttctgaaacgccaggtccaaaccctggtgatcctgctgtaagtacaagctacgatttgaaggacattgatgacatctttggattgattaatgtaactcctaaagttcagtctaaaggaggtaatgagcttgcttatgtaattgatcagaatttattattgattgattttgaaagtaaaacacgaagaaaagacattgcaacggtgaccactaaaaaggttgaggatctgatcatgaaaaatgatacagaaagtttgccaagagttacttatgaaaccttgttgaacaatatccgtcagaatgtaggtggtttttttgaaagcagagcagcttatcaggataattctaatagtggaacaatttcatatagtgataaaagaaataatttttatcaacttgcttttccatattatttgcaaacagaaaaatattcaggagcgaatggggtacaatttactggagtatcattatatatggataatgggacattaccaagtaaaaaagttttgggaatcactgaagatgaaaataataaaattaaaactctgatttcagataaacttctgaataatccaaaattttattttaaaaatgaacttgaagaagaaagtgctttttatcaatcttccgaaggaatagagtataaaaaatattttctggcagtattaggagaggatcaagaaggaaagctcactattgcttttcctgatactcctgtatatgttacaactttagatagtcttgctttttgttcagaggaatatggcaaatggctgccaattacaaatagtattaacacagaacccattaatttaaaaatcttataa

SEQ ID NO: 745 - DNA, 3450 bp, Chryseobacterium sp.
atggaagcattatttttagcaaccagaattgctgtaagaaaagaaggtaaaacaccaaatggaggatcatataatcttttgccgaccggagctaataatacatttgtattaacgccagaagggcaagtactcgaatttagaattcaaaaaagtccaactacttttcttacctatatttacattggttatgaacttattctggatacggataaaccattattaacagataaaaaaaagtataaattcggacagttcggtggattttgtttgaatacagtatatgaacaatataaaaattttaagttatcactggaaaaatttttacagagcgataattggtttgataataattttgagtatgcgcagaactcggatagtataacaatagatagactagagtttaatgaaccggctaaatattataaacaaaaaaaatactttttaacggttacagaacctgacatggactttttttcgccggagaaatatacggattttgtattagaccgatcggaaaatttattaccaactccatcaggaagattttatcaaaagaatattcctgctattgacagtgagccaattaagaaacaacgttataccaaaacgatcacacttattgcctttcgtgcagaccttatttgtagagatatttttggaattatttcaaaggaaaatatttctactattaaacaagctgttttcaaaaaatatcaacaaggtgacggctcacaatataacagccttttgaaaattgatcagatcattggagagctattaaaagattggggatatatagatcaggtagaacctacttatatttttgatggtaaatcttgtgagtttgcagaagcctattataattcgatgtcaagtttttatagttcgctgagaggagctgataaaaatacatattttggatatgatagccacaataatccgttagattttaatggaagacctataactaacgatggtattatacaaccgggaggagctatgggacaggctactcaacaggaaaaaaataaagcagataatgaaaggagaattaatattttattaaaacatcttacaactgcgggaattggtttattagactatgacacaaggttgggctttgttgctgatattcttaataagccttcattaccaaaagaaagtggaagcgagcttacccaaaataatattttaaaagttatttcaacgtttgcaaatccagatgatgcagatccttttttaaattatcttctaaagaaaaataatggaaatttattaaattttcaaaatctttattacaaaattattgaatatattattgagatagacattcctgtattgggtattcctgtaggaaataaggaaagaagtagaaaggtattggtttatacgctatttacaatatggaattattctaagtataatcccagctatattcctgctggagtaacacccaattcagaagggcttaatccaaatagtttctttttaacaactccgggaaaatattattttgaaaaacaaaatggagagcctgcaacagataagagtttggaatttgaggctattgaagtagggcaagatgtcatatttaattattataaagttgacgaagaatttcatcaggaaaaaattcgtattagaaaatatgaaggaaggatttataatattcaagacaaagttactgatttatggtatcatctgtatcagccgatatttattatgggttaccagaacgtagaatcagacaaaaaagaaaaattctgtatacctgaatttccaagagttcctgcgtttatgttcttttattttaaagaacttgaagaaaagaaaaatacgaatgctcttattaatctgggagtacaggttacttctgatctcttattgatgtatttgacaggaggagcttctgaattattggaagtgagatatcttaagtatttatcagaatcagggaaaatccttttaaatccaaatctttataaaaatgcaaccaatgtagtcagattatggaatattgtaaatacatctgaacagatatctttcattgcatctacatttgcaaattttgcaacttatctgagtgaaacctccaataatcccaaagaccaggaattttacgaaagaatgagaaatttagcatttttggtaatgctagggacaggtttcggatcattaatagcacaagggaaggctgtaaaagaagctgacgtcattttgggtatgttaggcttgccagaagttactgttattctgaatgacgatgctaaaaagtttctgatatctcttgcacaaacagaaaaatacttagatagtattgttgataaaatttcaatgacttttgttccaagtacaggaattgatcctgcacctctcttaaatgcagttcaagctttgacaaaagaacagaagattgctttttattttgatttcatccatttggggaaagaagatcttcttaagatgggaaaggttgtgaatggtgaagttattgctgtgtcgaactggaaaaaattactggcagtaggttcgtctgatcgtaatactatagctatcattactgatatctcaaaaactaatctgatggaaaggttttataaagaaattccaatcaaaaaaattcttgaagcatctggatatgatagaagatggagtttttttaataactttaaaaatgtagattctacaacttttaataggattaaaaattatcctgaatctcttgaagtttttttcagatacactcctatatctcaaaaattgttaggagaaaatgcagacatttggatgaaatattttgaactaagaacattattgaaaaataaaaattataatgagatatctatattgttcaataaaccaataacaaatgcatatgtaagaaatgggtataaatatgttatagacttattggatccaattgagcttccttatattaatgctggaatagacatggcaattccaatagcaaatcgtattgatgatgtaagtgttattgcaaataaattaaatatatctgaacatataattcagagagcgaaaaaacatttttttattgatgaacattttattcttaacccgaaggaaggtttacaacttggacgatttgaaagatcaacgactgattgtgaagattggcttaaatttgttgatcttcccttaaaagatatttcaaatatagaaattataaaatttaaatggttgatagctcatgaatatatagaatctagacttatggaaaaagggatgaattttagaagttttataaatgcggaccatatgctatcttacgatacaggggctcattttgaaagcattaatatgaataactcttataagtatgagtattataatttagggaaattaacaaatgctgctttaccgaatgatgacttatcaaatttggatcttatagtgagccaattaatagagattaacaaattaaaataa

SEQ ID NO: 746 - DNA, 621 bp, Chryseobacterium sp.
atgcaagatcaatttaataaaatactacaagaatttttagagaataaaaatatcacaaataataaagtaaacacagcaagtgtgttattatttaaagaatatttaaaaagaatgcatgtttggtatgaaaagcttaacatgggtgaaaaatggttttttatgtacagattggatgaggctcataatattgttcattttgttgattcacatttattagattcagttattactttagaggattttaggaaaacgtttgatataggtatgttttatgtagacaataaagggttagatataccaattctatatggatatatttgttgggaattatttaaagaatatcctcagtttaataaatataaggatttacctgatccttatgaaccagttattaagattttaaagagagggaataatataagaaggggagaaatgaaatcaattgaaataaatggtcaggttatttttaaagatttagattttactaaaaattatctaccatcatttgatgatgagtttctcaactatcttgataataactgtgaacgattggcagataaagggattcccaattcagaaaaaatacaagatatgtggaaagaatttagagaaatggaataa

SEQ ID NO: 747 - DNA, 1671 bp, Chryseobacterium sp.
atggcaaaaaaaacaatagctgctttaaaagaatattttagagcaggaaaaagaccaacagaaagccagtttagtgatttgattgatagctatgtgcatatggatgcttttaatcctaatgcttatttgccgctatcgggaggaaaaatgtcaggagtcttaagtttagggaatacaagtacaacgtggatttccagggatttatcagatgtatcggttaatagtaatttttccagatattttacaaaactgacaggttctaatggagatgttgacagttttggatattatggagcggtaaccaatactggatcggtaacgatgaattggggatttattggtggaattgcctataatgggaaaaatgccatcagatggactccggatcagagagtcgccataggaggaagtgctgccgtaattccaactaccggatatgcattagatgtaataggaaatgcgtatgtaagaggagatgtaacctttgccggtggcctgaatacctatcagggttcgttgcaggttcagcatctaaatgttaataaactaagagcagacagtgctaacaccatattatcggcaggatccaatagtggaacaagtggaatatttttaagaccagcaggagatacagttaccaccaatcaagttatcgttaatgcgaacggaactcaatatgtagataattataacgtactttttggatctcaaacaaccacaggatcatctgtttttcataccaatgtttcaggagttaatacccctggttatggtatatggatggcacataatcttcagtttaacggaacagattttattcagccaagagcctctttgaattcctgggctttcacagttaataatcataaaggtttttcatttaacagagcgaataacagtacaacaaatggttcagcagtatcacttattgaattggtaaagatatcaggcacaggagtgatcagtactttaaataatggaagttctgaccaatggaatgcagcttatggctggggaaatcacgcaggaaaatatatgcccataaatcatgctactccggttagtgcgttaccttatcaaaacgatatgttagcagtaccggtaggaacgtatgttgcagcagtgagctcgggatctcccaatttaccttacacacaggcaggtggattgatctcttttggtaatacagctgtttcaacgagattacttggagccagggataattcagataatttatggtttcagtccggtgacggcaaaggagcatggaggcaacttgcatcaagagattgggtgattacccagctagcttcagcatccaaagttacaatgtcatcagctgaagtatcctctgcaccagtaagggaaacgaatatgcctactaagaaagagtatgaaattgattcagccttttatctggaactaaacgatgaaacagagttcattactgttacaggtaatcagccgtccgatatgatttgtaatataacggaagtatattctcaacaggaaatgaaaattatcaatctatccacttcttctttgattaaacttcagataaaaggaagttcagcggttgtagtagagccaatgaaatacatgaacatctatatcacagagaatgtaaaagtaattaatcttggacagtttgctgtagaagttttggcttaa

SEQ ID NO: 748 - DNA, 1455 bp, Chryseobacterium sp.
atggcaaaaaaaaataaacaagaattaaaagaatatttcaaagctggaaagagaccgactgaaagccagtttgaagattttattgacagttatgtacatgcagatgaatcatcagaatattccacttccgttgaatttcctgccaattataaagtaggagactatatagagtttttacagtttgagccggcgagtgcccgggcagctggtttttttgaagtttctattgcatacacccgaaataatacagccagtgccgcgactcatattgctgcggtttctcacgcaaatccggatatatggagagaaagtggtacggttaataaaaataattatgtagacggtgctgaaaataataatcttaccgtcgatatcaatggtggcatttgcaggttccgtctgagagcattgcgtacctatggagctacggatcagaaattaaaagtatttattaaagtaagatctgttaataaaaatgaagtgtggacaaaaatagataacagaggtaatagtcttgccgctgttcctcttcagcccatgaccaatgagtggaacgtctgggtgggaaatctgaattctgcagaaacagccaaaataggactgaaagtaaatgcacagggaaatgttggaataggaacagccaatcctgagacaaagctgaatgtagtgcatgaaaactcgttgaatcaaaattcgacgattgctaaatttactgcaaacggtgctaccggaggaagtaatattgtgagcctttcttaccatagcaaagccaatctggaattaaattctggattctcaggcttaggaagaagatacggggattactttgactttaatatagaaaatgataattcttatgaccccaattttgggtctatcaatctcgtgacaagccaaaatgttcaaatgaccgtaagacctaatggaaatgtaggaattggtacagtgaatcctctggctaaattagatgttgtaggaggggtcaatattgcagctggatttcctatccaattagccggacatgcttcatctcacggtttgaaatataaaaggtataacagtgacaactctttgctggatggcccttttctttatggttggacaggaggtgctttaggaattaagaaagatgataatgaattcaatgttttgacctggaaagaaagcggtaatgttgctgtccagggcaaggtagaagctaaagattttgtagtgtcggctacgcctacagcagatcatgttttcgcatcagactataacttaagagagatcggagaacttgaaaaatttatttctgaaaaaagccaccttccggaaattccttctgctaaagaaatgacagacagtggattgtcagtaggagattttcaaatcaaattacttcagaaaattgaagaattaaccctatacatgatctcgatgaaaaaagagattgatgttttaaaatcaaattaa

SEQ ID NO: 749 - DNA, 1371 bp, Chryseobacterium sp.
atggcaaaaaaagatataccggagttaaaagaatatttcaaagcagggaaaagacccactgaaagtcaatttggagatgttttagacagttttgcccatttggatgacgccaatgtattttcaccccattataaagaaaaaagtaatctgagatttgtctttcctgagcagcaggcagatcaggcaatagacatactgttaggaaatgtgatcattcatggatgggttgaaattgaagtggctgggtttttcaattttcagaatagtgtagggacgataaaaaaacagattgttattggagcttttaatgataattatatctggagacctcctgtatcaagaatcattgaggcttcaggagaaattgtagataatatttacctcagtgatattgtttgggatgatgtcattaaacaatataaaattacaatttatcataccagttcccggggaaatgactatgcagtaaggatggttcatcattcaacaacgaatgcggttgtcgacaaagctatactttcagatatttatacaaatccgcttacaggacagcggaaacattatgtacattataatgagaatgtagggataaaaacaaaaaatcctggtgctccgctggatgttcagggaaggatattatttgatatcgattctcctgctgtaggcggagttgccatcagagggtatgagaccatgtgggcaagaggatataattttgtttcatccgatggaactcaaaatacaggaggttttggagctgtgggagtacagaataagattaacgaatattatataggacagtacgaaaacagggttgttacatttaatcctgaaaataagcaaagttcatttggtggaaatattaacacgtacggtgaagtaacatccagaagccaaagaatttttgattattcaccaactatttatttagatagaagcgaaaattttggtgggtatattcaaggaatccaaacaaggttatcggatggtaccaacaattggttctttggaaatgcacatgcagatacgtttgttatatcaaccggatcatataatgaaggaaggcagcttgttattaatagaaatggtaatgcagcttttcagggcaaggtggaagctaaagattttgtagtatcggctacgcctacagcagatcatgttttcgcatcagactataacttaagagagattggcgatcttgaaaaatttatttctgaaaaaagccaccttccggaaattccttctgctaaagaaatgacagatagtggattgtcagtaggggattttcaaattaaactacttcagaaaattgaagaactaacattgtatatcatctctctgaaaaaagagattgatttaaaatctaattaa

SEQ ID NO: 750 - DNA, 543 bp, Chryseobacterium sp.
atgctagaagttaatttaacaggagagattagacatcactatgatgaagaaagttctttacctgcacataatttagtaataaagccattactagaacaatcaaaatctgcatatattttcggactaaaaaaggatgatgaactgttcaaagccaattctgatatattgattagcgaacgaggaaaattcaggtttgactcttcgaaagaatgcataattggacacgaacaattatggaatgcaacaatgtggaaaagaggatcaataattatattacttcaaggagacgaatttgatttttccgacatttttaaaagcacatacagacctgccttaaccttaacaccaaatatgggaaataccgtttctgcgacaaaaaggtgtaaagaagaacgtgagttagggaatattgctatttgctttccagcatcaaatggaatagaatggatgacaatttatgcaaacgacaaagctcttgaagaaataatgaaacaagcagaaaacaattgtagagagaaagcttattacacacgaaaagaatag

SEQ ID NO: 751 - DNA, 834 bp, Chryseobacterium sp.
atgatgaaattattagctgaaaatcattattataaagttaccgagcccctcaaaaaggtcactatcaatacactttttgcacaggatataatacagcaaaaaataaaagggaaaatatatgtggacaacattgatgctcccaacaccttttatatagttcacccttatggaatgactttgctattgggggcctataataatgaatctttcaacgctgattttaaaaaatattctcttaatatcggtaatctcagaaatcattttgaatggatgcaggcttatcctaatgcatggcatcccgtattagcagaactttataaagattgcatcatacactccagcgataacaaaaatcagcttaaccacggcattatagagctcaacacccgggtcaattttaaatttaatccacagaagtacagaggcattaaaacatcttccccttctgacgatgtgaaaatagtaagaacagacagcgtgattttccgcaatatgaaaggaagtgttattcctcattatttttggaagaatgaacaagattttttgaataatggagtcggttttagtcttttgtatcaaaaccagccggcttctactgcttattctgcctgcattcagggcaaccagttggagtttggtattgaaacagcagaagatttccggggaaaaggttttgcagaaatagtttgtttagcgcttcttgagtacgctattaaaaataattttgaacctgtttgggcatgcaaattagaaaataaagaatcttataatcttgctcaaaaacttggttttgaaccatcattagaaattccattttaccgactaagcaattaa

SEQ ID NO: 752 - DNA, 843 bp, Chryseobacterium sp.
atgaaaattcaattattgtgctttgccatattaatggcttttgcatcttgttctagtaataatgatgaaatattgacagaaaaagaacaggtcgaaaacaaaataaatgctgtcaataaaatatcctggaacttcccggttttaacaccctcttctccgggatatgaccccaattacacgtttgaatatgacgttcagggtagggttgttagaaaaaacggaggtgttttttccactgatgcgagtacaggtttcggttcagtatttacaaatacaatttatacaacgatatcatactccgggaatactgctgttatgggaacttacagtttagatccattatttattccatcattagatgaaagaaaatttgaatttgataatcaaggaaaaattatcaaatcattctttccagatagtagtcattattttgatagacagctaacctataattacaattctttaggaagacttgtggagattttgactgaatatcctaatatgccttatgatcccacagagcccaatgattatgttttaacttttatagaaaagtttagctatgatacctcgggaaatctaacaagagcagttacaacagaaaggaataataatgctgatatttgggttgtaaaagaaatagagttcagtgattttgatactgctcagaatccacttaaagggctggacgtttttgaagattacttttacttatccttatctaagaataatcctaaaaagaaagtaattaaaaaatatgttgctggaaatttggtttccgatcaatatcaaatatggacaagtcaatataattcaaacggaacattaaagctttatttttaa

SEQ ID NO: 753 - DNA, 1476 bp, Chryseobacterium sp.
atgttggtagcttccataaaatctaaattatccaaatcagacttcctgaagaagttggttttcggtactttttggatgaccttcggatcactgatgtcacggggattattttccttggcttccattgtattggccaggattttaaccgtttcagaatatggtgagtttggaatgataaaatcaacaatagataattttctgatttttgcttccttaggaataggcttaacggctactaaatatatttctgagcttaaagatgaagataaaagtgaagcatcttccatgctgggggcatctttatcattggttgtagcattgagtagtattgtcgcattgatcattgtattgctctctggatttatagcaactcattttctgaacaaccagcatttgcaggttcctttgatgattggtggttttacattgatttttatttctctaaacggaacacaaatgggagccttattaggctttcaggcttataagaaaaattccacggctaatatacttcagggactgttcctgtttctgggcttagttattggagggtattttggaggagttacgggagctttactgggtaacctgatcgggatctttctggtatctgcagtattacagaaactattgggggatgagagtaagaatcagcaggtcacagtgagtttcaaaaactggaagaaaagtgttaagaaaatatacaaatttgctattccagcttctctcagcacaattattgtggcacctaccatttggtttttaaataccctgctggttaaccagcccaatggatataaagaactagggctgtatagtgctgtaattattttctctacagccattcagatgttcaacggggcgataagcaatgtcttgctgcccatgtttttatcaaaatcggaatcaaagacccctaaaaaagaattttttaattatttcggatcatggattatttcgattataatctccattccgtttatattatttccagagatcgcttcggctattttgggtaaaaaatttgatatccatcagattgtcccgattttgggaatgtctattatcaccacacttattattacaaacagagcgggtgtttcaagagaccttatcattaagaataaaatgtggcttagtgtattcagtatggggcagtgggctgttacaaaccttattattttctatttcctgagacaatatggggcaatgggctttgctttttcctatatgatttcttatatcattaattatatcatttttgtacccttttttatctacaaaaaattatctccaccggtcatattctacagcaaatggaatatccttttatggctattgctgttaggcctggtatttataaatgttcagttgtatagtttattactgatcagagtaattgtttctgtcttattagtagtatccatcttattctcaatttttaaactttataaagaatgtttgcgaaaattataa

SEQ ID NO: 754 - DNA, 567 bp, Chryseobacterium sp.
atgtttgcgaaaattataaaattatactggcggttaacctgtgccaaaacggtaaagggaataaaggaaagaggggagaatgccgttgtttcttatcctattatcatcacaaaaccggagaaactgcacttgggaaacaatgtgtatatcggtcctgatgcatggatatcgacctatggtaaggtaactataatggatggtaccatcataggaccaagattaaagatctatacagggaatcataactatgatagtgatacactactaccttatgatgaagttacaattgcaaagaatgttgttataaaagaaaatgtgtggattggtggtgatgttacaattttaccgggaatcaccatagaagaaggagccattattggagcctctacggtcgttacaaaagatgttccgaagggtgcaatcgtaggaggtaacccggggaagattttgaagtatagagatttggaaaaatacgatatgctgaaaaagcaggataagatttatctgagagaaaaaatgaaaacgaatttaaagatggtggttaagaattatgaaagcaatatttag

SEQ ID NO: 755 - DNA, 1104 bp, Chryseobacterium sp.
atgaaagcaatatttagtggatattacggagcaaaaaattcaggagatgatgcttttgtagaagtttcagcgtggggaagcaggaaatactggcaatctacagaacagttgttttttgcaggagaactgccacagatttcaacgccggcggagcattattttgcccacaagaattacttaagcttcggcaaagcagtaaaagatattgtgttaagtgatgtttttgtttcagctggaggatcaacctttcattcggcattgaaaaaaacagatctgagaacctatgcaaaattgaaaaaaagcctgggatgtaaaggaaaaacaggtgctataggaatctctttaggcccatttgtaaataaaggggcagaagaagatactaaagaatatttaaagaccctggattttctggcattaagagatgataaatcgtatgagcaggcgctgagttataatttaccttatcagcctgtaagagcttttgatttagcggcacttcttcctgagatttataatttcgaccagcataccagggaaatttccgaagacttacctattgtgggaataagtgtttgtaattacgaatcatacattaatggagatattagtaaagaattaaatagaaatgaatttatattaaatttaattcaacaattaaggaaacataacaatattatgttccgctttttcgtttttaatggaaacgctgtaatgggtgacgaaaagctcaccctggaaatgatagggaatcttaataaagatggaaaactgaaatatgagatcgttccttatcagccaaaagttcaggacacttttgatcgaatcgctgagtgcagtgtagttatttcaacaagactacatgcaagtatttttgcgtgctatagcaatacacctttctttttattggaatatcaccgcaagtgtaccgatttcttgaatgatgtaggccaggcgcaaaactataggctattggatggaaatgtggatgcggaattgattgttaccgaaattgagaatattatatttaaaaaacagatccttgtaccgggtaatattaaagaaacaatacaaagagcccgtttaaattttacggcaacttattaa

SEQ ID NO: 756 - DNA, 855 bp, Chryseobacterium sp.
atgattactgtaataataccattatataacaaggagaaaagtattctggatacggtgtattcagttttgaatcagacctataaggattttgaactgcttatcatcaacgatggctcaaaagataacagcttgaaggtggtgcaaagcatatcagatcccagagtagtgatcatagacaaacctaatggaggggtttcatctgcgaggaatgcagggatattgaatgctaagaatgaatatttagcttttttggacggagatgatatatggcatcccgaacatctgaagattttatcggcttctctttctcagctggataacgagacggtaggaggtgttggaacttctttttacaaatcaaatattaaagaatttgatgagtcaaaatttaaagaggaaaagcctgaaataataaaagattattttgattttatgtcttcccctgtttctcgttttaactcatcaacattattagttaaaaagacgaaagttctgaagacaggtctgtttgatgaaaatcttagctatggtgaggatgttgaattttggtatagactgttttctgattatgcattaatctataacaaaactattacaaccatctactttgtaggggcagaaaacaggagtgcacactatgtgatgccattgaataaaagatttcatctgtttgattataaaaataaaacagcctcggaaaagaaatacctggataagttggtagccttaattctggttgattatttcagtcaaaaggcgtataaacaggttttatttattgccaaaatgtattttggaagattatttggcgcatttggttatctatttaatataataaaaaagaaaatgaaatga

SEQ ID NO: 757 - DNA, 1062 bp, Chryseobacterium sp.
atgaagaagcttttaatagtatcgctgatttttacatgtaccttatttatttttggacagactaaatatctggacttaacaacggttttgcctaaaggatatgtgacaaatgcaactgtagattacacactggttctgcagaaagcgatcaatgacaacggagacgtcttatttcctgactttcccgtactgattaatgataatgggcttaaattaaaaagcaactgtacctataaatttcaggccaattctaaactgattctgaaaacatcagtaaaacccggatatagcctgttggattgtaacagcaaggaaaatattaccatccttaatcccgtattggtgggagataaaaaaacacatgtgggtacaaaaggagaatggggcttcggaatcagtatacgcggttctaaaaatataagggtagagaatgctaagatttatgattgctttggtgatgggatctacattggacagctgaataataaaatttcagatcaaattgtgattttaaattcattggtatcaaacagcagaagaaacggtctctctataacatcaggaaccaatattaaaatctccaacagtaagtttctgaattcctcaggtaaaggaccttccagtggaatagatatagaacccaatagctctaaagatgagctgaaaggaattgttctggaaaatgtttttacaggaggcaatgaaaactggggattactgcttaaccttgttaatctcagaaaagataactccctgaataaggatatttcaataactattaataatttttcggatagtaaatcaaaatacggaatgtctttctggttaaacagaaaaaacaattattcgaaaaatatcagcggaaatattgttctgaataatatcagtctttataataatactgcggagcctatcaaatattatgatacaaatgacaataccattaacctatcagtcaataatctgtcggtagactctaaaagctatgataaactggaaagtagtgttcaaagttataagaaagacaatagaatacaatttaaacaactgaaatctaagtaa

SEQ ID NO: 758 - DNA, 1191 bp, Chryseobacterium sp.
atgcagatttataaaaaacaaatacattttaatgctctaagcgtattgatggttgtcacggcattcctgcttttcgtgtttcccaattcgtttagacctgttaagcttgttttgttgctgttgatttttctggtagggctaacgaaggtgcagaccattgaaagagcagttattttctcggtagtcttaagtatcattgtcacgattatttatctgatagttggtattcatcaatctttgaatccttcggaagcacttagccaggtcttaattgtatatattttcacccctattttatgggtcgttatcctaaattattgctttgaaaaatttaaggtagaaactatagtaaaatacctcaatatctatatggtactgggagcggtttctgtatttctggcaatttggctatttatgaatggaaagagaaagattcttgaactgattattgaggatcccaacatgacatttaccaaaaaagggattgttgaaatgaagcttttcgtttacggatctcttatatttttcattcctgcttttttacaattagaaaaagtatttaaaaagaagtccatttattttgttatcattcttacggttgtaatcgctgctatagtatccggaagatcagcattgctactgagtgtgtttgtaggactgtttttttatgtgattaccaattcttccgtaaagctggttaagtattttattatcggtttactgcttacagttgtgctgatttttattctgaacaattacggagtgaatgtatttaatgtcctggaaggattttatgtcaaaatttttgaaggcggagataaggccaggtcagaacagactatagcactgataaaaggagtcaataataatatttttggggcaggtcatggcgtaggagtagattacataaggagtaaaaaatttccttggcgttacgaaaatgtaccggtagctattatataccgggtgagcatatttggatttttaatttattctattccttttttatactcagtatacaaatatgtatccataaaaataagaaatccatacgatcactacatgttggcgggtattgtttctatgttgatagcaacttttacaaacccttatctggagtctttcgagtttaatatattttatgttttacccttcatttattttgtaaaaagagataaagattttcaatga

SEQ ID NO: 759 - DNA, 1056 bp, Chryseobacterium sp.
atgaaaaaaatattgttttttactaaatattcccctatgggagcgagcagcagactgagaagttttcaatttttcccctctttggaggaaaagaaatacgtcgtgcatcattcttctctgttgggagataaatatttaggagcactgtacaggaatgaaaaaaccaaatttctgtatctgtttcttggatatctaaagcggttgtacactcttttgtctgtgaagaaatatgacatagttgttatagaaaaagaattgtttccctatttacctgcgtgggctgaaacaagattgaaaaaagcaggggttgactattttgtagattatgatgatgctatatttcataattacgacctgagtggtaaccgatttataaagaagcatttgtctgataaaatagatctggtaatgaagaacagtaaatgtgtatttgccggtaattcttacctggcaaagagagcagaaatggcaaaagcacccagaataatagtactgcctactgttattgatgctaagaaatattataagatcaataataaagatgatcaatattttacactgggatggataggttctccatctacttataaatatattgaggagctatttccggtgttttatgagttgaataaagagtttcccaattttcgggtcaatatcattggagcaaaacaaacggaagaaacaaaagattttatacactttattccgtggacagaagaatctgaagtagaggagattaataaatttgatttgggcattatgcctcttcacgagactccttgggaactgggtaaatgttcatataaactgatccagtatatgggatgtagtattgccgtgctggcttctccggtagggatgaataccgatattgttattcctgggtataatggggaactggtgaaagataaggactggtattccggtattaaaaaatacatagagcataaagataaaacaatcactcaaggaaagaaaggaagagtactgattgagtccaaatataatagggaacataatataaacaaaatactgactgaatttgaaaactaa

SEQ ID NO: 760 - DNA, 690 bp, Chryseobacterium sp.
atgaaaattatttttaatgggaaaaataatgttatacattatattaaaataaagagacaatcaaataaaacgatagatcatatctatatttatcattcttacaattttttagttgaagattttctagtaggaattaatacaatagaaattataaataatatcagtacagagatttcatacttaaatatgattcttacaaaagccaacattcttacaaaatcaaaaacatatacgaagttggaaggatttattagggaggaagatggatatttatatgatcaagatattattgatactctttatgattgggataatggtaaaataatagattggagatctaaatctgaaaggtttaaagcatcttatattaatgcttgttctcttggaaattatagacaattcaaatttataaattctgaaaataaaatgttagatggtaataagataaattctgaaaatgaactttatattacgcttggagagcttttttatgggataggaggtttttttgggagtgggctagatggattatatgattacttaatagatgtgagtaaaaataattctcttaatgaaatgacccttttaattattaacaaagaaaatcttattttaaaattagagaaagattattataacgcttttgtgaaaattcttaaaaataaaaaattaaatgtaatagagaaataa

SEQ ID NO: 761 - DNA, 288 bp, Chryseobacterium sp.
atgaaaaaccttgaattaacaatagtatctgttttaaatgcagctgtccctgtttgcttatattacatgattatcttttatttgttctttacccatggatcaggaaacggtgcagagatctatgtggaaaactatggtatctactggatgctaggatatgttatagtgggaatcttgcaagcatttctggtatatcgtttttttaaaatacaaaagctttatcaatttcttttaatcgtcctaatactcatgatatattcttctgttgcttacaccaatatgtattaa

SEQ ID NO: 762 - DNA, 252 bp, Chryseobacterium sp.
atgattagactaaaaagaaatttaatgttggagaaggacgctttagtatatgagagctccttaatcaatgtaagtatcagagattatcaatggaataagctgtttcaacttccggttccggttccaaacttaaaactgaactatttaacttgtcttaccaaggattatggtaccggaaaatttataatatcaagcactgtgtctgcatacccattatctccaaaagtagctcttattcctccggaatcctga

SEQ ID NO: 763 - DNA, 831 bp, Chryseobacterium sp.
atgaacaataagtttattgagaaggattttgagtttgaggctcagattaaagatcatattgcatattttcctttagctggtgaaagtgagatttctggttttagagcaccagatagttatgtttttatattttttgagaaagctttcgggagccattttattgatttcgtcgagtacgaagaaaaagacaatcaggttcatatctcatttcccggacaacttcattcctggaaaacagaaaaaggagctaagggccataagttgattttatccaaagagtttatagagatgaagctatacaattcaagattttcatcgttacttctcaacaaatttccagtccttgatattccggtaaaaatcagcaaaaagctgtcgcgtgagtttaaaatgatccaggaagagtttggagaagagcctgtcaactgggatgtaataagctcgagggtaaaaattatattctcattgattaataagtgtactgatgaagcagaacaggatgccctcgtgatgaacagaaggagcccgattatcttaaattttattgaattgattgaggtcaattttactgaatcaaaagcagtagcgtactatgcagataaactggctgtaacccctaattatctcaatattcttacaaaaagcacactgggagttactgccaaggaacttattgatgcaagaatagtgctggaagccaagcggcttctaaagggttctgaccagacagttaaagagattgcttttaatctgggcttctatagtattgcatcattttcttcatatcttcaggggaaaacagggctatatcccaccaagtttcgcgaataa

SEQ ID NO: 764 - DNA, 513 bp, Chryseobacterium sp.
atgcaccataaaattttcaaaataatattttttctaagttttgtagttttctattcttgtcagagttcaaaaaaacaagacatagattctgttatatctaaatataatgattcagatttttctatttttaaagaatcttttattgcaattagacaaaaagataattcagaaacaatatatatgttaggagattcagaaggaaataaacctctttattttattgaatacaatgaagctagaggcgaaatagttaaaataaataaatcaatgttggagaaagcaaaaatcacggattattttaacaatgaggaaattgaaaaattaatatatcattttcgcaaatatgaccttgttctattatcagttgatgaagataataatgtatttatgaatccttttgaaattaattctcctgctttattgattaggtttgataatttaccaaatacaaaaaggcttaaaaaaggatatttctataaacagtatagaggaaattggtatttaaaagaatga

SEQ ID NO: 765 - DNA, 879 bp, Chryseobacterium sp.
atgaaaagaacaacggatatagaaaactatgatatactctatgtctcggagaaaataggattacagcatgtagatggaatagtgattaacaagactgaggatgccgtaagaaatggattgacaaatcatccacattctgtcaatggttttatatgtgcaatatgtgtaaaaggtaatgccgaattgaaaataaacttccagaagagaaaacttagccccggaactctcatgattgtactgcccgattcaatgatggagcctataaaggtatctgaagacttacatatagatactattttcttctctccagactttatttccagagattctttttcaaacaactttattttttttcagaaaatacgccaaacaccttatataaagctaaatgatgaatactttgaaatctttagaaagcatcatagtcatatatctatgcattatttcagagaacgaaataaaagtaagctggaaatcctgcaatttcttttattagctcttctttcagagataaaagacttatacgatgagtacccggagcagaataaaaaatatacaaggggaaatgaattgacatatcagttttttgatttattgtgcaagcaccatgaaaaggaaagacatgttttgttttatgcagataagatgcatctgaccagcagatacctcacaaccataattcgtaaagagacaggaaaatctatcctctcctggatcaatgaagctgttattgcgcaagcgaagtctttattaaaaacctcaaatttttctataatggaaatcactgacaaactaaactttacggagtcttctctcttttgtagattttttaaaaaacatactcatatgacaccttcagaatacagatataaatcttaa

SEQ ID NO: 766 - DNA, 429 bp, Chryseobacterium sp.
atgaaagtaaataaaccccaaaaaatgatgggtagatttttattaatactgctagcaggaagcatttttctgagctgtaagagcaatgatggtgacgatcccactccttcctccggtcatagcatagatccggcaacaggaacatttaagggtaccatgagcagtggtggtcaggattattataatgtgattattaatgcctcaaaaatagatgattcccatattaaagtacaggctaaagcaggagagaactattcatttattaccccaaaggtaatcagtgttcaaaatcctgtaggagtaggtgttggcggtgtggataacgaaggaactataaattatcttatttcaacaaaagcaatgcagataagtaccaaaaagacttctgaaaatgataaaatattttatttcgaaggcactaagcaataa

SEQ ID NO: 767 - DNA, 525 bp, Chryseobacterium sp.
ttgagagtatcagaattaaaagttcacagaataattcgtagaccatcaaaaatagttgacaagtatggcaatagaatttttgaagaatatgaatatgatttcaaatacaatccctattttaagaatagtgaaacacaaagattatttgccaaaatcattgatatattgccatttattttaatcttaatttttctatgtaacctgacagttcttcaaagtttattgtggtctgttgtcctagtgatgatgtatggagcaattagtgaaacaatctttggaaaaactttaggaaaaaaaatatttaatctaatggtaatcgatgattttgcccataaaccatcattaccaagatcattaaaacgaaatattctctgcttaataaatttctttcccacatttacagatcaacaaaacaaaacggtaatgaattttaatatgtatttaaataacaaatttgcggggacctatattataaaagaaaaaatgttgaaagaaatagaagaaatgctggaaaagcaagcataa

SEQ ID NO: 768 - DNA, 606 bp, Chryseobacterium sp.
atgggttggaaagcatcagctataataattaataaaccgacacaggtagacaacgaaacgctactaacagagctaggatttaataatctgacaagaattgaggatgagccttttgaagttgctattaatcctgatgacaacaaggtttatatcggttcatataaaaacaacttattggtttgtgcatccggcattccaacgcaattttttgacgagaatgaaaccccaatcgaaaaaacattcaaccggatttttccaaattctgaaatttgttcaatagtattacatagtgcaattaacctgtggggctattcagtgacaaagaatggaaaaaaaataagagcaagagcaggcaattcagatgatggaacatttgtggagattggtgagccgcttgatgaagaaaaagaacttttaagtaaatctaaattagatgaaaacggaaataaagtttatgtattagacgaatttcctgacgaaacatttagtgaagatcaggttggagaaaactttgtttttttaatttgtaaaagatattttgatcaagaacttgacagtgcacacgatttgctctttaaaacaactttagcaggataccagtattga

SEQ ID NO: 769 - DNA, 282 bp, Chryseobacterium sp.
atgttggcattaaagtttccagataaaaaagaacaatgcttgtttttcttaaataaagaagaactttctgagctggatgtactaaaacttaataaaattatatttggcgaggatgtttcagaaaatgtgagtgccaaaaatcacaggtcttacgataagtctaccatttttaaaattttggattatcaaaagaaccagaaactgaataatatacagactgccaggtattttggtctcagcagaaacacagtagcaaagtggaaaaaaatatttttagtctaa

SEQ ID NO: 770 - DNA, 195 bp, Chryseobacterium sp.
atggtattattgatcgttttaggagggatgttcaattcttgtggaggaagtagtgatgaaagtgaaagaggttcagaatcttgtacctataatggacacagactgtatgtaggtgaaaaaggagggtgttattatctttcctccggaggaagcaaagaatatgttgataaaagttattgtataggatgtaactaa

SEQ ID NO: 771 - DNA, 468 bp, Chryseobacterium sp.
atgtttacggacttatttttttactttttcctggcttctttagtatttgctattcttttaggaattttcttttctattcaaaaaaagaaaatgattacaagataccagcagccaaactcaaaagtcgtacggagtattagtgggacaattgttactaaaaatggctttctgcggaaaaaatacgaatggtgtagttttgatatattaatcaactccaattcaatatttttatttcccaagactttttattgtattcctacccgttttattaacctgatattttctaattctgataaaaggaataccaaaaggccaaccattttaagagaattttatatcagtaaacattctgtagaacttgtatcttatcctggttatcttatcaatggagaacgtaaaatttatttgaagaatctcaatcaggaacaaattatacttttccaaaacgtattaaagaaaaattcataa

SEQ ID NO: 772 - DNA, 213 bp, Chryseobacterium sp.
atgactccatcacaagaacaagaaaaacaaatcaatttaagtttgatgattttaaactttaaaattaatgctttacgagcctctttatccgaaaatcaagattcaaaatattggcaatcaatagaagaatctaaaaagactcttttaaccttattggataaacccctatctcagaaagaaattgacgaagcaataaattctcttgatatgtag

SEQ ID NO: 773 - DNA, 186 bp, Chryseobacterium sp.
atgacaccaaataaacaaaagacaaataaaaagctatctaaaattttaaaaactttagataactgtagtaaatttgaaatagaagcagtcttaaatgtagttactacatatcaagagaatttattgcttcgtcaatttctttctgagataggggtttatccaataaggttaaaagagtctttttag

SEQ ID NO: 774 - DNA, 477 bp, Chryseobacterium sp.
atgattaacattaaagcacacaaaattctaaaaactctttataaacattacaatgagggtgagaaaaaaactaaaggaggtcatgaagtaacacctataggtagatcttttactacaattgaacttaattctaaaactaattactcaatgaatactatcgaagatatttgttttagtttagagcagaataaatatatagaacaaacaggctccaatcaagatttcaaagtatatagatattgtataactccagaagggattgatgcatatattactaaacactacatttattctctacttgagattgttgtaaaatggattcccattctaatttctgtattatccttgtttgtagcaggagcagttggttggtatacgatacataatagtaaatcgatagaaaaactccaaaaccaaacaatagaactgcaaaaaaaagtgaaaacattggaagcaccccaaaggaaaacaaactaa

SEQ ID NO: 775 - DNA, 210 bp, Chryseobacterium sp.
atgaaaaattccaaattaaaattcgaagaactaaaaagtaaaatccagccattaactaaagatgcgcagggaaaactaaaaggaggaatatcttcaattgataattacgaagaaggacaaacgcccaagggttggaacgttcttgcatgtttttgtaatgtaaatatacaatgccctacacaacctactaccggtacaggtatttcctaa

SEQ ID NO: 776 - DNA, 678 bp, Chryseobacterium sp.
atgtttgtttttacaggaacaggaataaccgataataatataaaacagaattttatgaaaaaaataatgttttttttaagtttaataatggccttttcttgtaaatcacaacataaaaaaagtatgttgccctttatagataataagtttgaaaaatttgactctggtaagatgaaaaaatcttctcaaaacaattctgatgtattgagagagtttttaccaaatggcaattatattgaaattaatattgcagattcaggaaaatattatcttgagacttttaagaattcctattatacaatctcaaaatcatattattctaatggggatataaaatcaaagggaattggttttaatggagatggttttcaaattggtaaatggtatgaatttgatgaaaatggaaagctgctcaaagaagttgattatgataaaccttatcaatttacttttgaagatatcttaagattctgtgaaaaagaggggattccggtaacgaaaggcccggtattgcaaagcacaggttttcatactatcattacccgaagaatagaaaatgaaaaacctatttgggagatagaatggcttaaaaagccaagtttagttgaaaatattattttagatggtatttccggtaaagaaatttcgagaaaagaatcgaagtttattaacaattaa

SEQ ID NO: 777 - DNA, 426 bp, Chryseobacterium sp.
atgagaagaaaagattttttatctatactttcagcattcgcaatagccggatttgttctatttttatttgtttattcaccaagcaatggtaataagtttactattgcagatattaaagttgcaatagaagggaaagtaaaaaagaaagttgctgttagggaaggacttataacacatgcaaaaatatcaagatataataaacctgatactttgattttcctaggggaaagtgttgatcgtgtaaatgttggtgatattattttaaaagaaaaggattctccttttttttatatcaaagaagaaggagcgaagagaaaaaagcttacatatgtactaatacctaaaagcatattaaatgatgaagattttccaaaacaatggaaagatagttgtaaaacaagttggaaagaggttgtagtagattaa

SEQ ID NO: 778 - DNA, 429 bp, Chryseobacterium sp.
atgaaaaaacttataataaatttattaattgtagtgtcatttttaggcctatttttaactatcaattacttaactaggaattctgatgaaaaatttataatcagaggtattaagcttgaatttgagggagttgtaacagaaaaaatagcaaaaagaaaaaatctttatctcgatattaaaataaaacgagaaaataaaagtgatactattatagaggcaagtgagtttatttcagaaataaatattggtgacacaatcattaagaaaagtagttccccatatttttatagaataaataaaattggggtgaaaaaaattccatttatttatatccctgaaaaaatgataacaagtaagaaaattccggattcatggaaagatagtttaaatacaaattggaaacctgtagtaaagaaaatgaatccttaa

SEQ ID NO: 779 - DNA, 1608 bp, Chryseobacterium sp.
atgcaagcaaacaatatcacctttatattgttatttatttttctcttctcattggaagggaacgcacagtcatataataaaaataaaagtttgcatcctaaaactgcctcaaataaaaaacccggaaaaggaaaaacattcccatcagatttagaaggcgaatgggctgtaaactgcggaaacggactaaccaccttcagtatagggaaagaagaaaacattatatcattgtatggaaactctatatacattaatgtagaggtggaaaaactaactgatagggaatatattttaaaatttaaaaatatagcaactcaggaaaactgggtggaagagtcattaaaaataactgaatcagatatatcaaaagataaaatcattggaaaattctttataaaaaaagatggcaaagtagagcttcattggataggtttgtataatatgaaaaaacaaaaactggattactctggtaaaaaatattatgcagatgaagaacttattaattacctatttgtaaaatcagaaagaacaaatattgatagtctttccattaatttatataagaataggaaaactaacaacttagtagctacattaaataagcttatttcaaatgatgacatggaacagtttgaaataatagatgttgttgatataaaatctaataaagaaagtattcaagttgaaaataaattggaaaatggaaaaagaagattgctattattcaataatggaatgaagttaaaagaatggtcttttacatcaaaatcggataccttggataatgataaatatgtcaactattatatagatattaataaagataatattcctgacaaagtagtttccagtgctcctggaatgggagatgagctttctctctatataaaaaaagataacaaattcaatttagtattgaaaaccatcaacttctcccaggatgggggaaataaagtatctgatattaaagaaacaaaagagggatttgttattgtcaccacatttcccgatagaggatactatgaagaaaactatcagattatatatggtaataatagttttatcttaaaaaatgtagtttacaaaacaagttcatggcaggatgattatacaaaaacatatgtctgtaacgtaattcagaatatcaacatttcaaaaaatccctataaatttaaaataaaagggatgccgggtgaagagaatagaaatcaggaatgtagtgttgaatattactcaggaaaaactttacaagaatttatagatcgatttaaagaacgaaattcacctcaaatcgtacagggaattgaaagatataaacaattattacaaacatttcccattactcaacaaaatatattacaatataatgacataggatattatctacaacaatcacaaaataatagagaagccatttttctactcacaaaacttatagaaaaatttccaaaccgagtagtagcataccttaacatagcagacgcttattgggaaataaatgataaaggaaaagccaaagaatattatcaaaaatatatatcattgatgaaaacccaagataaagatttgaagaagataccacaaagagtttatgacagaaataaataa

SEQ ID NO: 780 - DNA, 573 bp, Chryseobacterium sp.
gtgccggctgattatgacggtgatggcttggcagatctaagtgttaaaacagacgctggaacttggcttattgattatgccaagaatggatttaacggttgggactggactggaacacaaagaggaggaggtaatgcgcatccagctccagctgactatgatggtgatggcatgacagatctgagtgtaaaaactgatgatggaaaatggtacattgactatgcctataacggtttcgatggatgggactggacaggaacagatagaggaggccttgatacttcagttgctagaaaagctgtggcaaataatatagagaacaaactttatcaaaacacacctaatccttttaatacttctacaacgatagaatactttctagttgacagtactaaaactgccgaaataaatattttcaaccaacagggaagacctgtaaaaaaatatactcttgataaaaaaggaaaggaaagtattagattagaatcttccatgcttccttccggaatctattattataatctcatcgttgatggccaacaattggacactaaaaaaatgatcatacaataa

SEQ ID NO: 781 - DNA, 378 bp, Chryseobacterium sp.
atgaaaaaaaatatttttgtcatagccacacttacggctttatttttagcctcttgtacaaaaaaagaaacaaaaccagaatcagctgctgttgatagtacagctgtgattaattcaccttcagctcaagcagctaccggtactgatgaaatcataaaaagtacaatggtagatgcaaaaggaaaaaaactggaggcaagttttaataataacaaagaaacggcgactgtagttttcgatggtgaaacgattgaattaaaagcccaggctgcaggatctggaatctggtataagaatgaccattatgaacttcgaggaaaaggctctgaaaatgaactttcaaaagatggaaaagtaattttcaagggcatcaaataa

SEQ ID NO: 782 - DNA, 705 bp, Chryseobacterium sp.
atgaaaatatccgtctgtttggccacctataatggaggtaaatatatcaaggagcaattagactctattatctcacaattgggtattgcagacgaaatcattatatctgatgatggttctacagacaatactttagatgttattaaagaattaaatgagagtaggataaagattgttataaatacgttagaaaaaggatattcaaaaaattttgaaaatgcaattagccatgcttccggagatattatttttctaagtgatcaggatgatgtttggatgggtgataaagtggaaaaaatgcaaaaagctcttggtgaagcagatttggtaatttctgatgctttaatttcagatggagatctgaatccaaccttggggtcacattttaatatacataaggtaagaacaggttttttacataattggattcagacaagatacattggtgcttgtatggcattcagaaaagaaatattaaaaaagataatgcccttcccgtctaatcaaaaactttgtgctcatgactattggatagctaatgtaggtgaattttactataaagtttatttgatacatgaaccattaataaaatacaggagacacaataataatgcatcaacgggtggggaaaaaagtgaaaatacaattctacataaactaaaagtccgattgtacacaataaaagaattattaaaaagaatataa

SEQ ID NO: 783 - DNA, 1446 bp, Chryseobacterium sp.
atgtacgaaaaaaaaatactagctcttacttttattttattttatcatttatttttttgtcaaacagagtttctcaatgtaaaaaactatggtgctacaagcaacgataatatagatgatacttctgcttttcaaaaatgtatagatatattggcaaaaaataatggtggtacaatgattataccaaaaggaacatatcatatttctcatctcaaattttttggaaaatcatacagcaatattaaaattattggtgaaaaagcaacgatccaacaaattacacgtaacgacagagtttcagtgcacaatggcctgttcaaaacttttgccgaacggtacgctgcagatggatgctttgtttttgatgcccaagtttctaaccagaaagatgattccaggagcataaaaaatattaaaatctccggattaacttttatttcaaatgttgaaaagaaagggtttgatgaattatcgcatcaaatttccgctcatggagtttcaggttttactgttgaaaattgtaattttattggttttttgggggatgggattgcaatcaatgcaggaactgacttagatgtgtttaaatatgcttataataaaaatgtaaatataaccaattgtaattttgatggagtgaataaagataatcgtcaaggaatctccatttattactgtgatggttttatcatcaataaatgtaattttaaaaatactacaagagatgatatgcctggagcaattgacattgaacctaatgaagatacgcaggtttcacgaaacggaataatatctaattgtacttttgaaaatattggaggaatttcttctattgttatacatacgaaaaaatcatcttcattaaatgacttttcgaataaatcatttttagtaaaaaactgtacttttaataatgtcaggtcaccctttgcagtaataggtaatgacagttttttgactaatggtgaagatagtaatattatagtttttcaagactgtaaagttaccaatagcagaagtattgcagacctcagaaaagcatatggtgtcatgtttaaaaatattacttactataatattaataatgttggacttaatacagtaaccgacagtggtgcaaaaaatatcagttttgataattgctctttcaatggaattaccaatcctaatggaattggattttatggtactaccttgaatatcaattttaataattgtagatttgaaaactttgcagccaatgcaatcacaatcaatgatcctaatggtattggaaacattattaacaatcagttcatatccagtaaatatccacaagcatttccagttgtgacctcaaaaatcagcaaaagcctgaagaccaaattagactcgaaaaagattagtggcaatagcagtaaaaatggtaattttcaaagtctaaacttagattattttatgcactaa

SEQ ID NO: 784 - DNA, 834 bp, Chryseobacterium sp.
atgaaaaatactattctttttggtattgttacctatggtgagatattttgggaatgtgatagctatctgtcattggtctcatcatataaaaaatcaaaacacaaagtagaattatcaattttcatttttgataatacagataaagataattggggtttaaatctacccccagttgatgacgatattaggttgaactattttcatgattcttcaaatcccggaatttcttttgcatacaatagcattgctgaatttgcgaaggaaaatgattttaaaactatcgtttttttggatcaagatacttctttacctgaagatttttttgaaatttattattctaattgtgccctattggatgaccaaaatcctattgcagtaccattaatatattcaaacaataatttaatgtctccaagtaatttctttagttatagatcttcaatactgaagactattccagaaaataaattagtatttaaagacatcagctttataaattcgggaatgttattgtctactaactttttttttaaagcaggcgggtataacaaaaaattacgacttgatttttgtgatcatgattttgttcaaagagcctctaattttactcagtctgtaattattttacctattatgttagttcaaaacttttcttctgaaacaaataacctacaaaaatcacttgtacgatatagattatttgttcaggatatgaaagaatatagcaaggataaaaataaatttttattttttctccgaatagatctccctcatttattaaaagaaacctacagaaataggtcgtttgagtttttgaaaataagattcttttaa

SEQ ID NO: 785 - DNA, 1068 bp, Chryseobacterium sp.
atgtgggcatattattatttattcatttttagtgctttaattggtgtgagtccacttcctaaaaagggcaaagtgataactttaattataattttgtcattatttgctgggacaagattggagattgataatgattatggattgtatgagtataatatacgatatatagaaacaagcattaaagattttgctaccagaaatattcctatggaatggtgtatgtatgctattcctaattttttaggtttatttactcaatctaaaactgaaattattaactatagctttttaatttttgccttattgggtgttggaactaagatgactgcaattagcaggttagctccttttttctttttgagctttctgctatatatgagtaacttatattttatgcaggagatgacaacaatccgggcaggagttgctgcaggaatttttttactctcgataagaaatattgaacggggagaaaatcttaagttttttttaaagattgtattatgtttcttttttcattcatcaagtgtagtttttgttttatactggatattgatcaaattaaaaatagatattaaatattactactatgcagtcattgtttcattgatatttgtggtacttaaattaaatattctttcaatactgatgttagatcaggtttttgatagagtaagaatgtacattgaagcaatgaaatggtctaaagatggaaatgttaatatattcaattttaaggctgtatttgcaactctaataatgatcatatttgcctataattataaaaaattaaaaaaaatagaatattttgatgtcctgttcaaagctcacgtattctcactttttctatttttcattcttagtatttctgcacaggttttttctttaagaacttttgaaatgttttctgtagtacaaattttattatatccttatttaatatatgtctttcctccaaagctgaaaatattaggttgggcaactgtttttatttttactataatccaggtctattatatcatagacgtggcagatatatataaaccgtataaatcttggtttttttaa

SEQ ID NO: 786 - DNA, 1065 bp, Chryseobacterium sp.
atgaaaataataattccaattgttggatcctttgggaaatcaggaggttttcgtgtattatctcaacttgctaattattggatcaaggatggacataaggtaatctttctgtcatatattaatgctgtagatccatattttccaacaaatgcagaaatactgtattatgacaatagtggagatgtaaaagagcaaaaagataataaccatcctaaagcttttttaggggtgtttcaacttaggaatgcattgaagaaagccctaaaccgattagaggcggatattgtattagcaaatcactgctttacggcccaacccgtaaaaaaatcttctattaacgcaagaaaattttactatatacaagcttatgagccggacttttattatcacaaaacaatcaaagattttatttttaaacgaataagtaaaaaatcttataaactaggtctggaaattattgtcaatgcttcaatgtataaaaattacaaggaaataaaaacagataaggtcatatttccgggcttagaccttgatgtttttaaacccttaacaataaataaagattctaataaaataattttaggaactatagggcgattagaagaacataaaggaacaatgtatgtagtggaagcttttaagatgttacgtaagaaattaggtgataaaatagaacttcatattggttttggagagaagcatttagaagacgttgagggaataaaagtgcttttccccaatggagatcaaaagctagctcaatattacaattctcttgatttttatatttgtgctggaactattcaattagaagcaatacattatcctattattgaatctatggcatgtagagttccggtgattacaaccggttattatccgtcaaatgatgataactctattattgttcctattaaagatagcatatcattggaaaaagcagtaatagcagctattaatgaaccggaagctgttgaattaagaaatgaagttgcctctaatagtgttaaacagtttgattggaacactatttctcaaaacatgattaattattttcttagataa

SEQ ID NO: 787 - DNA, 1440 bp, Chryseobacterium sp.
atgataaaaactaatcccttgagcaaaataaacgcagaaataaaaaaggtaagtccggtattggaaggccatatgactattcccaactaccaaagaccttaccgctggacagaagagaatgtccgtttattattagaagatataacccagagctggaaagaaggtaaaaattcttaccgcatcgggagtgttattttaaacaaccatgattcacagcttaatattgttgacggacaacaacgtattaccaccatattactcatcctaaaatctctggaaagtactataggatctgaattgaggaactcattacagtacaggcattcagattcactgaacgctatcatccgaaacaaacgttttattgatagctggttgcgggaaaatataggaaacagcaaaagtagtttcggaaaatatattttggattattgcgaattcgtagagatcagggtcgcagacctttcagaagcatttcagatgtttgattcccagaatggtcgtggaaaagaattggaggcatataaccttttgaaagcttaccatatccgtgctatggaaaacaatacctttgaagagaaagtaacatgcgatatcacctgggaaggcgctgcaagatatcaggcagacaaagaaagcagtgacgtttccaatctactgaggcagcttatcaatgagcaattgtacagaacacgactgtggagccgcaaagaaacagctcatgcttttgataaaaaatatatcaaagaatttaaaggaattaccgtcaataaaaaccatcctattgacttcccctaccaaaacagggaactgatgcagtatgtagtgcaaaattacttcaaatcaataggtgtttctgtacatggtataaaatcaaggtttagaaatatttcaccggaaaacatcaatccgtttgctttagtgaatcaaaatattgtcaatggtaaagacttttttgattatacggagacctatgttgaaatctataaaaggctctttaattctgagtttgaagaaatgaagaattttaaaaaatttgtacaggataactgtaagtatgtaggctcacatcgtgatggtgatcagtatttatttgaactttacaaatcccttatcattttgatgtttgataaatttggagaagaaggaatagaaaaatattctaaaatattgtatctgctggtttacagacttaggttagaaaaagaacaggtacgatataccagtgttgccgaatatcctgttcagaatgaaattttcaaaattatagaaaatgctaaatcatatgctgatcttttaccactagagaaaatggctaataaagaagtgatctgcaaaaaaaatgtaggatccattatcagatatttcatacaacaaaacattaaacttgaatccgcagacgagaagaaagttaatcttaaagactacagctttgcataa

SEQ ID NO: 788 - DNA, 1836 bp, Chryseobacterium sp.
atggaaactcagaatttaaataaaagcttacagaaaatatttaatcataaatatattatccccttgtatcaaagaaattatgcatggggtgaagacgagatcgcacagctgctccaggatctctacgaaaattttaaaaagtttgaaaccaatcaggatttgaattattttattgggagcctggttgttttgaagcgaaaagatggattttatgaagtcatagacggtcagcagagattaacaactttatccatactgctgagaatgcttggttgtgtagaagagcctaaacttttctatgaatcaagaccggaagtagaggctttttttaattcttattatagaaatggcaacacaaaagatgttacatttacctacaaagtttcaaacctcattaatgcagtagatttgttgggacaaacaatagtaaatccggatgaagctaaagaaaaaacgctttttgaaattcctcagattgatgattttaaaaaattcgtttttgaaaacgtcattcttgttctcgtagaaattcctcaggaaacagatgttgcctcttattttgagatcatgaataaccgcggtgagcaactgcaaaaacatgaaattttaaagtcttatctgatggaaacccttaaagatggtgacggaagctattttgaaaaacagcaagatgaattttccaaaatttgggatgcttgctcacaaatggatatccatattcagaagctattctccgcggaagacagaagagaatatttcggacactattacgatgaattttaccctataaatttcaagaaagaagacccacagaaaacgtttggtttttctatcaatgatgcattggaaaggccaaaagaaaaaacagattctgattatattggtgacatcgacgattctggtgaagacaattcaataatagattttccaaactttttaatgcacattttcaagctaaagtatcaaacctattcccataacggaaatgaagtagaaattccgttgaatgaaaaagacctacttacagtttatgaaagcttgaagactaaaattgatgctaaagatttcatcagtgatctactctactatagaaccgtatttgataggtttatcataaaatcttcagaagacgaaaaccacgaagatcattataaatggactctcaaaaaaccgtataaatatacttatcataaaagtgaagacaagattgtaaatagtttaaaatatgaaaatgtatttggtcatcaggaacgtttaataaaatccatttctttgctacaggttaccttcagaaaccgaaaatacaaaaactggttacaggatatcttagttcttttttctgataaggaaaaatttggattatccggtgaagaatatcagatagtaattgatcggttcattatcagctattttgaaaataatataaatgagcaaatttatgatcagggggttaaggtccctcactttttatttaattttattgattatctgtattgggttaaatcaccttctgattttaactttaagttcacttaccgtaattcaatagaacatcatttatctcaatctttaaacaatcctattcaggataatttaggaaacctttgtttggtaagtaaaagttctaattccagaatgaacaatgaatctcctgtaggtaaggcagattccagttccacaggcaaatattataaaaaaggcaatataccaccaaaacaaaaaaaaatgtatgacctgacgaatgcaaataaaaaatgggaaaatgatgagatcgaaaagcatagaacagaagtcgtaacacttttaagggagagagctcatatcttaaataattaa

SEQ ID NO: 789 - DNA, 438 bp, Chryseobacterium sp.
atggatataaacataattttctttattggaggatcaattctatttttgattttaattcaatccgtcgtctatttttatcttaaacatcaacggactatctttcttaatcacattaaaaacagacagtatacccatataaaagatattgatgcctgtatcgaaagttattcaaaaatcagcaccaaaattacatacctaaaatcagatataattttcttagacaatgtaatttttttactgtccaacaaacctattattgaaataagtaacggctcggaaaacttcccttctattcagcaaagatttaaaccttccaccaaaacaatatcaaatcatattctggaaataaaaggaaagacaagcatgggaaatttcaaaatcacactaaattttaaaaataaagactttgatatggattcaattatatcaactgcgtaa

SEQ ID NO: 790 - DNA, 3129 bp, Chryseobacterium sp.
atgaaaaaagtaattgcagcttctctgatcatctgtggatgcgctctgggctatgcacaatcagtagatgcgaaagacagtaaatataacctcactataaaatctccggatgcaagccagctatccaaacatattgatatccctacttctacccataccggagcggtaggcattgatattcctctgtataccatcaaagtaggtgattttagtttacctatttctttaaagtatcacgcttcaggagtgaaagtaaaagaaactgcttcaaaagtcggccttgggtgggcattatccgttggaggcctttcactgtccaaacagatttttggaagggaagataagggaaagatacaatacattaaccctgataattttaatcctgtccaagggaactcaaatgattatacccttgctatgacgctcaaaaatggactgggagcaccggatacccagccggatatctattcttatgctattggtggcagctcaggagagttttattatgacagtgccggtagaatcattcaaatcccctatagtacggtgaagattgaagactcatttgtttttacagataatcaggggataaaatattatttcaaaccgggaaatcagacccaaaatgttggaggtggtaatgcacctgatcctcaggatttcaataccacagattttgtcattaccagaattcttttaccaacaggaaaggaaataaaatttaactatctgaccagcaattacaattatctgagtagtttttataaaggattaaaagtaggaagggcctgtactgttgaaaatgggactacttatgaagagtttgttacaagaacaagagttctttcagaaaatgtacttcaaagtattgaatttgaaggaagtgagatcaaattcctgtataatggccgtgaagatatcaataatggactttctttaagtaaagtagaggtgagaaatccacagaaatcgttggtatcagattatagcctggttaaagagtactttgtgagtacagattcaccggcagttccgggttttgaagctgactttccctatctgactaaaaggttgaagcttaaggaggtggtgaacctgaaagataactcaaaatacaaactacagtattatgaaaattatcctttaccaaacaggctttctgaccagactgattatgtgggattctataacgggaagacctttaaccggggaatcccctatataacatatgatgataagacctatggctatggggatgataagaaacctgatattaattatgccgtatcagggagcttaaaagaggtccaatatccgactgggggaaccatgaacctggaatacggattggatgatttctattttagtggagtagaaacgcaaatggggaaaaaggaatttcttatttcaaacctggaacctttaggcggtgttttcaatgtgagcagagacggaaataaggtggattttaagattacttttcaaagtactaccagccctgcagaaggttcagaggggaccctgccggagggacctcattttgtaggggagttactggacaataacaatacagtccttcaaacattcctgatcaacaaacaatacgaaatgattgtggacaagaaaccttcctataaaataaggatcagaaaagtaggaaacgtaaacagcagtcagtatgctaccttgaatgtggaatgggttgacagtatatctgaaaataaagagtacaataaatctgtagggggaatccgggtagaaaaaataaagaacagcgatggcaatacgttggcttacgaaactgagtttatttataaagatgcaaatggcaaatccaccggaaaatatatgggggatgatatagactattcttatatccaggaagtggcagaggataaggtggcaggatacagctgtgaacagatggtgatcagcaataccggaaacttcaatattgccaccatcaatggaaagcctacagtgtatgataaagtgacaaccagggtaaaaaatatcagtaatgcagcagaaagttacgaaactacagatgaatacatgaatcttagtcacaccaatgctaaaaatgccagaagccccatattcacttatgccaacaatcagtttgcccgtggaattttaatcggacgaaattattatgattctcagaagaagccgctgaaaaaagatgttatcacctatgattttgataatcatttcaacagtctttccaatgattatagtgcaggatttccaactcttccgataaggccttatgtgattggaattaaagcaatcgctgctaattttacaacgtttacggttaaccgatatgaaatatcatctgcctgggtaaagaagaaaatgatgaaaaccactaattatttagcaaataatagtaatggtattgatgagattaccaattatacttatgataccaattataagcataccaatccaacaataattaatgttaattcttcggattttacaatggaaacttcttatcagtatgccccagaacaagcgaatactgatatgattgcagccaatatgttgggtattccattacagacagaagccaaagaaaacggaaaaataatctcaaaaacaaaaacagtatatgcaaaaaatgctttaacaggtaacctgattcttccggtaacaacacaaaagtttgataaagataattcagcttcaccaaaaaatactgttgagttcaatcaatatgatgcacagggaaatatgttgcagtataccacaaaaggaagtgtgccaacagccgttatctgggggtataataatgtactacccattgccaaaatagaaggagcaacctatcaggaagcggtaagttttgctggcgaaatgatcttaaagtctaatgaagacatagatgctgacaaagaaaaagcattaatgaccgccatggatgcctatagaaatcaaaatgcttttaaaaactacaatatcactacctatacctacgatccacttattggcattacaagtgtaacccctccaacaggattaagggaattttacaagtatgacgcagcaggcagattacaatctgtagtggatgttaacaacaatatcataaaagaactaaaatataactacaagcaataa

SEQ ID NO: 791 - DNA, 1017 bp, Chryseobacterium sp.
atgatgaatataagggtaagtttcggaagaaacagggtaggtgcacttgaaattgtagatgccaatgattattacccttttggaatgagtcatttaaatactggagcatctttctttggaccgagtacatataaaaattataagtacaatggtaaggaactccaagagacgggaatgtatgattatggagcaaggatgtatatgccggatctgggaagatggggagtggtggatccgctggcggaaatgtatcgtcgtcatactacatatgcgtatgctgtaaataatcctatttattttattgatccagatggaatgcaaattgatccagcaagtcaaaaagaatgggatagattaaaaggatctgttactaaaacacgggatgcattacaaaatgatgtagataaaataaatcaaaaagctaaagataagggatgggatgctaaaactttgacatctaagatgggtgataaattagataggcttaataatgttaatcaatccttgtctagtatgtctacattagaatccagtgaccagatgtatagccttaataaaatggaaggaaatgacggagttactacgtatgacaaaaatactgatgctgttgtgataggttatgtgaatgatgccaattttgttcacgaaatgacacatggttatcagtttgaaacaggagatattgcttttgatgttgcaagtggaaattctttagcacaggatttagatgatgaagctacagcgtatagagcacaggctgcatttgacccctcatcttttggtggaatttcggtaaataaagtcaataataattttcttacaactttgtcagatcaaaatggtaataaagtatatggagtaggaggaacagctaaatcaggcttatttggagttacaattaattctactgtagggcaattaagattagcataccctcaagcaaaagaagctttaaagaatttagatcaaagcataaaattgagagattttcaaggtgtaaaatttaaaggaaaataa

SEQ ID NO: 792 - DNA, 360 bp, Chryseobacterium sp.
atgtttaaaatactattattactatctatgatgctattgttttcttgtcatgcacagacaaaaaaatatatattaagtgaaaattattcgtctttagaggaaccatccgaatataatcttcaattaaaatctgattctacatttgtgtataagattggatttaaaggaagcttagtggcaaaatgtaaaggaaagtggacatacataaaaaaagcagattctattagattatattgtgaaacagaatcagctctagaaagcttaacaaatacttacatgtctgaacgaataaattcctttaagattatgaagaaaggtaaggttttacgaaataaaaaaataattctaaaatctaaataa

SEQ ID NO: 793 - DNA, 480 bp, Chryseobacterium sp.
atgaaggaaaatataaaaaaaattagtcttttcttttttttactttctatttttagttgtaattctgcccaattaaataaaaaaatagatataaaattttataatatcctagatagaactatcaatgatggaaaaaagataaaatatataggaattacttttattagaaaatgtgataaggagataattttttctgtagataggatgttgtataataatgagttacctgtttataagtcttatcaatataaaggttttcctgttttttattttacagatgcaactaatgaaacaagtgattacggaaagaaaattttagataaattattaaagccatctgattatcgtatagataactttgaaataaagaatcaatcagtcgtatatggtgaatatgcatattttaaaaatggtaaatttgttgagaataaagaacaaataagtgaattttttgaaaattgtaagagttcagaaccttaa

SEQ ID NO: 794 - DNA, 876 bp, Chryseobacterium sp.
atgtatgactatggtgcaaggatgtatatggcggatttgggtagatggggcgtgatagatcctgctgctgaattaggaagaaggttttcgccttataattatgcttttgacaatcctgtaatgtttattgacccagacggaatgtggccttggccaacttggggacaagttaaaagctttgggagaggagcttggaatacgactgtaggaatggttaaaggcttagctacttccaatggaatatcaggagtattgcaaggaggtagagaatttaagaaaggttataatgcatatcaaacaggtggagcctctgctgctgtaaaacaatatagaaaatctctttatgaaacaagcggagctaaagcgattgtccaaacagcaaaaggcgtggcaaaaggagatgcggaatatataggctctgcaaccgttatggtagccgctgctgtaattacccataaagcagccggaggaaccaaagccggaggaaaagtaattgctgctgaaacatcaacaatgaatgagctggcaaatactgttaagggtactgtagcagatttaaaagcagctggaaaagcccctgctacagttgttggagcggaattaaacggacaaacagtagttggtacaagtggaccgccaccagcaacaattgccccacaattagaaggtgttgttggagaattaggtggattaggaactaaaactgcttctgggaatactgtcggttgtcgctctgaatttcatactggaaaccagttgctattagacaatccttctgcaataccttcacaaattaattttactgaagcaattagacctagagatggttctgttattccaatgtgtgataattgtaaaacaacttttaataaataa

SEQ ID NO: 795 - DNA, 468 bp, Chryseobacterium sp.
atgataacagaaatagaacaagaaacaatggatatggattggttttttacggatggtgaatatgtgggatttatggcttctggtggtgggaagctacccgagtcagtagctgaatctgaggaaaaacgtcaaatattagcacgttattttagaaacttaccagaaatatcagaagctgttattagtccagaattaaatgatatattaatcaaaagtaaaaaatcagcatcagggattaatgagagatatttagaagactatgtatttatgacaaaaaaaggattatactcttttgataaagttattctaaataattttctagaccctcactatcatttagttgccagtccaaaaactccattgaaattaaaagagctgccacaggacatattagatatagttattggaacacaatataggaataagcttatgaaagttcaagaaattaatagattagaaattaattaa

SEQ ID NO: 796 - DNA, 537 bp, Chryseobacterium sp.
atggaagtctcaaacataaagatcaatagttgtatgaaattaattagtattataatgattagtatactcttgctttcatgtcataaagaaaagcaagagtatattgaagtatcattgggatttagtatgaatcctaataaaccaaggattggaatcctcataaatgacagagactctttgtacgtatgtaaggaagatttaatatcagttgacaatggaataaaatataaatattttaaatcaactcaaaagattgattttgcttcgtacaaaaaaagaatattaaactctttttatgattcaattcaatttaaaagtactcctgatgcccagccacgacagataaattattatttaaatgggaagaatctcaaatttagattttattcacacgaattatcaaagagacaagaggaaattattgaggacttgattttactaaaagaagataaaagacttaaagaaattccttatcataagttttcacgagatttgctagattctaaaattcctaacccgccacctccacctaaataa

SEQ ID NO: 797 - DNA, 561 bp, Chryseobacterium sp.
atgaaaaaatgtttgatatatttagggttattaatatttttattatctcctgtttcttgtaaaaatgaaactcggaataggaaatttttagataaactgtcttccattcagaatggcttaccttcaccatatttcaactattatttatactttaaaatggataatggtgaaatattggagactaatattgatttagtgtatgaagtttataaatctcactactccaaacaatatttagattttagaaattttttagacgatttaattactcaaaaagaaacattaaaaatagcagatataaaaaaatattcaaaaaatgattattttcttaatataagtaaaaatgaaggaaatattgaaaggatggactttgaaaatataaagaaaacttatttagaagagacaaaggaacaatcatttatatttactccaaaaaatcttaaacaaactcagataagaacaatattatataaaatgtttttagatggatatataataagtccaaatgatttagttggatattataatattaggaagtataaagatgaagattttaaataa

SEQ ID NO: 798 - DNA, 144 bp, Chryseobacterium sp.
atgtcgatgctgatgtatcaagcaaaaatccaatatttaaaactaccaatgtttatagcacttggaaatggccaacatcaggaaagggatatgtcaattttaatgggtcaacagcaacatatacaggtagtaacagaaaaataa

SEQ ID NO: 799 - DNA, 528 bp, Chryseobacterium sp.
atgaaaacaaaattgatatttattttaggaggtatattaattctattttcttgtagagcacaagataaaaagattgaccccaaagtagtaataccatttatcgaaagttatattgacttcaaaaacaaagagcactatgtaaatgtaagtgacaatatattaattgttggtgcaagtaaaatacaaaatgaaaacaaatataggttaaacgtatattttatgaatccagaactaatgtctggttttaagtatacaaaagtctataaactttataattataggataataattgatgaagtactggatgaaacaatcatgttgaaaaatgcatttaagaatgtacaggaagttccctatgaaaactttaatttagcttcttatccgttttcttataacactagtatgtggttgcttactttcgattataaaaatgaagttatacaagtatcgcctcaagaaaaagctgagactataaaaaatattttagaaaagaaaggtgttaagttttcaaaggactacgaagaataa

SEQ ID NO: 800 - DNA, 447 bp, Chryseobacterium sp.
atgaaaaatttagtaattttattaaccgcgttatttattactttttcctgtacacagcaaaaagcaaatcaaaccgctaaagttccctacactgaagcaaaaaattattttgtaaaaaacacttacaaaacaaatgctgtgacctccaaaaaaatcacctctcaacaggaatttgatgacattttcggaatggcaacaactatgggaaaggatggtaagccaaccagcattgatttttctaagaattatgtcattgcactaatcggagttgaaaccaataaaccgactgactttttaattaaaaatctggttagagagaaggacgatattattctttcttacgctataaaagaagagggtacagaaaactcttatacaatattacctactaaaatacttattgtcagcaagcaatatgatggcaatatcatttcaaataaactatga

SEQ ID NO: 801 - DNA, 306 bp, Chryseobacterium sp.
atgctaccgatggtagtaaacatgttatatctgtataaaaaatacgctgaacaactacttcatggcggaaagacagaagtatcatcaaaatcaaaaaatatcatgaaaaaattagaaagtttaaagtctttgaaattcaaagaaatgagtgcaagccaaatgaacacattcaaaggaggtgttatccaatctaccagcaatggatcctatagcccggatggaggtaagacctgggtacgatgcgccgatcggtatgatactgttcttaaatgtacagaataccttattaatgaagtatggtattag

SEQ ID NO: 802 - DNA, 3783 bp, Chryseobacterium sp.
ttgtcaacgaaaaataacgttgtagaatctattgattttatgataattgtggaaaagtcttcttttgaaaagaggacttttttaattaaatttgtaagaataccattaaatatgaataaaaatttattttcgaaattctttaaaaatagagaaattgatgaagaaaaaaccgaaactttactaagttcgcttgctccaaaaatattaacaaaaacagaggatattgagaaaatcgaaccctatttagataagctcaaagaaactatagatacgaaaggaattagtaatatcgcattaactggtggttatggttcggggaaaagtacagtaataaaaacgtttcaatcattaaacaaacagtatgaatatctaaatatatcattggcttcttttaataagaaaaaagaagatgaaaacgaaaataataatcaaacagatgtaaaagtacagaaagaagaactggaaagattgttagaagtaagtattttacaacaaatattttatcacgttaaaccacaacaaattcctgaatcacgttttaaaagaatagataatattccgggttggaggatatttggtatatctataagttttgttttatgggttctttgtacaactttacttttgaaatacaactatttagataaaattaatccaactagttggaatacaaaaaatagtattgattggtggagtgtaccaatatttttaatttcttttagtggtttgggtgtattatctaaacttataatcaacttgtttagtaattcaaaaattaacaaagtaaatataaaaggagaattagaattaggagataatgtaaataaatctgtatttaatgaacacttagaagagattttgtacttttttgaacgtacaaaatacaatgtagtaatcattgaagatttagatagatttgatagtactgatatttttacaaaacttagagaaatcaacatattgttgaataactcactgttaatagatagagaaattaattttgtatatgcggttggagatgatttatttaatgacagaaaagaaagggttaagttttttgaatacataatccctgttattccatttattaattcttcgaatgctgatgaacagttaagtttattaataaaagaatcaggattagacgaaaatatatttacgagagaatttataacagatattacaacttttattgatgatattgatatgaggttattaaccaatatttttcaagaatttgtaatttatagaaaaacattaaagcctgaatttattaagaaaaatgatgaattatttgcgatgattacatataaaaacttatatccaacagattttacagaacttaataggaatgaggggaaattatataatttgataaataataagaaagaatatattataaattttgtaaccaaaatagataaagaaattttagataagaacaaggaaatcggaaatattgaaagtgaaacaatagataatattgcggagctaaaaagtatatattttcagaaaatattatcaaaaattcctacaaatgcgctgattaaccgaactactattaacaatgattttgatgagataatttcaaaacaaaagttgagttataaatatcacaataaaggttatggtgatttatttgataatggctttgattttaaattttctgaaattgaaaatgaaattaatcctgaatttacttatgaagaaagagtagagtttatacaattaaaacaagaagataaagtcaattcattaaaaaatgaaatcaacaaattaaaaaataaaaaattagaaatacagaattgggatttaaaacaaatatttaacgaagttgatattaatcaatatttagatggatttttagacgttaaactattgagaagtctaattttggaaggatatattaatgaaaattataatgattatatatcgttgttttatgaaggttctcttacaaaggatgataaaaaatttgaacaaaatgttaaaagtagatttaattcagattttaattacaaattagtgaatattgataacttgttgcaggataaacatttatcagaattgaaatattttgaaagagatgcaattttaaatttcgatttattagattatttaggaaacaactacaacaaatattctataaaatatgatgcagtaattctgttattaagtaatgaaaaagaacgttcgatacagtttattgatggttatattaaaagtgaagatagaccattagaaattttctttgaaaagttagtagaaaattggaaagatttttgggaatatattgtggaagaatctgtttatgatagaagtaaaatagatgaatatttaaggttaatgattatttatacaaaggctgaaactatactaaataatcagagtaagaaatttttaaatgaaatgattgaaacgaatccacagtttttatcattagttaaaaatgttagtgggaaaaattattataataagattacaaatcttttgaaagggttgaacactaaatttgaaagattagataatccgaatgaagacactgagaaattgtttgaatatgtttacaataataatcattacagtataaacagtgataaccttttacaacaagttttattatttggaaaagatgttgatgaggaagattttaagagttcgaattattcaacaatattgaagtcagattgtaatgcacttattgaatatattagcagtaatttatctacctatatagaaaaagtttatttaaaattagaagataataagtttgatgaagaagaaagtctaactaaactcttaaataatgaaaaattagataatacattaaagatcaaaattattcaaaaagtagaaacaaaaatctctgatttaaataacattaatgagtcagttataaaagagcaattacttttaaataataaagtaattcctaaatggaataatataactaactattatagtgatagcgaagatacaataaatgaaagtttggttaagtttttaaattttgaaaatgtttatattgatttatccaaagagaaaatgacacataaaagtgatacttttgagtatagtgttttcagagaaaatttacttttaactaatgaactatcaaacgaaagttatactaaaatattggaaagtagtatttattacagagataaattagcatttgaaaacttagataaagataaagttgattatttaacacaaaggatattaaataccactaaaaccaactatgatttgttaaaggaagggtttaaaaataaccacataaaacttttggagaaaaattttaaaacttttttagataaaaatgcagagtttgaaactgagaacactgatattttactgttactaaattctgataaaatagtgattgataagaaatttgactacattatgatattgaatgaaagtactgtatccggtagtaaagaaatttcaaaaaaagtaggagaaattattctacaaaaatctaaaattgttgaatttaatattgataccttgaaatctattgttattaatcaaccaacagctgaaaaaagaatactattgattaatttatattttgaaaaattaacgaatgatgatgttattaaattgttgagtagtatttggaattatgataatttatttaaaaacaaaaaacctacatttaacaaaacggaatacaatagaatcctattggagagattaaaatctaaaggattaattaaaaattattacgataacaaatggaatgatgaagagtttagagtaacaacaaattattga

SEQ ID NO: 803 - DNA, 171 bp, Chryseobacterium sp.
atgtttttcagtgttttttattattcaaaaatcacctgcatgggtggttataagttgtataccgcacgaaaaaaatcattttccatttcttttattctatttgtatcccaaaaacaatataaaattaatcaattgattatcaacacacaaacacactacacacataggtga

SEQ ID NO: 804 - DNA, 1554 bp, Chryseobacterium sp.
atgaataaaagtcaagattcagaagattttttcttggtgaacaaaataaaagaaattgaagtttgtgaaactaaatttcttcaattttcaggtacttctttcagaaagccaactgattttataagagagataaatgaagaacataatttagaaagctgtgaagactgtaaaaaaaattatttggttgttttagaaacatttgagaatagacacaagaattttccagactgttgtaagtaccataaaaaattgagtactcaaagttggtttaacgttaatgattacttagaaattcctcaagtttcagctgaaaaaatattttatagttggcatttaattattaaatttttagatgataaagattgggataataaaatttttgattatttacaatatgtaatttatacatttggaacttttccgaaagactttggagggcctttattcttaagttcatattttagtatactaaaaggattattaaaaagtataaagaagagtaaatatgccaaaaagaaacaagcgattgaagattatttaaatagtttttacttagacaatcaaaaaaaaacgaacacagactttaacgtactcttaggaatatatagtcagtggtacaaagtattccccttcgatattagtatttttagacatttaaaagaacagttttcaaaatcattaccattaattgaaaagactcattacaataaatatctagaagtcatcattgcaacacccaaaacaaaacatgcattaataaattatttagaagatataacaaataaaattttattggaaataaattctttaaaactatatgaagaaggaaaattaaatgaaattgacaattataaattagaaattattttaaagaaacgacacctaaaactagatgaaggatataaaaatgattcaaaaaataatgacacaagatatagaaaaattttaaaatcctggttagcagacgaaattgaatttgtaaaagaactatcatcaactattagtaataccgagttaaagcaaagaaatattttttcagacattctatatgcctgtaataaattgcaagagaacaaaatcttttcaaatctcgacgaaaataatcgtacaaaacaaatattagatattcttgaattgaattatcatactaaagatcagtctcaagttggatattcttcaactggtaaaaaagcagggtcagtagatggtatagtaatagacaaaaataatattgagtattttattgaagcattaaatctaaaaaacattgacaaacaatacattgagaaccatatacacaaattggaaaaaaattatgacaataaaggcctacctaataaattcttgattatttattgtaacgttttagaaaatacctttgattcgttctataataaatattttaacttcataaatgatgagttcgctttcgtgtataacaaaattaatattgacaatattaaatcaaattatactaatcaaagaataattaaaactattcatacaagagaatcattaaatgtcaatatttatcatatcttgattaaaatgtaa

SEQ ID NO: 805 - DNA, 252 bp, Chryseobacterium sp.
atggacccaaaattaattgacaagcataaacgaactagtatttatgaaaaaaaagattttgatgaattacttaattttattggagatataagtagactaataatagttccgaatgtctggactgaagttgacaatttactgaatgatttttcaggtaattataaatatccttacctactaaatattaaaaagctaatccatcaaacaactgaaaagtatattacttcaaggcaaaacctctactttgaatga

SEQ ID NO: 806 - DNA, 279 bp, Chryseobacterium sp.
atgctcacattaaaccaattacacgaaatagcatacactgagctacaagatttagtcccaaatgcaggaaatgctgattttcggcttgaacaaggtgaatataatccaaatcttgaagaatggacagtagttgtttcgttcctccttgaagataaaaatatatccgtctcaccacttgcaaatatttcagcttcaaaatataaatatgaacgtgtatataagaagctaaaaatagattctattggaaaggtttctggattttatatctaccaaccgtaa

SEQ ID NO: 807 - DNA, 798 bp, Chryseobacterium sp.
atgagtgccattttcggcctaagctttcttaatgctcaggtaggaataaacaccagtacaccggatctttctgcaatattacatctggaatcacccaataaaggttttttacctaccagacttacacttacgtcacctacagatggtgtaaccattcctaaaccggcaacggggttagtggtatatcacaaaggaacgggttctatgggagcaggaatttatgttaacatcggtacacctgctgcaccacaatggacaaaatcagctggaggaggacaggataattcagatacgcatggaagtaatgtgtacaaggcgaagtatcgcggtaggaatgctgccaattcagcaggcgtttattcaaaaccggatcttattattcctgaactgaatttaatggttcgatttgcaattgtaggaggatctaccacatcaggaagtaatgcattgactggaagtaatagacttcaggtaaggttaattaatcagccggcgacagatgtaacgattaccagctattcacattggcatgggccggttacccataatagcaggggagtgaatttatcatttacttctgctaattttgatcagtggcagaatacagatgctgaagcttggaacaaccaatggggatactattacctgctttattcaagtgaggtaagagcggtgaaaagccctaaagattttgccatgaacttgtatgggatctgcggatatggaaactctatcgcagctggtccccaaaatgatggaagtgatgaaatgtattccctggctgctgaggtattctaa

SEQ ID NO: 808 - DNA, 855 bp, Chryseobacterium sp.
atgagtattcaaagtattacaagttcaatttctagtttagaccgagaaattagtagtttagaaaatcagttgcaaactattaataacaatcttagccgtaaagaaaaagaagctacttctattttagaaaaaataagtaaagagaaagatttgaagagaataatcacttataacaaagaccttctaagaaagaatgacgaagttaatagaataagcaaagacaaatcttctaaatcaaagagcctttcggaaaaacaaacaaaaagactaaaactggttcaggacttaaataaggaagaacaaaaaattagagataaaacaaaaaaagagcaaaaggaaatccttacaatgcagcaaagcattaccagagaaatggaaagacaaaaaaacctatcactaaactctttacctaaaaagaattttgaattacatgttaatacacaaaaaagctatgatgtttttatttctcatgcctctgaagataaggcaggttttgtaagaccatttgtagaagcattaagagctaaagatgtaattgtatggtacgatgattttgagcttcaagtaggtgatagtttgaggcgctcaatagataatggacttagaaattccaaatatggaattgtagtattatctaatgctttctttaataaagaatggcctcaaagagaattagatggattgtttgcaagagaagtaaatggagaaaaggttattctacccatttggcacaaaatttcaaaaaatgaagtaatgagttatagtccaactattggagatatggttgcaattaataccacagattttatgattgaagagattgcagaaaaaatagcaacaagaatcaaaagatag

SEQ ID NO: 809 - DNA, 876 bp, Chryseobacterium sp.
atgaactattattttcgctcttttaacacaaaatcatattgggtatatgcgctttggtctgtagattctgtaaaaacttttatggctgttgttggtggaatatggctttttgtagatattctaagctcatttaaagtaataaacaaggaaaagcttacactttggtacttaattccgattataatatttggtttaataatagtaataattactagaaggccagttaaaaaaatatcatacaaataccccggacaagatttaacgattgaggtgtgtataggcaacctttttgatttctctggacaaaaagtaataagtaccaatacaacttttgatactgatattgccggtggcatcatatctcctagaagtttacaaggacaatttactgaaaaattctttccttctaatctaccagctcttgatgaagctttaaatattggactgcaagatttgccaaaaattcatatccaaaaggaagctggaaaaacagaaagatatgattttggaactactgtaaaattaaatttgtccgggcaattcttctattggtttgcaatggcagatttaaaccataataataatgcaaaaactacactaaaaaatgttcatcaagcactagatgggctttgggaatttatagaaactaaaggtgagaaactacctactgtcattcctttaattggaaccggactagggagattaacaactagtagaaaaaagttaattgcaattattgcacagtcatttattaatgcatccgaagataacttgttttcagaaaaattaattattgtagttcatccatctgacgttgaaacatcaggtttgaatctatttgaggtcaaagacctccttcatcactatttaccataa

SEQ ID NO: 810 - DNA, 498 bp, Chryseobacterium sp.
atgaatccaacgtgttacgtttgttttgatggtgataatgatattcattattatagattaatgcaagcttgggataagaatgaaaagtttgaatttacatttatcaatgctcatgatattacccaatctagagatacaagtacagaagaaactattaaacgtagtttgagaacccgcttaaaagctagtggtgtactaattgtattagttggtgatagtacaagaaacctttataaattcgttcgttgggaaatggaagtagctattgaaataggcctccccattattgtggttaatttagatggtaaaaaatctataaatagaactctttgtcctcctattcttagagatgaacttgcaattcatatcccatttagtcataaaattatagattacgctataaaaaactggccagcatctgcaagaaggcataaagtacaaggagaaactggcccatacttttataataattcagtttatatatctttaggactttaa

SEQ ID NO: 811 - DNA, 741 bp, Chryseobacterium sp.
atgaaagagtttttaaacttcctgaaaaaaagtaaaattttacaatttgtaaaagaatatttacctttttttattattattccaccgtcgttggggggaattaagcaaatttttcagatcagcatgcattctcctaaccttgtaagtaaatgtttttcagtatctcaggtagttttggatggcattttaattctactcaatatgccgttcatgctgtttggtctgctcctgtattatttatttagaaattatcctgagaaaaaatacaaaatcggtataatcctattaataattgtagtattaacggtatatgcctatttgtactatattactaatgactcatccggccttatccaacttatactttacttagttctgaacggtgcatttatactatgttaccattatcagaagaaactattaactcagaaatatggtaaagtagcctatataacctttatagcactgctcttttcatttcttaataatataattagcataggaagtgaactccatatctataattttagagttcttatagataaagttaggttaaagcattcccaagctatgtttctatattctaatgaaaagtgtatcctttttgatctgaatccgaaagaaggtgattatttgattataaagtatgaagacatttattttgataatagtgtaacagaaagtaaagaaaaaaagaccactacagattcaactgttgtggacagaacttataaaaaataa

SEQ ID NO: 812 - DNA, 969 bp, Chryseobacterium sp.
atgaaagcagcaatcataaaagagttcggctctgcagaaaattttaaaatagtagaaatacctaggcccatacctggattcagggaagttttggtgaaggtctttgcaacttctgtaaaccctctggattaccaggtgcgccgcggagattataaaaatgagctggaattacctgtcatcaccggccatgatgtctccggtgagattgtagaactcggaccgggagtggaaaattttaaaatcggggatgaagtttattatactccagagatctttaagggacaggggagctatgcacaatatcactgtgcccatgagtcaatcataggtctgaagccccaaaatatcagccatctggaagccgcgacacttcctttagcagcaggtacagcctgggagatgctggttaccagggcacagctcaaaattaaccagaccattctgatccacggcggtgccggcggcgtagggatccctaccattcaaattgccaaggctatgggagccaccgtgtttactacagcaagaaaaattcatcatacatttcttaccgaattaggtgcagatcacgttattgactatgaacatgaggactatatcagtgcggtctgccaattaacagaccataaaggagtggatgtcatcattgataccatagggggcagtacactttccgatagcggtcagattctcagtcagatgggccaggttgttacgttggtagatattgaaaaacctcagaaccttattgatgcctggggaaaaaatgctacctatcattttgtatttacccgccagaatagaaataaactggatgagatcactcaattggtagaaaataaaaaactaaagccagttgtcaacaaagtttttccattgtcggagatcggtaaagctcatcgcttactggaaaccaaagctggtgataaaaacttctatggaaaaatcgcaatagagattgataaatag

SEQ ID NO: 813 - DNA, 597 bp, Chryseobacterium sp.
atgctttccaaactaaaaaaatatatctcaaaaaaaatcatttctataatttcttttaatcaggcaaaagaaaaacgagagatgtggacggacttcttatcattaccgaatattaatattcacgattcttttcagcccaaagatgttacttattttaaaggaaaaaacaccgagtatggcgaaatatccattgatgagcaattttatatgaaagaacattgcagtattttagttttccctgaggctaaactattaataggaaaaaatgttttcttcaataacaactgctctattaattgtttggataaaatagaaattggcagcaatactatgtttggagaaggagtgaagttatatgatcataatcaccttaccacaatatctgattctgaactatcaatttcaaaagcagagtttagcaaagcgccaatcattataggaaagaattgttggattgccagcaatgttataatattaaaaggagttactataggagataattctatcattggagccggctgtatcattcataaatccgtaccctctaattccattgtgaagaataaccagaatttaatcattgaatctattacataa

SEQ ID NO: 814 - DNA, 1200 bp, Chryseobacterium sp.
ttgaatctattacataaggtggctataaacaaaaaaatactattcattctacatgatgcatctttatcaggtgctcctattcttgttttaaatttattaaagaggttaaaacaggacagaacggattatcttattgacattttattattaaaaaacggagagctatatgaagatttcgcgaaagtctccaacgaaatatttacttttaataatacatccgaatcattttcttttttgagaaggaacttaaaaaagattcagactatcgttttaaaaaagaaagaaactcaccaggataaagtagataaaataattaataagttactattgaatggatacgatctgatctatggtaatactatcgtaactttaagctggactcttcctttttataagaaaaatattcccacaattatagctgtccatgaacttactttcggaattgagagtgtgtattcaaaagaatttgttttagaaaacattactaatactacaaaaattatagcaggatctagagctgttgctgaaaaccttatcaatcaataccatgcagatccaaaaaaaataaacgttgtacattcctttattgattctacccttgccattcagaaggacaaagaaaatttaagaaaggaattagcaatacccagtaatcatttaattgtagggattgcaagtgctcaggaattaagaaaaggaaccgagatgatccccctacttgttcaaaaaatagcacaaaaaacggatatcccttttacatttataaacctgggaggcgattcaaaaagttcagctgtaagatgttcaaaaattgatgccgaaaaattaggggtagcagatacgatgatatttgtaagccataataagtttcctaatgattacattaatctttttgacattttccttttaatgtcaagagaagatccttttccattggtaatgcttactgctgcaaaactaaagaaaccgattattgctttcgaaaaaagtggtggtgctacagaatttcttgaaaatgaacatggaattcttgttccctatctggatttggatattatgtctactgaagttattaagcttatgaaagaaccccaactaagggaaaaattaggaaaaaatatatacaaaagactagaggaagactattctgatgaaaaactgactttagatatttttaatttaattgatgaattagtttaa

SEQ ID NO: 815 - DNA, 183 bp, Chryseobacterium sp.
atgatccagattatattaatgctattcagcttagcattccaaaataataacgcaaatacagcaacaataaatgataacaatgaaccccaagtaataatagtaagccaaagtgagcctttgtatccggatggacctattggcggaaatgcaggccaaacacctcctcccgccccaaaaccatga

SEQ ID NO: 816 - DNA, 1455 bp, Chryseobacterium sp.
atgcttagtcttggaactttctttatttcgcttcaagcccagacatcccccaatttagaatttgctgtccattccggtgttcagaatcctcaaggtaatggcccggtgtatactgcttcggtgaattttgttaaaaatgtggataatccttcaggtacttcttatgctatatatcaccctgatcttaaggtcgatttcgctttatcaaatcagcagtatagctcagcggtaataatggggtacaatatcaacaataccagtattcctgtttttcccaagatcaattatattggcagtccgaataatagtgattttactgcttcgggggcacctacgggaaaggggatcaatgtaaaaactaataatggggtctctcttttttacaatacttctgttttaggaggaaaatcaactcttggagtatatcaaatggctgatcttactattaattttaaccgcccggttgataatcctgttctgcatatcggagctatgggcgcatttcaggatcagatgggaatggcgggtggttttgattttgtagacgctaatgtacctgtctcattcacacggctatcaggcaacaacgctaatttttccgtgacagcaataagtatgaaaaattcatcagctcatccaaatgatgttggatacgagtctgcttccggttctgttcttataaagggcaaaggaattacttatataaaattgagaatgtctgtaagaggagatgggggtgaagcttcatggaagatgggatccggagatttgattaccatgggaatttctgttttggaaagtgatcttgccattaccaatgccatagataacagttccccccacattaatgatatggtaacattgaccataaaggctaaaaataatggagtatcaaacaacacaggagttgttgtcagcagcctgcttcctgatggatatttagtaatcaacgcttctgcgggttcaggaagttatgatacaaataccgggctttggaatataggcgctctcaatgataatgaagaaaaagttcttgttatccatgctaaggttaaaaatgtagggtcttatacggtaaactcttctatttcaggagaactccgagatcctcaggaaggaaataataccgcatcaattactcccatgatatcaggaaaaggagtttgttataatgatcccaatataaacagtgtgggtacagattccaaatttggaataacgctgttaaagagagcaggaataacaggggataactggcctatgatcaggaagtcagctcatatggttcttgagtctgacaccaaaggttttgtgattacacgtatggcaaaatcagatttaaataaaatcgttgtacccgttgaagggatgatggtatatgacacaacagataaatgcctgaaaatatactcagatgacctatggagttgtttctcgacaccaacttgtccgtga

SEQ ID NO: 817 - DNA, 855 bp, Chryseobacterium sp.
atggccttctctttgagatggctttttgttatatttgtggaaatgctaaaagtaatggaaatatcatatggagaaattattggttgggcaggaggtttatcggttattatttcaggggtaggcacatggataagtcagcttatactaagtaaaagaactgaaaaatggagatcaagcactgagataaaattgaaagtgctggaaagtcagctttcagaaaaaacgtcaatgttaaataatttaattgacattcagaaatccaattacaattttagtcaagaaagaagaattgtagcaatagaaactgtgtggaaattatataacgagtttatgttcaatcttcctgaatcaattaggactgttaataatataagacctgaggcttatagtgaatacttaaataaaacagagtttaaacctgatgaggacattaaaaaagacatgttagatattgaagaaaatgagacttttgcagtacttttcagcgatatgagggaaaccctgacttacaataggccgttcttaggtgaagatttattttacctaataaatactaatttcatgtttgtaataaagataatttggaatattattaaaggtattgaagataataaacttgaacattggcaaacggatggctatctacttaaattaattgcgaaagtaattccaaaggaagaatatgattttattataaaatataaaagacgttcttataattataccttggatcttttccaaaaattaataattgaaagcatgaattcactactctccggcaaacttgcctcagaacatacaataaaacattataaggatataagggtgcttttgtcagaatttgacaaaaattaa

SEQ ID NO: 818 - DNA, 801 bp, Chryseobacterium sp.
atgagacaaatgacagaagctaatctggcatatccagtattggtgcaaattgaaggatcatccgggactggattcttcttagagaaaaataataaaacatattttgtaactgccaagcacgttctatgtaataacaatagttttaagggaaacgttgcaaatcttacatttcaagcaaggaatagtgatcctactatttattttccaatgaaattatcacttgatctacagttgcttttggcagatcagcatgcagcaattaatccaacacgggatattgttgtaatattaattataggaaacaatgcaaatgagggagaatttgtccaccctgtccgaggaataaacatatctggagactcacaaggaggttttacaagaataccggaaatttctatcaaacaattaagcgaagtagtaatagccaatgatatttttatttttggatatcctgtatcaattggattgcaaaatagtccacaatttaactacgaactcccattgactaggaagggagttgttagccaagtacacgcgcctaataagactattatattagactgccaggttcatccaggtaacagcggtggtcctgtaatacaagttacaaatacaggtacacattttcaatatgatgtaataggtgtactaattcaatatgttccttatgtgacagaaattaatttgggtggcgcaatttattcctatagcggtaggagtgtaaatgattttaaaaattcaggatattccattgctgcatcaatggatttagtcctggagacaattgatatgcttaagtaa

SEQ ID NO: 819 - DNA, 972 bp, Chryseobacterium sp.
atgggaaagttaattataacaagtttatttttattgtcaaacctgagtggttgtcagcaaaagcagacaattgcttcaacaatggaaaatcaagatcagcttatagatcagaaaatgttcgatatttataagcaggtaaaagtatatgattatagtccattatatcaggtggaattcagccaggatgcatgtgggtatgaaattttaatcaacgatatacccttacatcgctatctatttttaggcagtgccaatatgcagcgaattccaatcaatgatcatatattgagaagtggacagcaggaaattacgattcgtttgtttcctcctcaacttagcgatgaaagctggtcaccaacatttgttgaagcttctaagtttaagattaaggtattgcgtagcaaagctgatggacctttgaacgactataaacagatttgtgaatttagtacctccaccaaacgaggaacagaaaactttctggccacgggacaaaaagtctttgaatttaagggaacttttgttgctgatgtcccatatgaattagaaggatggcacaattccaaagaccttagtcgagaaaataaggatgaattgctcaaagaggctatttctgcctacaacaggttcaggaatatattgataaaaaaagatgtgaccgcctatgcttcgttaatgtatgataaagaagtagaattggcaaaggcttactattggcacacttccatcgattctaaagaacggtggaatgaaatgagtggtacagttcgcgaaaagagagaaatcttacctttaaaaaattttaaaatggtgctctatgctggtggaaaagtgttggcattgcagccgacaagtttattgtataaagattacctatctgctattcatactcagacagatagtgaagatattcaagtttcattcctactccataaaaaggcaggcagtagtaaattaactgcaatccgataa

SEQ ID NO: 820 - DNA, 624 bp, Chryseobacterium sp.
atgaaaacaacccccaaaaggatacattccatcaaaatgaataaatggcctattttatctggcacggttgtgttatttctatttgctacagcatggagctgcaactataaaattaaaaataaagaacccaaagaatcttctgacattaatactgaagtgcaaaaggaagtaagaatagcagcctaccggactttaaacgcatggcttgatcaagggatcgaaggtattcagtttttacaaagcagtgaatggaaaattggagaccgaatttttcttaatagtagcaataataaaggttttctgttactactcaaccaagataaagtaccacaggccgagctggattatgttcaggttttgtacgctgttaaagagggagaaaaatgggatatttatcttgcgtccttacctaatattatcatccccagaaaaaaagaaaacggaatgtatattcgcaattcatttggtcaattagccgctgtaggagagcgggaaattcaccgctatctaagaaaaggcgatgaaactaataatgataaaggcattaacaacgaattcaatgaggatctaaagaaaaataaaaggctttttctatcaaaaagaatcaaaaaacctagtagttga

SEQ ID NO: 821 - DNA, 420 bp, Chryseobacterium sp.
atggaagtaaaaaatcggaaattagctgcaaaattagaggatttaatagaagagtcagaaagatattatgaagagtcagattatgagggatttgttgaagtctccttaaaagcctggaatgtattgccaatacctagagaaatctatgatgaaagttatcacattgcagaaggtttagcggagggatacctgttaatcggtaatcatgaagaagccatcaaatgggcagaaattatggggaattgcgatatggaaagagcagatgatggtgcgcgtgaatttgttttgggtaagatgttgtttgaaagtggagatatggaaaattctagagaaaaatttatattggctatgacaaaatctgaaggaagggtatttgttaatgaaccgaaaaaatatatagaatttttaaagaaaacgtaa

SEQ ID NO: 822 - DNA, 645 bp, Chryseobacterium sp.
atggcaaaaaatacagtaagcaacgaggcgataaaagaattacttggttctgaaaagaaaagtgatttaagaaaaggtgtaaaattagctgtaaataatgaactagtcgactttgcagatgatctctttatcatcctgaaaacttctatctcagatgctaaaatgtgggaggtaaattatgatatcatcagacttttaggaaaagcaaaatatcatcagacaatccctattcttgaagatatttgccgaaaaaatgaagatcatgatatggtaaccagcgctgctgctactgcattaagtagaattaggagagcaaacataaatgatgttcaggaagttcaaaggttattaacttttgggaagtttgctgttattgatggagcattaaggtcgatgggaattgataaggtgatacctaacgagaacgaaattagcgaaataattggttttatcaatgcatttgagccaaagatcgagagaggatatgcagatatcagagaaggacttgcggttgcaagtgcaggttggacaaaaaatgaaactgtcaataaatttttagatgattgtttgcaatctggggatagtgcgttatcaaagctggctaaaagttcaatgagtggcaaatatgctgatatagactactag

SEQ ID NO: 823 - DNA, 270 bp, Chryseobacterium sp.
atgaatattaatgaaataccagggaatacacctgtaataaccacaaagtatgtagttgaaaaaacttcagatattgtttatgtatcgtttgatgaagagggtgatttccaggtctttagtgatgaaggtgcagatatggataatgtaaaagtagtgtcactaagtcaaattctcgaattagacaaaagtgtaacgcaattagttgatataaataaaggagagaaattctatagagaaaatataaatagtatatggcaaaaaatacagtaa

SEQ ID NO: 824 - DNA, 549 bp, Chryseobacterium sp.
atgaaaattaaagtacttaaaatttcaatgctttttttattgttgagtatactaaacggttgtaaaatcacttcaagatatgaattagcatataatgttattagtaaagatttttttggaaaagaaacttctactaagcaatttggcaaagatgtttccggtgtatatgtttttgattctatatatgcatatccacaaagaaaattaactaatgatgaatctattatttttaaaaaagggatgaaggttattggtgtaagtaaagttttaaaaaaaatggagaaggattattataataaaaattggctgactataggggatttaaaaaggatatacggggatcatgttttatatgaagcaactcctaatggtcccttaagtgctgctgtgttttcagaaattaaagacgatcaattacgaatagatgttattcctttttttataaaaactcctaaatattgtggttctgtaaacaaatactattttaagttttccggaaaaaaaataatagaaaataagaaatgggttgatcattatgaatgttggtaa

SEQ ID NO: 825 - DNA, 489 bp, Chryseobacterium sp.
atgtttaataatttaatatacaaagaaaatgtggatgaaatccatacatctgaagcgtattttggtaaaatattgtttttagaggggaatctcttaatcccatacatcaacttaggtatatcaaatcatatattaaataagaatgatgatttaagatttatagattattgctattttattgttactgatatgtattatcttaaaattaatgaaaaaattataatcaattctttaaataaaggctacgatagtacaaagtctatttatcttggcggtagtgatttaattaaaaatcaactaatttatgatatagaattacggggtaataatacctttttacaattgaagtcaagttcgaaaataggcgagaaattttggactccaatagcaactcctaactttgataaaaatatggatgaaaatagggtagagagatttataaataatgaaaatttacctgaaaacttattaaagatatttcacaattag

SEQ ID NO: 826 - DNA, 561 bp, Chryseobacterium sp.
atgaagtacaaaaatttaatactaaaatcactcgctaattattgtttattatgttgtttattacttgtttcttgtaatgaagaacaaaggtttactgactatgaaattgcaaagatttcatttaaattaccaagctcatttaaattcaaaaaattgaatagtgaagattccatggtgtatggtattttttataacaacgtaaacaaaggttatgtctattttgggaactataaaccatttgaagaaaattctttttttataactgaggaaaaagaattatatgaaaaatataaaaatagagaattaaaggcttatttttcaaaaaatcaagagagggattacaaaaatggtatattcaatgataattattattattatgatactattaataaaaatattgctcaaataatgcttccgaagaaaccaaacaaaggattaataggaatatattttgatagtatagattcccgtagaaataagtttgtaataatcagtaatgatttaagtgaggaaaataaaaaagtatttttaaaaatttttaaaacaataaagactaaataa

SEQ ID NO: 827 - DNA, 843 bp, Chryseobacterium sp.
atgtatgattatggagcgagattctatatgccggatctgggaagatggggagtggtggatccgctggcggagaagatgagacgagttagcccatataattatgcttttgataatccaattatgtttattgatcctgatggaatggctccgacacccccagatattataacaaaaattttaatagcaaaagcaaaaacatatgaatcaggaacaatggaatattcaagaaaagtttcaatgactatgactcttttaatatacaaccctgaaaatttggatttatctaaagctggattaagttctcaaggtgttatggattggaaagaatttagaggtaatgcaaacagagtgttgatgaatgggaaaatacttcaagatgattatatcaacaatttatctgtagtatataaagtcactaataatattgatgatattaaagggacggcaaatgtcatgactattacgaataaacagcttactgatgaaaatggaaatgctataaacgggatgactgatggagcaggaggccaaatttcgatagttaattatcaaaatggtgattttaaacatacattcaaacacgaattgggacatcaattagggttagatggtgaaggatatcaacgtccaggttttgcctatccaaatgaagatagtaataccattattgataataatggacaatataatgtaaccactatgcaaaaagcaaaggcagctatgacacccacatcagcaaaaactggtgatatttttaaggcatcaaaaactaaccctaattttattagaagctcacaattaaaaaatgaagtacaaaaatttaatactaaaatcactcgctaa

SEQ ID NO: 828 - DNA, 531 bp, Chryseobacterium sp.
atgcaacgatatttttttttattaatgatttttatgttctcttgtgaaaacaataataagcttcaaaaagagaatattcgaaatgtaagttttgaaatgccgtctggttttcaactgaaaaaagtaaatagtgaggatactgaaacctatgatattttttataaaaataaacgtataggttcgtgttattatggtatttattataaaccctttgttgaagactattcaataactgaagaaaaagaaatttatcaaaaaattaaatcagaacacaccaaaatttattactccaagtatttagaccaggactataaaaatgggatttataatgataattactattattatgataccatcaataaaaatatagcacaagtcatgttatcaaagagaagtaataaaggattaatcggagtttattttgacagtattgatactcataaaaataaatttgctatagtagctaccgaattaggaggggaaaatcaaaagaagtttttagaaatttttaaaacaataaagactaaataa

SEQ ID NO: 829 - DNA, 849 bp, Chryseobacterium sp.
atgtatgattatggagcgagattctatatgccggatctgggaagatggggtgtggtggatccattatcggaaacttctcgtcgttggagcacttatacttatgcatttaataatcctattagatttattgatcctgatggaatggctcctgtccctcctgatataattactaaagttcttaatactaataataaaacttattcttcaggaactcaatattattcgagagacgtatctatgacaatgacagtattaatctataatcctgaacgtttagatttgtcaaaatctggatttaaatcgcagggtgttataaactggaaagaatttaaagggcaagcgagccggtcattagcaggaggaaaagtacagcaaaatgatgatattcaaaatttgtcagttgtatataaggttattactgatgctaatgacataaaagggacagcaaatgttatgacaataacatcgaaagatgtctataatagtactgatggagctgatgcaaatggtataacagatggaatcgggggacaaattggcatagtacaatatcaaggaggagattttaaacatacaatatttcatgagtttgggcatatgttagggctagatgaaggttatcagaaacctggggtaccgtacccaaatgagaattccaatacaataatggataataacaatttatacaatgtaacttcaaagcaaaaagcagaagctgcatttgtcccactcaactcaaaaaaaggagatgtttataaggcttcgacttcaggaaataatcctaattttagaagatcttcccaattaaaaaaagcagtggaagattttaatacaaaaaataccaggtaa

SEQ ID NO: 830 - DNA, 3291 bp, Chryseobacterium sp.
atgaaaaaaatatatgtgtcaataggggtgcttctggcatttcaattatacagtggtcaggcatcatccgaatccaataacaattacggattacccaaaatagtagcaccatcccaggaaacatttgccagcagcaggattagttttgaacaatcttccaatggtgatttttcccatcagattcccatttatacccagcttagaacaccaatatctttaaactattccagtggagtaagagcagatgatataggaacaagcaccggaatgtcctggatactgaccgctccgggtgttatatcaagagtggtaaaagatgaaacagacgaaaataataccaactggaaacccgaaacgattagtgaaacagcggatttagccaaaataaaagaagctgccagaacagggaataccacagatacggaatatgactggtttaatttttcagttgccaatggattatccggaagtttttatattaacagtaatttacaggtttttacggaatcaaaagataaggttaaaattgaaatttttgacctgaatgcccctgtatttggctatggaaaactattccgttttaagctgacggataaaaccgggacagaatattattttggaggatcggtagagaatattgaaagatccaccacgcagagttcaggcacggatcgtcaggctatcacaggctggtatttatataaaatcctcagccccgataaacaggaaaccaattttacctacatcacagaaaatctcaattatttttcctcactgaatgcagggtttagcttgcttcaaaaatgtccggatgcctcatctggcgaccaatatacctacaatgatatcgtcaaaaacaaagtaagccagcaatcctataaaccgaagctcacgcttatttcagaagataataagaatatctcttttatttatggaaaagcaagaaatgatttattcaacagcaatgctgaaaataatcttctgacttctatagaaataaaaaacgggaatttactggttgaaaagtataacctggaatatcaggatgttcaggcatcaacagctgctgctacttattatgggattccttctaatgaaacctctaccagaaacagacattttttaaaatcattgaaaaatgtcactaagaatacaagtaccgatttcagctattacagtttggaaaaacttccggcaagatttagtttaaatacagattactacggatatcccaataatgccaataatgtttccccttttcctgttcccggacctaccaataactttggtatttttaaaaagctgggagcttatatgcctttgacaatgctttctgctaatagagaagtccttccaacatgggcttcagttggtaatttaaaacagattacccattctaccaaagggatatccgaaattttttatgatcctaactccagttccgggcccgttactacagaggtaagagaggtatatggattggaaccccaagctcataagtgtaatcctgcctataaccatcctaaagagtcatttacttttgtttccaatggaacacccattgatttttatgcttctgcatcttttgatataggcgcggggtgtaatgaaccggatgaaagccgggattggcatcagctggttatatcgaatgtaacaacagggacaaatgtatatacttcccaaaataatcagctttctttagttcatgattctcaagcaatagggaatcatgccataaatacggtagctggaaatacgtataaagtggaatatacagtaagggctgcccttggagcggtatctggagcagcaactatttcgtataattcacataatgttactacaaatcaacctgtatatttcggaggaagcagggtttcatcgatcaaagaatctgatatagaagggcatagctatacccgtaagttttactataatcctcttgccaatatggccagttcccagacttcggttgccgattataacctgaattatataggagcagcgctacgcgaaacctcaaggacttgtacatggcctggcaatacatttccatccatacaaatagtcaatatctatacagccaaccaggataatctggtccctaattttaaccatagaaaaaataaagtgacctatacagatattacagagattgtagaaaataaaagtgcagtagagaaaaagtttagctacgttcccaattcaggatatagtataggaaggccgccggctatttataacaccgcagataccaattccggggaagaaaaatcttatttactgatggaggaaaacagctatcaatatgaaaatttggcttttaaaaagcaggttacaaaagtttataagtatgattacagccagctgaaaagtcttaaaaactatgtctttaaagagaactttgcctattatcctgaccctacccaggaccagctgctcaatatatcctatgggttttatgacaactattatgggttctacaatcctacagaagtaaaaactacagaatatttgccagataattccgtggtcactaccaccagcttcagcagttatgccaacccgaatcattatcagctaaccacttcaaaaactgtttttgcagacggttcggctcaggagacaagttatcaatatgctaatgaaaaaggaaatccactgatgattagcaaaaatatgattggtatccctttggaaaccaaaacggtgcaaacggtgaataatgtgagtaaaaccctttccagaacagagaccatttatccaacggttttaccacacgttgctactggaaacctggtacttcctgtatctattttaagttacgataatctaaacaacgcaaattctaaagaggtcagttttgataaatatgacgaacagggaaatattttgcaatacactaaaaaggatggcaccccagttagtattgtctggggctataataatactgcgccaattgcagaggtcgttggtgcaacctatagccaggttgaaagccttgtatctgaaatagtgacaaaatcgaatgaagatgccaccgatccaacaaaagaagcggccttgcttatagcgtttgaaaattttaagccgatcggttcggtcacaaagtatacttatgaccctttggtgggagtaactcatattattccaccatcagggatcagagagcagtatatctatgacactgccaataggctcaaagaattaaaggtcagggaaaaagatgcttcaggaaattacattattagaaccgttaagcaagtcacctataaccataaaccttaa

SEQ ID NO: 831 - DNA, 2856 bp, Chryseobacterium sp.
atgaatatacctaaaatgaaaatttatcctcaagcgacggataaatataatgtctcaaccagctatattcttattgaacccaaggaaggtaaatcttctataagaacagtaattgaaaactgggacaaactggaagctgaggaaaagaataatatagcgtggatttggagtatatgtaaccagaaacctaattttcaagaaaatgcatataactcagatttgggtataggaaaaggcaaagaacataatctgaattttacaaatgtctattggggaggtgtcggatggcttgaaccttatattcatgggaaaactaagcctaccaacagtacgaaaaatggaatattcgtaaaagttaaaaccactccaaaagtattggggtatgaatggagagagtatgatacaaataatgagggtaaacttattagcagagaagtaaaatatggagagacaattcaattgcatatttatactgaaggtctgtttggtgaagatatagaaatacagctgtttgatgataaaaatcgggctgaagatttgcctatgcacgaaaaagaagatggtaaatggaaaaaggaagaagaacgtgtagaactggataaaatcaacaaacagaaactgccaaattcatttccccgtatattaagagaggtgggtgcatttatttctaaaaataagcctagttttaaaacaattaacagcaaattaaaagatggtattaattaccaaaagtgtgtaacaaatatttatattgatcccgtctggagtttttatgccaattctgaaaataataagttcaaagaaaattcaattacattaaaagcttccattttcttttcagggaaagagttagaatgtaataaaaatagcataacattattaggacttaatcatgaatattcttttcttgaaccagaaggaaacaaagttatcataatagggaatgtagaaacaaattatgctaattttttaccttgtggctattcagaaatacatggtaaatataaaaaaaatgaagaagaagtagatatacaggtattcccgcttaaaaataatccgagcccaacacaactggtttttcctgttgttgcaggagtagacaaaatgagaaaagaactaactgttgaattaaaagatgttcgttccaacgattgtttacatgaaggaaagttaagacataccggaaaagtaatagatatatcaaaaatagaatcattactgaaaccggataataaaacaagaaaaaggcaatggagacttggacaaagctctgaaatattcaagggaggagaagctcaaacgaaaaaggaagaagataaaagtaaactgacacaagctattactttaattgatggtggcaaaaaattgaaaatgcagtccggatttaaaatactggaaaattattatccatttgaatatcagcctcctactgatgacttatttaaattaaaactaggttatgattatagttgggggaatactgttaatcctcttataggtcttatagggaccatatggcctaacagtgaaggagcagcccaaaaatatccgattggtttaaatacatgtgcatttcgaacaccattgaatattgctgtttatccggatacaaaatggactcttcaaatagcttataattatgatggtaaagaattcaacgaattaagagaagaatatcatgaaacatggaaactaaaagagcttgaagccgatgagcggatcaatcagttaaaagcacagcagcaaggtaccggtagtaaaaggaaaagaaacagagcacgaattcaacaggcctcccaggaaagaaacagagcccgtaaaaataattctgtacgaagccaggcaaataatctaatggaaaaagcccatggaacgcttgatgcagagtataatttaatttgcgaatttgacagaccatatggagcattaaattttagctcagaatttcttaaagctaaagaatttcttaataaaattgtaagcttaaaagaacttattgaaaaaattgtaaaaggcaataacacagagactactagaaattctcccacaggcaatgcgactattactaatcgtaaagccaaattgcaggagttaatgaataaaagaggaggagaaaagaaaagcaactggagctttgaacttatacctccaaaagtaggtctttctgtaagttggtgtgctgaggctcctgtggatttaaaggacccggtaatggggactttgattgaaggtgcaattgatttaaaccctttatttggtattgaagcaaaatatgatttgtatcagctattatataaaataaaacatccggcagttcttgccgtcgttgcaatattggatgttttagatgatgcattaggagataattttgatattaatttagatctgattattaacagtcagatctttggatctttaaaagggaatatcaatacagcttctggtagtagttttacaaacagattaatgaaggatgatgatggtagtccatgtaaatttggtggaaaagtttcgattgcaattaaaggatatttacaagctaatggaagtatgagagtatttgttttctggaagtctaaggcctacctggaagctagtgtggaagtaaaaaccggaataggcttagaatttgttactaaagctgacactcatagtatttatgtggaacctgaagttaaatttgaaggcttattgttagaagcgaacgttagcctaggatttgttgctgatgatgcgggaacagataaagccagcgaattaaaagaaaaagatggaattcactatactgcagatggtaaaatagtggtcttggatccttatacatggaaaacaggttggaaattacctataatataa

SEQ ID NO: 832 - DNA, 975 bp, Chryseobacterium sp.
atgaaaggtgtagcaaaacaagaatatacaaaggtaaagatagacggaattctgaaccttaataaactttccggagagtatgaactcactccggaagaattggttggttttcataatcaatattgcagtcttcaggagttattgaccttatcactgcctaagtatgtggaatacatttatattccttctgataagtttgaaatcagggacagaaaattgctgaaaagtgcagtattggagattccttccatttccagtgagaaaatatacggagtgatcatcaaatttttacctaaagatctacagattcactacaaaataaaagtaaaaagaacagcctcccagattgaactcactaaggaaaaaacttatgtaaacaatcagggaatcgacaaaatgatagagcaactgtttgaaaaagcagaacagattttatatccgttgcagatttcaataaaaaatgatggtggactaaataacattatcaatcatgaagaaatagcaaaacgctggaaaacagacgctctcccaaaactcaaagaatattatcagtctgaaatcactgaccatatattggagcaaatggatcaggcttatagagatcttaatatgagaaaagagatgtttaacaataatatcttttataaattattttttttacctgtttatcagggatatcctgagtttctgaaaaaagattttttgcagatctttttttcagggctgtcacaggaaatcggttataatatagaatttgtattaagcaaagaatatacaggaggaaacagaatagcattaaaaataacaggaactgaagaagaaaacctatttaataaaaacagggcaaaaggagaagtgaatctcctatataaattcgacaaagaaaccagagaggtgttttcaatcaccggttatctttcaacttttgagaaaaagaatgagtataaaattgaatttcagctgtttgaacagtaa

SEQ ID NO: 833 - DNA, 1689 bp, Chryseobacterium sp.
atgaaaaagacactacttctttgtttactcctaatcttgaacacccttactttagatgcacaaaataacttacagctaaacagacttttacaatctaatactggatcaccttcccaaactattactccaagctatttgaaagcattttctgatggaagtgtttatactcatgtaattgtttcaggtaatgtaaatttttttggaaatcaaattaacacgggaacaaataaagccagtttattcgcaaaattagaccctagtggcaatttaatttcacaagcctatataacttcagccaatatacaaccatccagctatgataatgccaagaacattgatgtaaatagccaaggtgaaactatatattctattgaaacatcaaataatactacttttcacagcaatagcggaatcatcactcctttagcgaattacgcatacgaaatcattaagatctcgagttctggtgaatttctttggaaaaaaagcattaccaattctaccgctaatccaaaagtcttttgtttttatgataaaaacggagatgttatcatctgggtagggcaaaatcagggaggaagtttgacttttgataatcaaacttatgacccaataagctgcttcatagcaaaattagatggccaaacaggaaatattgtttatctgaaaaaatatgacgatttagatccttggaccggacattttgcttttgatgaaaacaataatatgtatgctttttatgagcctttttcatatcctacaacctataatattggaaatatacaagtcaatggaaatgcagatgaacttaattttttgatggtaaaatttgactcttcgggaaatcctgtatttggtaaaaacttctacgaaaatgtacctgccggaacacgtaaatatagctggcctatagatataaaatacaatggactcaacttctttatttacgaggttttatcacgaaacactatcggcacctcatcttttctgagtttaaacggggtttatcatacagatccttatttgaccaaaagtattgctaacgagatatcaatagtatctaaaacaggagatgtgttgtcatcaactcctatctttacctctggaacatatgattcaaaccaattcgatgtagatgggtctggaaatagctacatttatggaagatggtttgataaaattacacttggaaatacagaatatcaaatgcccacttattcctccaatgttattaagtttagttcaaacggtggtttaagttttatagaacctattgttcagaattcttttagtgatttaaatcaaaaaatttccatatcagggaataaattatttttaagtggaaatacttccgcgcaatcaataaaaggtacagcaattaacaatttaggaggcagcaattattatattgctgagttattacaagctggaacattatctacaaaagaaaatgtttccaataatgatttaaagatatatccaaatcctgcccaagattttatcacaatagagaacggaaaaaaactatcttctgtgaaaatttacgatgtaagtggaaaattagttctgtcaacaaatatattatccaataaaatagacgtaagcacgcttacaaccggaaactatatgatagaagttttcgatgaatcaagcaaacttattgttaggaaaaaattaatcaaaaaatag

SEQ ID NO: 834 - DNA, 717 bp, Chryseobacterium sp.
atgaaaaacaatgcaaatcacaatgggataaaacattacattttatttttcctgtatatatgctgtatttcctgtcaaggtcaggaatatgacaaggatattctaaacttaaaagaacttgaccttggattaaatgctgaccgtttttataaaaactcgacgaagagggagaatgttaaactattaagcggaaaacagtatgttgaaaaagataccattaccgaatatgaccatgactggaatggtgaccggaataaaatttttgcaatacaatatcgtgtcgtaggatattctcctgcagatgttgttgcccaatttggcaatatccatttttcaagagtagaatcacttgtggatgataaaggaaatctcatgctcatcaatgccgttacgaaggcttccaaagacgatattctcaaattcatcactgcactgaaaaaagaatatcccaatcccgaagtaacagaggcttcatccggatataccaataaccagattataacatggaaagataaagaccggatcattaaattatcaaccaatgcccgtttagatttttccaatcctcacaacatcctcagtgaagcggataaaaaagaaattcaagaaatagaaaagaacaggatcacagaatctaccctttttatctgtaattcaacatatgagaaaaaactcttagggaatcttcattccggaaactggatgaattttaaatag

SEQ ID NO: 835 - DNA, 243 bp, Chryseobacterium sp.
atgaaggaaactggcttattgactacgctaaggatggattcaacggatgggaatggaccggaacacaaagaggtggaagcgatgcaaagcctgtaccagctgattatgatggcgacggaaaagcagacattagtattaaaactgattcggacagttggtacattgacacctatgcagatggaatgttcagcggctggaatagcatctataatttggatgagattaccccatataatctgttag

SEQ ID NO: 836 - DNA, 1212 bp, Chryseobacterium sp.
atgaaaacagttaatgtcttaagaatttttctggcatcaccaggagatgtaacagcagaaagagaaatgatttttggattaaaagatgatcttgatgaacttattggtaaggacaaagatttaaaatttgaaatagtaaactgggagagaaacacctatccaggtaaaggtgaagatgctcaagacgtaatcaataaacaaatcaatgacgagtatgatatttttttaggtatattttggcaacgttttggtactccaactaatcgttttgagtctgggactttagaagaatatgaaagagcaaaaattaaatttgaacataatcctgaaaacacacatattctaatgtactttaaaaatctagaagttgatatgtataatttggatttagatcaatttaaaaaagttaaagaattcaaaactaggatatcaaatgaagatggagtatattatactatgtttgaaaaaacagaagatctaaagaaattattacaattacaccttgtcaatctaattcgagataaattcactaaagaaaaatatattaaaaaagaaaatcatgagattaaaaccaatcatgaagttgaagattatgataaatatgagttattagcaaaaaaaattgatgctggagattataatattgaatatttagatttagtagaagatgtagaaaaggcatatggttttttacaagatctaacactatcaactaataagataacaaatgttatgaaatttttctcatcaaaaactaatgaaaaaactaatctattaaaaattacaaatcagcttaaagacgaaaagttaaaattaattagagctaaaaaaatatcaaatgattacgctaaagatctagatagtttttcagataactttgaaaacttattacctgaatttagaaattcaattaacaatactattgagtcttattctgaaattattttaaaaacaatcaaatctgatcataaagaaattaaaaatgaaataatagaagttattccaagccttgtcaatggtattcagagtgcactagatggaatttcaaattttttaaattcatttattgagaatagaacccatatcacttcaaaattcagcaccgcaaaaagaagagcagagctagctacaaacaatatttttaaagagcttatcaatgcacgaaagttattacaacaactactggatgataattttaataatttgacataa

SEQ ID NO: 837 - DNA, 2022 bp, Chryseobacterium sp.
atgatttacactgaagattttttctcttttggaagtaactatccaacagatgatgtagtagtacttgtagatagcttctcaaatgaaaatgtcaattttaaaaagacattagtttgggaggatggatcaccaatgactgacgctaaagtagaccagattatttatagaaaaaaaggagcttttttctacaaaagagtaacggtaaacgctaaagtattacatgcgaagattttcaatcctttcaacaacggtgttaatgacgatagtcctgctatctctaaaatgatgaaaatatcatccatggggtataccattgatggtaatgggctaacctatcatttactcaacagaattactcaggaagttgataattttagttttatcaactttaattttcggctaaatgataattatgacttagattgtggatggaaacttactgtcaaaaaaaatatagtatttgaaaatatttttattgatgggggaagaggtacttacaaagatgaaaacggaaatattgaaaaatggattcaaggagaaggcgatgcttctgtaccatccatcataccaagcttagttgatgtttttttattcatacaaggagatggaaaatcaaaagccattataaaaaatgtaagagctgtaaatgttcatgctatgtcggctattactttttattcttatggaaatgttgatatcgaagacagtcattttgaaaatatttcaatgaaaccttttcatgtttaccactcgtttgatgacggtaaaactcagtctggaaaaacgtttattaagaatataacaacgaaagattgtgggtatttagcagatgaaattttggaaaaattggctctagatccaggcttcgttctaagaaacagggcagattctatgggaatgatacaatgggggtatggggctatcgtatcttttggtgaatactatattgaaaatataaaagttgaaaactatggtgcttctgcagtttgttctgacaggaatactaaattctttggaaatggcatttatatatccaatgattctggtaagtttgaatctaataaccctagtggagccatgtggtttgaagctaccggtgatgcttatatcagcaacttggatatcgatatcagcaatagaggcagtagagatcttatctttgacagttctgctcttcaaatattcaacacagagctatatattgataatctaaagattaaaacagctacaaataaagtactgttgaaaaaagggataagagctagttataataacgataatacggttactgtaaataatctttatattagagggggttttcaggatcaatctgtatttcatggtattatggaatttgctaaagatgaatatcctttaaaaagtaaattggtacttaatggaggaatcattgaaggaggtaatctgctattttggggaacgagtgaggttaacctgtcaaaaattaatgctccaagttctaaaattgaatttcaatcaccaatttcaactcaattgaataagatttcaattaaagaatcttctttttactattttaataccatcacccattacaagcagatggttttagaaaactctacaattatttctgattttttctataatagtaatacttcagatgtcgttattaaaaattcaaatattaatggagcattaagtctaccttatacagtagcaggatctaaaatttatatttccgaaagtgatattggaagaacacatatcaacggataccacgtttttatagatcatgtaaaatcccgtcagggtctttacattgataacgcccagttttttaccatcaataattgtattttaaaaacttcagaatcagaaccggtgattatggtttcaaacaatagtaacagattgatttcaggaatgatcagccacaatatattgtctataaaaaccaatactccggcagcgggctacatccttttaactcctgaagcaacaacaaaagtaagtacctataacaatgccgaaactaattttgattag

SEQ ID NO: 838 - DNA, 780 bp, Chryseobacterium sp.
atgaaaataaaatttttattattatgcctgttagtacatgccattttttttgggcagatcggtaaagtaggtattaatacagtaactcctaccagaaatctggatatcaacggaaatgttagaatacgttcacttgctgataaaaaggacagtacaaatgtatatgacagggttttggtagggaatagtcagggggatgtagattttgtgcccataacaaaatttgatgttgaaactccaacaattaagacgataaaatttgttgtaaaaaaagtggcaattcccagtacttatagttacctcactgaagctgtggatataggaaatatatcagtcagatatagaaataatccatcttgttttggaattaactgtgaaaggagaatcggtggaaaactggaattcaaattttttaatgcatcaggtacaggaagtgtttggactggcagttccatgctggttaggagatccaattttttgagtagtgatgatactattcagccaacagatcaaagcggggaattcagaacaaggttttatgcaggaaccataaaaggagtaccttttggtgatactacttctccatatacagttcttgaacttgaatacaatccggaaacaagagacacgggtagtacgattttatcactgaattccacaggtgatgtatatagaatatccataatgtttaatggcactttaccggcagatgcggtaaataatattgctgcattacccagacaggcaactgtatttattgagcgtttgacagatgattaa

SEQ ID NO: 839 - DNA, 150 bp, Chryseobacterium sp.
atgtcaaaagcagccagtagccttaaatttgcaagaaaaaatactgctgtggcaaaaattgttaaagctgctactcaaaatggatcagtagttaataaggctggccaaaactcaatttctgatagaataaaacaattttttggattttaa

SEQ ID NO: 840 - DNA, 324 bp, Chryseobacterium sp.
atgaaagataaaataaaaatttttggtattttaactcttcttatggtttgcatatattttgtagcaacctatttacgagttggagaggttgataacattcaacatataaataaaaactttaaaatcatcacaggtgttataacaagaaaatctgtacaaaagggaaatcatatatgggttaaataccatgtgaatggtaatgtctatattgaatcggatggttttcttgagtctcagaaagtcaatgtaggagacagtgtaaaagttaagtattcaattgataaacctgaattaatgattacagaatttaatgagtatttttaa

SEQ ID NO: 841 - DNA, 174 bp, Chryseobacterium sp.
atgaaaaacaaacaaaaagcaatcgaactcttaaatggtattgaaacacgggtacctcttgatcatatcaatgaagagaagtacatacaacacaatctgaatattggcgaaggacatgcaggcttagaagccctgttttcacagcttccaaaaggctctaccaaggtaacataa

SEQ ID NO: 842 - DNA, 192 bp, Chryseobacterium sp.
atgaaaaatgcaactctaattgcaataatttcaataagcctcattattcttattgatcttattcagtttatttccagtttttttgagttttactctatggagctgtttcgcgtttttggtgttttaaatcttatctgttttatgggaattctacagtttttcgttaaattatacaataaacaaaaggaatga

SEQ ID NO: 843 - DNA, 546 bp, Chryseobacterium sp.
atggtgaaacaactattcctatacataagcgtcctactattttttataggctgtaaagaccgtaaaacacaaagtaccctatctcccaatacggcaattgctataaaagtaaatgagctctatacaaagtatggaaaatccaatgaagctgtatataaccagcctattccggatgatttattttccccggacctaaaaaagactttgcaaaatgccataaatgcttcaaaagcagatatcgaaaaagtaaaaaaaagtgatcatccggatgagaaacccctgatatttgaaggggctattttttcaagtttgtatgaaggctatactgcttacaagatccaatctatggacattcacaatgcttcagcccaggtgctcgtccattttgagtacaatatgacctatcctacagtatcatggacagataccatacatttggtggaacgtgatgggagctggaaaattgataatatcacctttgattctatcggaaattctaaagatcttaaaacaagaatgaaagagtttgtacaaagtacccgttaa

SEQ ID NO: 844 - DNA, 420 bp, Chryseobacterium sp.
atgaaatcaataacaacagggaaggtactcgtaaccttagttgccttagtcactctttttggagcatatatcgctgattggaatcatactcatattttcaatccccgctggcctccacatgcaaaatttcataacgcacagaccatgctcttcggtgctgtacttggacttttgtcattgtggtttctttgggtccagaaaggtgatagatgggtcgtttttaggctctcaatcatctttgccagtctttattggataacgcaggcaatgtctattttatttccgggaactgccttgtttgatccggagttttcttatcctggtcagtggcctgtacagttcatattagacggggttatgtttctgctgcttataatggcctatattttagaatcaaaacacttagataaagtaaaataa

SEQ ID NO: 845 - DNA, 171 bp, Chryseobacterium sp.
atgattaatcgtaaaaaaacaaaagaagctttagggcttctttttttatggtactgctctggaaccaatctggaaaattcactatatgtacccgttattttattacttttgcacaaactaacccatgaaaaacacttacctcaagtattttaccttgctgtaaaattttga

SEQ ID NO: 846 - DNA, 390 bp, Chryseobacterium sp.
atggaaattataaaatatatatcagactatgaagattttattatcaaattcgaaaatgtacttaaagaaaagtatcaaataaaagataacatttataaacatatagatattcttaaaaagaaagactcttttgataattatcaatataattttcatggagctggctgtaaaattacttttgatagtataatttgtgaatatgattttttattagacgaaaacagtaaatatcagttctctgtatggaaattgaaaacttttatagaaagcctctacaaaaacaaagtagaggatatagaactaaaaaactctctggaagatctagtctcaaaaaagtatttaaagaaactaattattggagaaaaaatttttgatatttatttaatttaa

SEQ ID NO: 847 - DNA, 1452 bp, Chryseobacterium sp.
atgaaatcagtattgtcactcatattactgttcgtgatgaatacatggtctttttcacaaactaaaacctatgtcaacaatcaaaattcacaaatctatggagtatgcttagcctgctccgtccagaatccacaaaatgctgtcggttctaatgagggcgacttttctttgatgcaaattccattgggtgctattgccagaattgagcagacattaatctttcccgcaaccacaaaactgaataaagtgatcattggtatcggaaccggccaagcttctttatccgtacaattgcttggtggagttgctatagaaacatttaacggaaatgtttcaaacaatgattacaagatcgtcaacagtgaacttctcaaaatcggcatatcaaatccaagtaaaggaacaatagaatttattgccaccaaaccctatgatcgcgtaagagtaactttaaacagtggtctcctcaacctgaatagcgggctcagtatatactatgcctatcatataccggatggctgtacatttcctgcatttgatccattgcattattatcctctcaacggtaacaccaatgatatcatttctggaacccatataatcagcacaacaaatcctccatcattcaataatatgatatgccaccagggaattaatgcttcagggacatccgtcaacagtctcaaagctaacttatcacctagcttaaaagccgcctatacaattgcattttgggtcaaaacggaacaaaaacagcccaacatgtcatccccctctctcacaattgatgcatttgctatgagatttcgtataagaaatgatagtatagtcctgggtattacccctcctaattttggcttagaacctcctttagaagaacgcagcagcctcagtacatctactgcattccatcattatgttctcagcagcgaaaataacagaacaattctatataaggatggcagcattgtaacggataacagccactttaaccctattatgattgatctcagccaaatgcaagccataactaatttaatagacggctccgttataatttcccttgaccgtgcacagatcgatgaatttatcgtttacaataaaacgcttactgatgaagaaattcaggcactttacaactcatatgacagaccagtgatcagccaatcaggtctttattcagatcataaaatcttaaagaacattccaataaaagaagatttcattatttctcccaaccccactaccggacagattagtatatatggaaatattcttctattagattctgatatcttcataactaatgtatcaggaaaagaagtatatcgttccaaatataaatctaaaacattcgatctgccttctactctaccgggaggagtttatatgcttaccctacaaacgaaagacaaaaaagtctattcccgtaagatcattttaagaaggtaa

SEQ ID NO: 848 - DNA, 135 bp, Chryseobacterium sp.
atgatttataaaatacctactgttgttttagtcaaacgattaatcaatacagcctctgtagaaacacgccctttcccttcagaacctgagaatattgaaagattttttcaaatgtttcaactattaattgaatag

SEQ ID NO: 849 - DNA, 837 bp, Chryseobacterium sp.
atgaagaaattaattatttcatcactggctatggcagtgatcgtaagctgtagctcatccaacgataatccggaagacaataataatggcagcaataataacaccccttatcttgtaaaaaaattaacagaggttgctccagacggacagtcttatgttgtagaatataagtacgacggaacaaaaataactgaggcccttgacgttacagataacgaaaagacattatacacatatgacggggacaatattgtaaagactgaactattcaggaatggagtcatgaaaatcatgagagaatttacctattctaacggaaggctcgcttctgaaaaagtgactaataaagaacaggcaggaactttggtatatactgaaaactaccagtatctgagcgataaccatgtgaagtataacgattatcactccgctacctataacccggcaactgccacattttcagatataaaatacacccagaaagatgtatacatcaacaatgccggaaatctggcttctatgagctattcatacaatggaatttcccgtaatgtcacctttgcttatgacggcaataacaatcctatgaaaaatgtaaaaggccttataaaaatagatatgttttcccttggagatggtggtggagatggtgaagtaggttacaataacctcatctacttaaacggagcctattcaggaattgtaaatgataccaatcaaaccaccggagttcatactctaaacaatgctgattatcctaccaaatcagtaatgaaggagacaagttctgttaccggaacagtagttcgcacctatctttatgagtataacaagtaa

SEQ ID NO: 850 - DNA, 405 bp, Chryseobacterium sp.
atggatttcatcatcaaattattatactctttattttttgcagcgatatctttcatcctcttcatgaagtataacaaagcattttctataaaacccaagctgctcatcattttactcctaaatctgatattattattttgtctgaatacgatttataccagtatttcaaataaactattttatatattactcatgttttcattatcagtggtaatattaaatatcatgaaaaattttattaacatggaaaataatgctgtactaaaaaataatgaccgttttagaaataactataaaaatgtcaaaaacatgttttttattaaagtcattcccatcataattttcttttatcagcttttgttaatatgggtcccttctatttctgcaaaaatgttgcataattaa

SEQ ID NO: 851 - protein, 264 aa, Chryseobacterium sp.
MERTTHVITARSIQELPCIDYLKNIPRQKIIRIVFDYPIIHIREDYGEQLTKNLPHFQIAIHSNEPKIEIKKLITKEEIIANQLFFVQCAKDYRKLGEELVCLFFEKKKIKLNKDFPFLAFNYFKGRSRRTQSGKVGKWRYFLHGYHCYFQNVMTKQEIEVPFMFGMEFGDLDPYFFSLYIKSTPDYQPLPVAIYEDFADGERILDVMLQLGLLERINSNLKTHFGLAIKDRNKVDIKIYNPDKDYEKIEFNSSLSRFIQFFNF

SEQ ID NO: 852 - protein, 183 aa, Chryseobacterium sp.
MKTLIWKGIFYQSLEYFNLYSDDKGYTVESKIIGFHENKIYALNYKILIDKDWTVQDFLIESEINTVKRTFSGKRNQNQWKVNGVVHSEFNNFKFIDISLTPFTNTLPINNLKLSENGSQKIDVIYIDVLSHHIRPVQQQYTRTDVNKYLYENIETDFKAEISVDEIGLVINYPELFEKISEL

SEQ ID NO: 853 - protein, 370 aa, Chryseobacterium sp.
MEQQNKRILTLDVIKGISVIGMIIIHTLLVYANVKSQYETAIGSFIVFLGRGTSIFLICMGITFMTSSHQSLKSAMKRGVLLVLAGLFMNFMKFMIPVFLGFAPDNFIQKYGWNAPIEQQYVYLVLLGDILQLAGMSLLFVGFIREYVKNKYVILAIGLFAALVSREVSGINIDYPVINYILDLLFNNDYPAYVYFPVFPWISFIIIGMFFGKWFQELNYDSKKLFRNMLYVGLVFVAIGAPLVFFYSEYNYNGFYHMGPGGVVYFAGWTLIFLWIIYILTAKINENKVIAVLKYCSKNLTSMYMIQWILISWGKGIFGYRQHEIGYVSVLIVLYIILTFSVQTLVDIIRKKKTLINFRPVSPDKTFLKQ

SEQ ID NO: 854 - protein, 411 aa, Chryseobacterium sp.
MNLKLSFILVLFFVNINAQSKNDLNPKEKEYISKFIYPIKTFNPDEKDGSDLLILNRLIGNSKIVGLGESTHGSSEVYQMKYRISKYLIADKNFNVFSLEANMPESFLMNQYIQEKKGNPKDILKGMYFWLWQTEETLNFVEWLKKYNENHDSKVFFDGFDMQYAKGAIDQIRKTYQENQLPEQEINDLETALKQNNRGFRTYSKKGQKIISEYLFLIKQKGISIKNPDEKLRFLQNVDIIRQYIQLNFIRRDKFMAENVKWLKENYLNSKVIVSAHNYHIAKLNSDRMGYWINETYADDFVNFGFAFYEGTYSASIDGKIGTYNSEQACPGTLEYKLNSLNIPIFILDLKAIRKDNNKLGNWILKDILFRKTGSGTDKNEFLKTNVANSFDYLIFINKSTNSKLLISKSK

SEQ ID NO: 855 - protein, 576 aa, Chryseobacterium sp.
MKSLKYFFFLLLALLAYNQYYSQNKVLIDTLSKYDYLELEEKFYNYKNNNKIKESKIIAEYYLKKAKKAMIINNIAEGYVFMQYNQNLAVSLKYIDSLESISNRLHDNRYPARIYLLRGKLYFDYDNEKLALDNFVIALSHAKENNNKRQIAIADLQIAYLNGYIGKHKETVKVLEYYYGNPEFLTPEDIEHIQISLADAYIDIYEYTKALKLIEKGLKDASKNNEIKRYNKYLILLGRYNLETKNYPNAISNLEICKKYFLKNNLDFDANYTMLYLGESYLKSNKKDKAVENFVRIDSIIQKTNNTFPELRDVYTFLVDYFKEKKDKEKQLYYIERFLNVDKTLDFQFKYISRELPRKYDAPKLLKEKENIINDLEKKKYFLFSGLGVLCLALVAVGFFFYRSKKSEKKYRKIAQDLIKSINEKKSEIEKKEKKRDFPSKIEPTSKIKKSVIRNISEDTVQKILKELERFENNELFLRKGITLNSLAKDFKTNSAYLSDVVNTYKEKNFASYLNDLRIDYALNRLVQDKKFRSYKLTVVAEELGYNNEQAFALAFRKKTGTILSTYIKEINQSQE

SEQ ID NO: 856 - protein, 45 aa, Chryseobacterium sp.
MAGYFPAISMNKLNFITPEDVIFPSFGWVVKIQRIFDGVVLTATF

SEQ ID NO: 857 - protein, 243 aa, Chryseobacterium sp.
MNKKILLVLASSLAMFQYTNAQVRTNGFASGNIAGQGAFLDASGSTGGFTDSVNDGKGLVFPRTNLTTFTFATPVTDEDNFPTAYDGMIVYNTATGTTVSGIATSVTPGYYYFSNPTGGTANGFATSTGRWVSLSTSPKVTVGTTETTTNTIINTTAGDKQLYAIKGTFTASGTSTAVNIPAPAGMSAMYGITIYKAGTNTVYDRSLYSYTIATTAGNAITGSPSMSVVYPSGTYDYVLEYLK

SEQ ID NO: 858 - protein, 210 aa, Chryseobacterium sp.
MKKFLLTAIMLVGLSALSKAQQGRVGINTTTPAATLDVVANTTDNARPDALLIPRLTRAQLLAKDAAYTAAQNGALTFVTTIDGTATPKTTNVTAVGFYYYDGQTTNTWIALGGGGTVTPVVPTVRTSATGTDLSAADLDGYVFLTTNADLSTIPVTAATKGRSITLVKVGGGTLTVNGASAASVNSMTVNGRGLGFVYDGTAWQSYSAQ

SEQ ID NO: 859 - protein, 303 aa, Chryseobacterium sp.
MKSLLSSLFLLLMACTSTSQVKNNQTKLYYALGTIGNKADNYFKQIGAVEVGFLDEGQFISKTGDKYYLNKELLEKEINRGVPDKNAKGIVYIDLEMPFEDMNGKDKNLAMKGMNYCLEVLRYAKKARPNIKWGFYGFPFTSVWGPNKEFFDEQNKFALLLKECDIFFPSLYTFYSNPAAVLANGNYLENNLTGSIKLGIAYKKPVYVFMWHRYHNSNEKDGMKEISDKIWQEQMETVASQNVNGKFVDGILWWGADAYFYERPEAENMRKEFKGTLNNFISHNDESIIRKAKIIKDVLQSKK

SEQ ID NO: 860 - protein, 230 aa, Chryseobacterium sp.
MSLTVKIRSAINAMTGKITNVKRNININHKWYGNDYSGFYVSPLKLTEKSVIYSFGVGEDISFDEALIKEFGCKVFAFDPTPKSIEWIKNRNIPLEFTFFPYGIDDHTGVVEFLLPKNDNHVSGSVINQINVDEKKTVKAPMKCLSDIVKELGHSYLDIVKIDIEGSEYKVLESILSAPVEIDQILIEIHERFFSDGKDKTKELLNMLDQKGFKLFGISDSKEELSFIKV

SEQ ID NO: 861 - protein, 387 aa, Chryseobacterium sp.
MKILMLCDAYFINFQYQENLIAKSYIKLGYEVVVITNTNEKILDFINDIHDNSLPEKIEYDNGVKIYREPYSINILHRVRRFKNVKRILEQEKPDFLFSHDIQFNIGDLVDYKKKYNTRIIMDYHADFSNSGKNWISINILHKIIRKRYFYKYKKYIDKIYPVVPASEEFLHKIYGISYNEMELLPLGCEYDECEKFRKETDIIKLRREYGISPNDIVIITGGKFHKLKRTDLAVKAVKKINQKNVHMIVFGTADKNHEEYLKTMLEDAEGANIHFTGWADSKKIYELMAISDIALFPASQSVLWQQSIGMHLPLIAGDAGGQDMSYLNQNNNLIKIDAPDINEDFIKEILLDLILNPEKIVSMKKGAEKTAKEYLDYSIIAKRTLN

SEQ ID NO: 862 - protein, 399 aa, Chryseobacterium sp.
MYIEKVNKLQVVFLVLMLYGYELVSFFPSLLNMESSRPVSVAYRIFVFLLASWVILKNKIRITNKHLLIYTFWFLYLLRLLYDSALTSKMIQSPIVDYWAFSVGIIGCSLACTTNFNQNTIISARKWVVIVLYIVNLWGLYNNITQPQIVPDDVLIRADANAALNTVSFGRAAGVMFFVCFTIFLEKNSTWQKVLLGIGMGVSLFNLFMAGSRGPLLQLVIVIIVFLLSSRKLIKPKYILLFVIMVVILMTLFPQYLNISELVFERFKETGFSSNDSDRYRAELFKSAWNQFLDHPIFGDSIETVFEGTYPHNLLLESLMSIGFVGGIMIIIITIIAFINAIRYIKIPYYNWLGAILLMDVISSNSSGSIANYLLFWPLLAFTINSHITKQQNGKTIQT

SEQ ID NO: 863 - protein, 72 aa, Chryseobacterium sp.
MCRYAGKTYKSHYACFKCRKSFKQADSSDILAACQKTLIEECPGKNNEIKYWSDNIQKIKTEIIGNRFEITV

SEQ ID NO: 864 - protein, 61 aa, Chryseobacterium sp.
MSKKLTKKLTLKKEKLSQLNSDEMKSVKAGKELVTSVFDCSHWTCTAGSSRSTNLCVCPVS

SEQ ID NO: 865 - protein, 305 aa, Chryseobacterium sp.
MANKLKIGLLEFGIRENSLNNSKKSLYDIIDYATRADELGFSRFWVTENYFSKAHDMAWSTPEMLIPILLGLTEKIKIGIAGVILPLQSPFRVAHNYKLLSSLYPKRLDLGFVKGLVGEYDLKYFNVDVDKENYFSSFLPKLESTLSFLRDESEFLEKDLIIPPYKGNIPDVWYMGSSHSGLKVALENDLNFARSIFHGESNKDYLKEELQNFRTEYKAKHGKEPSMVLTFSGCCHKTKRKAINVAKKSTNNDISNISLVGDGSFFHEKLLEFKELYGYNEFMFNNISRSHKDSLTAIEILSQYV

SEQ ID NO: 866 - protein, 384 aa, Chryseobacterium sp.
MYKDKIDFFLAQISEKCNQDKGENITFSLGNGYYSLFYNNDVEIEKIEDLIDMASEASYSSFATGSLAIIYFMRLLHNADIITDEDIDGLEEDSIEFFLELLSAAADKKEYDLFTGLIGLGIYFLEIKKFDAVDKIVSHIDQLKHERNQSIFWIDHIVKEENIIDLGLAHGQPSILSFLAECYHRGCKKETCAKLISGSVTFLNELYEENKQAQHIFPSKLNIATGEKQLSERLAWCYGDLGVAIGLWKAYTVLQDENLKAMCYHLILNVSKIKADKSGVFYSQKNDCIDTGICHGTAGISHIFNKFYRIFQNEELKEAHNYWMSLTLDQLEKGAKFPYDLKNDEWVEHTGLLEGISGVGMVLLDYQYPEKAKDWDKIYLMNIG

SEQ ID NO: 867 - protein, 411 aa, Chryseobacterium sp.
MTRIALINCYFGKSWPEYFNHFLYSCKYNPDVDFLLFTNLEAPFHLPNVHFTKISSLAEFSKMASEKLNLSISILDGYKLCDFKPTYGLIFQDYLKEYDFWGYCDIDIIFGNIRYFITEKILKKYDVISPHKNYPAGFFTLLKNNEQCINLFKKSKDYAHILQNTRHFCFDECNFEFNLVHTKDITDIPTEIESFTLVVRKLELQKEIKYYHKNIVQEFVYSDATHHWVEGNIFNTVTEKQYLLIHLINLKDNPYFFIDPFDTKGKFSISPRGIHYRSNNISYPIKKIRRKIEKRITNTRYRLLLVKSKLLAYTRKQHVNFLEDQSYKIGKTHITFYPQDKNKLIIINKVENMFHYNQFFLYNLKGNQWIGVSKKNISTIEFHYKNKENIPYKISIKNVKNCVTENAYYIY

SEQ ID NO: 868 - protein, 123 aa, Chryseobacterium sp.
MIKKCEYLRSFNFLLKKFVQQHKKARKIQDYNLPIEDYNFYSFYNILQNDFDIECMVVRLDHWEDMEELSFPAIAFLKINGGIFVLLNDYKNGKVYWENNEYRKQVNTFSLFKKISDQVFLIS

SEQ ID NO: 869 - protein, 342 aa, Chryseobacterium sp.
MDIILDTNILRTDFFLNSKDFEVIFDYIEKTHSNLVLLNIVLQEIEKLYEEELKEKYDVFKRTNFELSRLLAEGPIETKDIDFEKQKKIFKDNLLEKFQISEYNEIFELENSSFNKIIQRAVNKKRPFRINGVGFKDAVLWESIIEYIKMYPYKDSVIFISNNAKDFADENNKNNLHPLLLEEIKKFETKIYYFSNIKDFIEKHSKHINSISSEWLNINIDKNLYLEKIKESFEVYEVKEICNWFEKQNPDLKANGKVKLNRVFFGNSENFYVYEMSNKDVIIKFEQEIEAEIEIGFDKKYHYNSFAEGLMELNYIKINLYVTLEQISNNISIDEIYFDIIN

SEQ ID NO: 870 - protein, 101 aa, Chryseobacterium sp.
MVSGWKNSQNKTVSNPNIGYGFYTLQYADGKTRDFYQIGMSANTTGISVYVMNIDDKTYLPETYGEKIGKASVTGYCIKFKALKEINIEILKAAILDGLKG

SEQ ID NO: 871 - protein, 43 aa, Chryseobacterium sp.
MKTYTEKQSINPALLNSYKLMKKIIKYSLYILIFYFAVKGFMA

SEQ ID NO: 872 - protein, 81 aa, Chryseobacterium sp.
MKESFYSRQQSGYDYVADEANCNVCLIRINEIDSFFASLRHINKKLNFALKKFFLSYFSFLISKGFLKISSSCFPLISILR

SEQ ID NO: 873 - protein, 164 aa, Chryseobacterium sp.
MFEVLVSKKKLIMPQYIDSYYLVDTRKLEIVYDFFSKYFPLGVEDLAIDYPFPEFSDSPEKIFHSVRELLLHLEDNLGYEYTIYFDNIDKSATIKQIILQYTDDGKIIFGVSIIGNDPSLIQQIEIIKEIKNYLNSKDACATVEEIPPINSSEFVEFCDERYRI

SEQ ID NO: 874 - protein, 576 aa, Chryseobacterium sp.
MSAYIKMMKYKYLFLFFIISNIFYTQNKISDSLKSLNYKDLKSIFYDHYDHIRIQQSEKIAKYYLQKAKREKNTLEIAEGYNLVHLNEDFHTALKYIDSLAKITKDIKGNLYPARTYLIKGNLYYKYDNLKTALDNYVLGLKYAKDQNDEKQTAYANMNIAYINSYIGKNVEAAKIFRYYLYNKNNITDEYQHNQIRIALISCYLDINKLDSASILIREGQAFANINKNNYDISLYSLLSAKYDLKQRKYKTAITKLSKVYDDIIKINPNNANTALYNLGKCYEGLKNKEKVVEIYTKLDSNVQKTDISFPELREVYTYLIDYYKEEDDKEKQLYYIDKFLKVDKKLDEQFQYLSTELPKKYDTPNLLQEKEDIINDLNNRKTVLHASISILSVVLLLILYLYFKAQKTAKEQRRIAQELIQSIEKRNFESTDLKKEVPEPPVQEQAEIESKTTKMVPEDVTVFILKELEIFENKQLFLKNGITLASLAKNIKTNTAYLSETINNHKGKNFTSYLNDLRIDYVLERLVKDKKFRSYKLPAIAEEIGYNNVQAFAVAFKKKTGTTPSIYIKEIETQQ

SEQ ID NO: 875 - protein, 92 aa, Chryseobacterium sp.
MILQYSVWIFLNRFFSSFVFFRPPKGGFSFIAFYDSTHMYVDPENVLLLHAFSFHIYQNGFLFREAIYYMVNIYPPRIKYGMYWRKIVRYYK

SEQ ID NO: 876 - protein, 522 aa, Chryseobacterium sp.
MKKIFSILTLAGLSLVLNSCADKFDEIDTNPNSTENPLPTGLFNNANKEYIDYTRDGWVSGRMMLPWVQYSAQRQYTEEDRYQYRLTTGTQLWTRSYYVAQDYKKIIELNTDPATAAQMANYGANVNQIAAARIMLSYVFLNLADAFGDIPYWSYGNKDADFQALNVDANLQPKFASQQKVYADIMKELKEAAQMIDLTKDVLTSGDQLFGNDPEKLKKFANSLRLRVATRVKGVVSGAEAHITDAIASGVMTSNDDTVGLTYENNLINPSPFFLTYQTRSDFAISKTFVQLLKGQVGNFGEDPRIFKYASPTTVKIGNIRNQNMVEATSASQISGMPYGVPSTLAASQAASSSFFGASVLKPAYTEVFMEYAEVEFLLAEANGWSQSHYEKGVRASMERWNVPEAKITAFIAALPVANKANVLTQKYVSLFMQPNEAWAEYRRNGYPNHLLLPGQTANLNVPSASGQTTYTFTSLIAGLTDLPTRIFYPTTVQTLNTANYEAASNAIGGDKMDTKLIWDKN

SEQ ID NO: 877 - protein, 975 aa, Chryseobacterium sp.
MKKLTTSLLVLVLSSSVAIANAQQKKNDTATQTKEIEGVVVTALGIKREKKALGYASQEIKGDLISDAGQTNAVSALSGNVAGVQVTAPSSMGGSTRITMRGISSVTGENRPLIVVDGVPLDNSNVNSVDTQRGAGGRDYGDATFDINPDDIESVTVLKGGPAAALYGYRAGNGAIIYTTKSAKRGRTEVQFNSGVSFESIYIRPTLQNQYGGGLESTLPTATINGKTYNITDFGTDESWGPKYDPNLYYLGWNSFDPEFPNEYMKLKKWVAPTKDVDDFFRVGTTYTNNFSVSKSFEDTNVRLSYTNTKINGIVPNSEIKKDNFSLNVTSKLSEKLKADAVFNYVHTAGFNRPEQGYGDNSVAQKFYQWGQRQLDFAELKEYKLPNGMQRSWNRTSWDNGTPNFSDNPYWTIYENTSDDTRHRFFGNAGLTYNLSKKVYVAGKVYGDTYSQTITSRVAIGSAALPEYNIQKRNNSEFNYEGRIHYNDNFGDFSLNTFAGFNIMNRKWDVLNGNSVGGLIIPGLYNLSNSVEPAQSSNASYHLGVRSLFASVSLGYKDFLFVEATGRNDWFSMLNDDQFYPSVTGSFVFSKVLKADWLSFGKLRAGWSRIAGGSDPYIRGTYATIGTPFGGSPIYSMPATKGEPMIKPELKTTKEIGLEASFFKNRLGFDVTYYDVKTTDLIIPLPIDPSTGYGFKRINAGEMTNKGIEAMVNVTPIKSSNFSWDITWNFTKNKNKLVELQGNLENYILTNAPFRVQLAAQVGYSYGVILGTDFVYDANGNKVVDENGFYKASEIKPLGSVLPDYNMGFRNSFKYKNFGLSFLIDIQKGGKYFSTTHMWGMYSGMLEETALGGNREAGVVLPGVKEDGTPNDIRLDAPTWGGTYYSTVDAQNVFDASYIKLRDLTISYDLPKSIIGNALQGVRISAFGRNLFAWNLAFKGVDPENTAYGSGNIQGLEGGSLPSTRMYGINVNFKF

SEQ ID NO: 878 - protein, 163 aa, Chryseobacterium sp.
MTLKIKNYFIVFFRTTLFLFSFSLPFVFTKGAYQNMISKGHYLWFSYFILIFLFMIYLVGKKNYYELIRAKIQNENLVYHNFLLIKKTIHLKDILGYKHGVDDDGNEFISLFNNQNRKIATLKVNIYSNLPEFLESLHCEHIGYELTPLQTVIEKIKKLFTNT

SEQ ID NO: 879 - protein, 451 aa, Chryseobacterium sp.
MKEKKTVYQLEEIFTPSQPADITFVERNEINRRLDRALKTPGKQIILYGYSGVGKTTLLANKLKESELKYIKTNCITGMTINDIILDAFNQLDIYYPVEKSKTKSNGGGIDLNLSFWIIKASLKDENKSETKISQKRAVELPITPQNLAKYIGAKELCWVIEDFHKIEESQKTQMAQIMKVFMDSSIEYKKLKIIALGAVNSAREVVQYDPEMRNRIAELEVPLMDIPNLKRIISNGEKYLNIDFDDAIKNRISTYSSGLPAVTHNLCLIMCELNNIRESQAIRKKILSTSFNEAMEEFLEENSDSFKIIYEHATKIIHKRKNENPLDLLHAIIQVNKENFSISEIKEIIQTINSSYVGNNLKKYIDEFCSPIRSEILRFNENSNRYYFSNPFIKAYIQCILKKDVNVDNNSFKSEDFREEFKNILKIELSLAKKAFILDFGDEFGNFEDF

SEQ ID NO: 880 - protein, 210 aa, Chryseobacterium sp.
MKTNLLEFIEYHKIDKSDIMDAKGLSISEIKDEMKINDILFAYNTTPCGNAGHTIRDRHSHCIVCNTAHIAFMKRTKATGYVYIAGSIIKNYIKIGMTTEDPIKRIGKLNSRKVGNTNDWIVIKAIKCDHANMVEIDIQKALQKYKVEGEYYGDESIESVEIFRCKYNKALETVENYFRDKQINKKEEKTYLFNIEKYNNFRNIVNPKYL

SEQ ID NO: 881 - protein, 294 aa, Chryseobacterium sp.
MAIFEYDHFDSPLKVGDNNPHRQKCVFCQNELEVFLIDDYWDVNLKEIYSFHQLGKSWCYEEGMDEEMWELDLSKYSCKTYFHHCNKCGWWRIIKDVTVSAKVWQLWQFFYGTAGLLKKLDLHNIDVPINEISKYLLAKYEARFSLHPKLFEDVTGQVFKNLGYEAIVTGYSNDGGIDVILEKEGKQIGVQVKRYKNKIKVDQIRELTGALFLSDIPKGIFVTTSDFQSGVNKTVQKSHDRGIPIELINSKRFYDILKLTTETKIDKENIRNKLEAVLNNQLYSYNWENPMNSI

SEQ ID NO: 882 - protein, 135 aa, Chryseobacterium sp.
MQDKKIHQGRNIKRFREMLGIKQEALAFDLGEDWNQKKISLLEQKETVEDPLLQKISEVLKIPVEAFQNFDEEEAVNVIANTFGDHSIGYQKNDNPIFNPIEQVLKLHEEKIALYERMLKEKDEMMARLEQLIQK

SEQ ID NO: 883 - protein, 221 aa, Chryseobacterium sp.
MRIFLLFLFFPFLSFAQDKFEYKKDFEKILKETKNIKSELYYDNLLDRYNKIDTTLTDKQVLALLIGFTDNKFYKPYKDLEFGKRLYQLNTDKEYEKVIQLGDEFLKTHPFDLKTLFETSYAYFKTDRKETADQYLLKTRIIFHAMAYSGQGFSPDDPTFALNPSDGQDYLRKGFNMKIGKMGSGKDKNGYFLDILDINFDNGNTTSMYFIIPHATKKMFE

SEQ ID NO: 884 - protein, 219 aa, Chryseobacterium sp.
MNAQELQTLLTERAEKFHLKNEAFHMLHKILSENPEELIGGFARHEITFQFEGYQYLIEQQYREPIIRARISLCVQNEIYLKNLEPIGYYDLEMDFDGEIIDDWFVIEKEKYLKDIGIISYFQGMNKKMPSHYLKGNDGEYEFVSYISLVGTLFISKDFEGAGLFVDRANTYLKDHSLPDKDYLKECRYFLKITSHYLIENNLVSEELKQKLEDYKINK

SEQ ID NO: 885 - protein, 219 aa, Chryseobacterium sp.
MKKAFEFLTQLKENNNREWFAKHKSEYDTIVKENKVLFTQIYNELQEHDQLKGMHIFRIYNDVRFSKNKAPYKTNFGVGYSRSKPMLRGGYYIQLEPSNSFVGGGFWGPEANDLLRIRKEFEISSKEIEKIIADKTFIKYFGELKGDSVKTAPQGFDKNHPAIDLIRKKQFLVMRKFTDKEVLSDNFQKEAVLTLLAMRPFFDYMSEVLTTDLNGEPLF

SEQ ID NO: 886 - protein, 197 aa, Chryseobacterium sp.
MLSVSKTCSDKAMKKMSSHIFIAFTLFACTDNSQKTQSMDFRSFTLQVPKDWSKLKSDAYDSNAGIIVTKNNDSIFYDYGPYSNSLEQLSTPVISRKDLNELLKVNPDADTTLFIILNENENQEDFIKSKITYKKIDGYKAKILEPKQVGKGITGVYIDSLKTESIGKIRFNLYGTNLKKENQVELLKAIQTLNFAK

SEQ ID NO: 887 - protein, 322 aa, Chryseobacterium sp.
MKTKILLLLLFIVNAVKAQITEKITIPNGVVYHYADDTINEKVKKLLTESLTNTANDDLLGKNLIIGPTLWKRFKNIETLKRIPDSLIFHIDDVEIEGKMAKKLDDSKKIWNEFKKEVSGNYQIRKANEDELKYYWSTISFDIQEPLFIIQTENHYYIVNFLKEELKLFWLDEFPYKNSYSNPIDNGTYRTEGTFKTYKNGNEIYVTDKGNKETKLEKVILLSGDSELKANSSFEDIKSVIEKTNRIFESLFKDSKNEGKIMVQFELGKKKNDIQFAVKDDLDLEIMKEFEKQVNKETYPNSKKDTVKFQLLYKVNSYNDIE

SEQ ID NO: 888 - protein, 167 aa, Chryseobacterium sp.
MPTIIKIKNKTNWLLTIILGLGLFLLSFTILILIPLISIQEEGFFFFLNYISFIIPFIAFFILFLYIWLWNTFGKTILTIDSEKVTVRYKNKLFTKPKTYLKKETDQILVKDFQVEKYKFGVRYHFSLSGSTYSVVLIQKDIETRMVDWITESKASEIVNEIKNMWY

SEQ ID NO: 889 - protein, 144 aa, Chryseobacterium sp.
MKKNDQSKHRICISKIKRTTIKPYDDFQWTKFYEDNYSFYDAYPGISIQLNEEELLICSTIIDLDNYSILTTQKLITSENGVLESGLIMHAENGLYGNFKGYGNEKLTFGKIILEHGKTIKYFIETRKASMVMIQGIKTLIQIK

SEQ ID NO: 890 - protein, 127 aa, Chryseobacterium sp.
MPHFIIECSQDILRQRTPDELMDAVYETADATGLFAPNDIKVRLQPYQYYRLGTDKKDFLHVFGYIMQGRTTDQKAGLSKQISTRLSELLPDISFLSVNIRDFEAATYSNKALINPENTDNDRHFGL

SEQ ID NO: 891 - protein, 164 aa, Chryseobacterium sp.
MEKHAISSDGQKIHYKESGNGNTTLIFIHGWLGNTGWWEGQKEYLKNQYHIVLMDLAGHGKSDSSRKEWTSARYADDIKAVADAVHAREIILVGHSMSGAYVLEASLKIPAVKAIILIDTLKNLDESFTEQQAEEVLSQYRKDFKYAVENFCHNFYLQKELHQM

SEQ ID NO: 892 - protein, 1421 aa, Chryseobacterium sp.; identical to SEQ ID NO: 4

SEQ ID NO: 893 - protein, 1273 aa, Chryseobacterium sp.; identical to SEQ ID NO: 3

SEQ ID NO: 894 - protein, 158 aa, Chryseobacterium sp.
MDRNYFLSYSHKIVLLLLLVAVGKLNVKLISVTDGKDVLLYCADIYTQRCITDVSVHHGVDGSVLHKSADHNSVNSLCSGSQHHLSLSNHLFTEILLVKNIKTIANHNDLIFLHLFGRRNIFFNFKELGNFHINSARLIDGFKFVIKIPDKLIHTINH

SEQ ID NO: 895 - protein, 1006 aa, Chryseobacterium sp.
MKRVFTALMFTFIGGAVFGQWTPTSFKKGNDNKRSTGFRVDQSNVKPDGYYKLDLDLLRSQLKNAKEMGPNAAPVIISLPNLDGKIERFQVYSFPVMVKELADKYDLGSYVGTSVDDPTKYLRFSVAPNDFQSMIIHGDKYEFIEPANADKSVYAVHPKTMKNGEGFVCSTEESPQAKKQIQALLQKGKSFTNQPTNFAKNSDKKYRTMRLAMSVTGEYTQYFMTLAGVPSTATDDQKRAPALVAINNTLTRVNGVFEKDFALHLNLQNFPNVIYIDPATDPYSAANVGAGGAWNGELQAALTANVGDANYDIGHLFGKSGGGGNAGCIGCVCINPTTQVPEGKGSGFTSPANGIPSGDSFDIDYVAHEMGHQLGANHTFSHNVEGSGVNMEPGSGSTIMGYAGITGANTDVQANSDPYFHVASIDQIQENLIDKTCDVETAITNNPPVIGDLPTYNIPKGTAFVLTASATDAENDPLTYAWEEVDDAIAPINKFNLGLTKTGASFRSKYTGTNPTRYFPSFTSVMNGVLNNANNTWESVSMLPRTTNFAVTVRDNNANVLQQQTKHSVQTIVVGDNGPFRLANQYADVNTPTPIQWIVANTNAAPYNVANVKIDYTTDNGTNWTVLSASTPNDGSENFTFPSSLNGQTIKVRISSIGNVFYAVGPVSIAPLSACSSAAPTNVVVSNITFSTASVSWMSYTGATYKVRYKKTSGSVWTEINTTVPSVNLDNLVDATAYEVQVAVVCNNTVGTYSASVNFSTPALAYCSAAGNTGSPIYISNVTLANINNTTAAASGYTNFTNNTALQVNLTKGNTYPITVKVANSSTYVSAIVAYIDFNKDGFFDDTEAVMDLPCGTFANNTATGSFTIPNDAIEGSALRMRVVGFYVGANNAGFYLPSSYLCGINFQYGEVEDYNVVITGNLATAETAVKNNGIQIYPNPVSDVLNITKVSDKATYKIYSAAGQLVDKGNINNGKVNVSALVKGGYVITIDDKGIEQFKSKFIKK

SEQ ID NO: 896 - protein, 322 aa, Chryseobacterium sp.
MKKKLLFIAPGYYGFNEVVFEGLKKYSGFDVTHINSTLPYQYKNIFEKIYNFLLKTFLGKNLKNIKRDEHIQKTISSLDYDVLLVNRPDVLSLNDLDLAIKKSKHSIVLFWDSIQKIPTQKEYINKFNVCCSFDSDDCKEYNLHYITNFYFIENNDSATTYDISYLATYDKRIQETISLFEYFNKNSISAKGRIFTYKPTSITEKIPKEIEIIHDIIPFSESYRYYLDSKIILDLAHPHQKGLSFRPYEAIGLHKKLITTNKEIAHYDFYNPANIFIIEDIQNINIPESFISNAYEEPSELIKEKYYIKNWVKTILSINNEN

SEQ ID NO: 897 - protein, 349 aa, Chryseobacterium sp.
MKTKIYFVCPNNTFASGGVKQIYRQVEILNKNGFDAYILHKKIGKKDSWFNIDVPIVYSPYLFKKLKYSYKNKKLNFFKKTALFFLQQRSKKIEKEAILVFPEIYGPKIHHIEPDVAKVIFNQNCYYTFNYFSIYENYKITPYNHPNTLATIVASEDALTYMRLAFPQSDILKMRLGVNHHVFNYSENKEKQICFMPRKLSDDVTQVISILKQRGSLNGWNLVPIDNKTEQEVADIMKKSTFFLCFNHKEGFGLPPVEAMACGCYVIGYRGQGGKEYFKREISSQVEDGNIIEFVTKIEDAIKVYEENPDEILQKGKNASSFILGNYNLQNEEQDTIALWKKIMLSAKK

SEQ ID NO: 898 - protein, 436 aa, Chryseobacterium sp.
MTEGNFGVNISGFFKAEIGFGEAVRGNIKALEAASIPHVPINFNLDLKNRLNDSSVEKQLSEDPIYNINIIHLNPDTIPSFYEEKGADFFKKRYNIGFWAWELSEFPDSYNDYFSLFDEIWVPSSFCQKIVAAKSPIPVINIPHIIDIKDKDIDKEKEFSFSKDKFTFLFMFDYNSHLERKNTIAVIDAFEKAFPNDENVQLVIKTSIPTYFPQDKETILKRIQNRENIIIVEEMLRRENLLALINQCDCYISLHRSEGFGLTIAEAMALGKPVIATGYSGNLEFMNVNNSYAVKYKMVELTKSVGQLQQGSSWAEPDVIHAAQLMNFVFSNNEEAQKIGAKAREDMYLFNAKAIGAKMKKRLDYIQHNILSLEKNNTENEIMLMKLKHQTLEEQNRVLQDKVNGLRKLTFVKLKVKIKNMKNKLTGKNRKYFWED

SEQ ID NO: 899 - protein, 217 aa, Chryseobacterium sp.
MHILSRLFSSFITVSYAITVNNEVKELKKLLDILLPLIDKNDEVIVLQDITNETVEVTKLLEKYSNITKVQARLDGDFAGFKNNLFKYAKCQYLFQIDADEYPTKDLIKSLKPYLRKERRGDCFFVPRINTVEGITADYIKKMNWTINDKGYINFPDYQPRIIKNNKKIFWKNRVHETFHGFKRIKEMPKNYNLCLIHEKDFERQKRQNEFYETLAD

SEQ ID NO: 900 - protein, 265 aa, Chryseobacterium sp.
MKKAICLFIVGEKYLKLFNKCKAQFENYAKKCDAELLIIDKPLDETFVRPLLSQKLLIPSKTEEYDMVLFLDLDIVISENAPSIFDFLPEDKYFGAVLDPRGTEEFNKTWGHIPRILEETTEIYFTDRHFDASPLLQGSINGGVFVFRPKKVSEIFSSYYFSDHNQGALNSFEETPFAYYSQINNWFEALPAKFNTQVLYKIKGTSIGHQIENDEKKVPKFLRKYYYKKNDAFFYPTRKYKNFVRNIIKDNYFTHFSGNYPIIYI

SEQ ID NO: 901 - protein, 476 aa, Chryseobacterium sp.
MKKQILFSLGTSLMLFMGSCSYEDLNTGTSAPDNPAKTNRLSAAKFAGDGVYDVLGHGFNATGEYANANSAGFKVIDIDRFKTEQAARLISENANTQQYIEEYGENAETYSKMVSTKVDATAGIPLFKKTLSVGFNSAVTTNHKFDAKYIYGSYNLLIKQKRLRFNATTDMLADYVTPEFTQDLQTKSPQQIVQDYGTHVMVDIYTGAKMDIMFQSETSNESRERAARIGVKIGMLKAFDVDVQNDVNTSESSMNYSKKLSYRTRGGDPSKGLVGELNLDQSTPKINIANWQNSSTANNSVLVEFGNNGLVLIYNLVKDPAKKAQLKAYVDQYLLDNQISLEYNTTMLYGYQNQADSNHYFTFNTNLQPSSYWTNEGPTFKVFQYKAPNTVPIYCFKSTSGAHHYYTQSSTLQPSSYWDVYMGIAFYAYKDPAADRIPVYNYKAKNQSDHYLTVNPNLGPTSYWVREGIAFYIPAN

SEQ ID NO: 902 - protein, 1132 aa, Chryseobacterium sp.
MKKILSFLFIFYIFTSAFAQLDREHWFAPMIDRTGAPNPYQKLYLSTSRTTPFPVNIYNNNVLIGTVNISKNNPQKFDVLRNYIITTQQTDLFTPTTKGLYLKADFPFYANLRFSVFNHAEIITSKGIPSTGKTFYAASAPISVSNNILNFMTSVLATEDNTTVTISGYSPTVQFSNGMTGATNPTITFTLNKGQSYIIDGIGNIAGNSDGFIGSKIISNKPINVTNGNFNGQYAGNFPSSSDILMDQAVPVNRLGNEFALVKGNGPIGANMEGAVVIATEDNTQIFVNNEIPPVATINAGKYFVIPDSKYILQGNGHYNLYVKTSKNAYVYQILAGDSNSGNETATGGFNFIPALNCYLPKQINELGLINENFVHSNGNPGGILNIPTKLNLITERGANITVNGTNPPAITGPYNMTGTNNWVTYGIPNITGTITVVSDKAIMAGITAGSDAVGYGGFFAGFPTQPVILQSGGGCIPGVVLTVDPLIYDTYQWYRNGTLVPGATASTITPTLPGYYTCSVTMGSCAPLVTEKFKVLNCTKLTNTSYNVCTSQTIPPAFSSSSQTPVPATVAITAAPTLGTAVINSTTGVITYTVNTPGTAGTDTFIYTFCGNDPDFPDCETITVTINIQALTVMNATLSACDINGQGTFNLTTANITNNSSVTITYYPTLVDAQNENAAAMITNATSYTAPNTTIIYAVVKNNIGCKSIAQITLSLFNKAIILDNYNGIFCDDNLDGTVTVILSNITPIVLNNPNYFTNVRYYASLADANAGNNNTLPNNWSYTATTTIYIRVDSPDGCASVIKPLQFSIGAKLTLITDTVTESICDDDLDGVKSVNLAQFIPQFTLDPNVSFTFHATLSDARNNVNIISSPVNIANSQTYYIRFEKNDVCPEVGTLKINIKVPKKSDVLKDKAICPKTTTTLDAGPGFEKYLWSTGATTPSITNVAPGSYWVQLTSNGCVYKQYVNVTEFPLPMITSIEIDGTTIKVGVSGGTPPYEYSLDGVIWQSSNIFYNVPRGGHNVFVRDSRMCEEVKKPFAIINLINTITPNGDGYNEGIDYSALMANDNLVFRIFDRYGAEVFRGTPENRYTWDGRVGGRYVPTATYWYFITWTEYGSTLMVKYTSWLLVKHR

SEQ ID NO: 903 - protein, 415 aa, Chryseobacterium sp.
MKKIVLLAALVSNMALLFAQSKEISAELNKLELSNAPSVMLLGLASSDLETPKSKKAFMSSIVNSFSENDGLPNAYAVELTPTHLFTLTEMDALKYAGIKSIKKPDNSYEYKNNIFSEAKNVSVSFAFLRNYKIEDLDTENPSVSFSLRTTILKVRNKKNIEAITTSNDNISKQLKDIQAVFEKSKEYNDIEASNASPDEKNEMKAKALEKFVPDYYKTETENYKKYLDEKPAFQLDIASAYSTFFLDNQFKNNQFGKLGFWITMSSGINLERTKSPKKKEDQNDEKSRVIIKEAFTTDASKIEKRLNFYAVARYLQDRTIYDAASGFSRTDNYDFGGKIELVYNRFSIGYEFIYRSSDLDDTYRSNGIINYKVSDSVYINAAFGKNYGDKNNLITFLGLNWGLDSKRKTLFSEK

SEQ ID NO: 904 - protein, 221 aa, Chryseobacterium sp.
MKKLFLFFAALTVLTSCLPKVALTPTYWDKSSKVGILVNATPPAKYKEGSQGLLDMAVTSGDKYQEALNLIGEKIHPKEELIAMYSEILKSKGKEVVIIDEKFDSKTAKKFNGTKAEGKKYSRYDFSDLKAKYNIDELLFADVNHGFMISYYGMIETGKMAHTFLNTSLIDLSDQSLVMSSLNMKNVTLKKWKDNNYESSIQGVRSTLDQAKAEERDINLK

SEQ ID NO: 905 - protein, 622 aa, Chryseobacterium sp.
MKKTILCGALLLSLSLSAQQKKEWCDFDNEQRVHQKQNGEIDEMIRNIRNKIISSNQNTASKNGSAYKIVNGVYEIPVVVHVIVPTGSALGTAYNKTDAQIQAWLDRCNQMYAGTYQWAQGIPADFGTAATMPIKLVLAKRDPNCNATTGIIRYNGGTLTGYDTYGVKRSGTNGVTTDEVKTIAPHWPEASYFNIYIMNKVDGGGQYGIMGWAGLPQNADANYESFMKSFVVTLQDDITLAHEFGHSMGLLHTFGNANAQPPQGTTSTTYCPATTNNCATADDQVCDTERSRSLLNDFPAPTNNDMNYCTGANYQGVQYNMMNYTNPIAFKFTNGQHDRAALYFFLMKGSLSTSLGATAPSAAASIGTPIAATCNPSGITTPDDYFVGPTLVKLGNINNASTGYWTNNANFYEDYTGASCLRATSTELAATGTHNLQVNVSGSNNDIRVWIDYNNNGTFEASEMVASANDIIADPTTEIGTYSTNITAPASVVLNTPLRMRVLVDDENPNMTPCGQLMYGQVEDYTVKFVTNLGTSEVKADNGDLTIYPNPVATGDKIFIKAKNGKNLKVSISDMSGRLISAPSVTEEGNGVFKVDQQLEKGVYMIQVSNGKDSKSSKLIIK

SEQ ID NO: 906 - protein, 232 aa, Chryseobacterium sp.
MKKELLILFLLNFSFYCTGQEIKIPENFTEHFIPKVESKEWFVLVNAKDCYAVKKDNGRLIVEKTSYYKENSELEIEDGKLIGENKGEFGGALYFQPKEDKDKVVKIKFGNIVDIFRFQNKIYFTEGSGIWGNLYELNKDSAFTYNKIESFGDALEAVAVFDDSIYIASYHGFHKVADEKATLIFRKQFWDNLYPNSVVVFDEENIFMGIRSGIVKLNLVKNTVNFYREKEL

SEQ ID NO: 907 - protein, 195 aa, Chryseobacterium sp.
MKKIFFASAVVLSLISCSEKKSQNDIVEKAAENTESSIPVKRLSKAQDIFNGIYDEKIKNDKEIKKIDEKISLMQEDAHKMQGIYSSIISNSEDYYLIAKNEAKSINDSVLRKEMIKLIEESQNDYYQKVQIIKDLKHKINRNKQSIYSLYAAFKIRKTLPEIEKYQKAHPLKTDSLNQFINKQNKLLEELKKLK

SEQ ID NO: 908 - protein, 340 aa, Chryseobacterium sp.
MDNFKEEYLKALREIEKEELEKYKPQIQYFKKIMKDKGIKLTDDNFNFYQTSGIIVSFPNIVNLLVEDLVIDKDGLINFDELNKTFVKKTFFNGYLFHENFVLMANSYFRREFHEINNYAPRFIEYFWESNDTNVDHYISIDMDRVRIDVNGSPCLELDTWYGAQFNNKIDLIPDGIVKLRPPMDIEYTYISSFFRNAYSLDIKWTTKDNIKSFQAEEFKTEEIKIIKNNVEYFPVRYIHAEYDMQKGYFRHFDGAIHFYNENQYYARRDSDFNYNNKNQGHIKTLSQKLFKMNGIVSINTWIKFCSHFFAGNPLIFEYFEDKYPNHINEILEKLRLRNE

SEQ ID NO: 909 - protein, 534 aa, Chryseobacterium sp.
MKELSKEILNNKYSKELRFELFNLWKSNSTDKQINSLYQLINCNLTEDSIENLLKDPKFILPEIHIDNIEISARINDIKFILGDKDKLNCIKNAVDSYIRIYERTDELDYLIRSLELIRKVKSIFKQDLIRLEEKILEIIFRLESSYYQLKLLSASINLLIQEVSSEKLKNYFIIKLKESLKANQYGNALNYIQGLNKLGHFNHNELKIETALCLEEEADYYKSQKDENTYNPNILSTYLDALKQIKGIVVDKSFKTRLEKKIKKEQKIEAEIISIIGTTGKSKLNIPQLIKEQNIDDFYSGFNFLLWCPIFSPTFIKKQENNNFYQRYFPTSVHITNKGTVSGISNTEEFNLNQEREYYRNITISLIQEIKFIMDLDGQVSKDWVAEMINKCKSSFISKDREYLFIEGIYSGFQNNFILASHLLIPQIENSLKSIIESNNRNTILLSEDIQNDNTLGGILSTKENGKMLDGICEKNLLLELNSFLIDGNSVNFRNKISHGLISPLEINYYGIYLWWLSLKMIVQAEEYFKIDK

SEQ ID NO: 910 - protein, 356 aa, Chryseobacterium sp.
MKFIARKEPDYFKDFNFSKDNYYKYFERIRPDLIKEFNNKCGYCEGDLNITSLPQIDNFYPKNKYPQEAFKWNNLILCCQVCNIVKRDKFPLDENNMPLLINPSIEEPQEHLTLDINSGLLEGKTEKGKITISTFALNRPELVELRRKSGNLQQIQSSFPNLNIELDRNSIFIAFKDNINKILEVTNKLNEDSSGDNLVAYLLYANVITSLETYLADIFINTIFQNTLYLKKFVETYPKFKGKDNSQKFELSEIFVKYNKIEEIVTDEILGIIYHNLSTVNQMFKDTFTIKFPSDKATIYKAIEIRHDIVHRNGKTKIDKETKVSTEHNIGKKEIQELITATTKFVSEINEQMIEL

SEQ ID NO: 911 - protein, 157 aa, Chryseobacterium sp.
MLFIARHCLELGLKANIGYFSKYSEKDDYTNAGTHDLEKLFNAFKMHVEKTIENLKSKHNIDIEDEDKKSFKQLCDEVEKLNNTLHILDKNSDAFRYPIDKKQNPSFKNNDRINLIDVAELLEKSMTLFLYTADVFAKYTDYVDGIESFYEDIMREQ

SEQ ID NO: 912 - protein, 112 aa, Chryseobacterium sp.
MLGIKQEALAFELGDDWNQKKISLLEQKETVESDILAQVAKILKVPAEAIENFDEEQAVNIISNTFNDQSNGYNYYPNFTFNPLDKMVELYERMLQQQQEMIEKLEKLIQQK

SEQ ID NO: 913 - protein, 260 aa, Chryseobacterium sp.
MKFLLDFLFRVLQLFTEPYFLLFLVIVLIALLKRNSKHKKLRIGMGIFAVLLIIFVGNGFLGKLISGYLQKSYLNTSEIRNSGSQHPVIVVLGGGVVDIDHTEKLHTMSYSRMVTAYQLYHAYKTNNQSCKILVSGKGKGRMSEAELFRENFKKMGVADADIIKEDKSMNTYENAKYSSRILKQMAPSSIDLVTSGFHMKRSVALFQTFGLHPVPNASDFITTEITLISNSYNAAFTFVMLKEVLGIWQVKVYNSLGLNG

SEQ ID NO: 914 - protein, 87 aa, Chryseobacterium sp.
MKPKMIWANLAVTNLERTQKFYTELGFKPNNPHSSNELVSFFFGENEFVIHFFLKDIIERNLKTMNFGDPQSANEIIFTLLQKLKNR

SEQ ID NO: 915 - protein, 68 aa, Chryseobacterium sp.
MNKNIIHKINALGGNTDAVNVSENFAENWKNIRFNNHLYYKDWQLYGIDEFHETYKELYGRDKQKWIS

SEQ ID NO: 916 - protein, 72 aa, Chryseobacterium sp.
MAGISRNGYPDHFFVCTTYPDQSNPTVYSTDHEVYFEEIENRGKLEDFLDGFMTKEEFSETVITYLEEKSKE

SEQ ID NO: 917 - protein, 412 aa, Chryseobacterium sp.
MDTKSINFSNQRNRNAVVRFLHLCAISYVYLFIFTSQFSPFGGVYKSSVLWLCKNVFQQKQVEYIEITGSGDTTLDYWVVAVNIVLAVVTALVIILADKKQRTFKDLHWFTVVVARYYVAMIMLSYGFAKLHDGQFPANTIGRLEERVGDMSPMGVVWTMMGASTGYTFVSGLLEVIGGLLLLFRRTKTFGALFSMTVMINVALLNFFYDVPVKIFSSHIVLFCLFIISGDTIALYRFFVLHQPSQLRFQKRTSDKKWKRITLTAFKWLVVAFFISSSSSALFYTPPAVPMEGAYIVDQYIINNQEIPCNDSLGWKKIIISYPGRTNIILNNDSTKAFQSVLDTGKKTLMLRKADEQNIYAYLHYSLQKDSIIFTGNKGSDSVKIKTIRKKKEDYPLNKRGFHWVNEYPFNR

SEQ ID NO: 918 - protein, 260 aa, Chryseobacterium sp.
MYTINYHLRKLNSMIKCLTIIISLFSLTTYGQKMRSIDELINDKDQGWILVKEWIDTAKNKVEILPVDSNKAKDALYKTQVTTKSPMGSIVYMTGGLLVDNGWIRILGSGSDKLNRSLPEWNRGKTFENYGKPIPYLLIADDAIGGIFILNGGGLGSDLGKVYYLAPDNLELEPLDLTYTEFLNFCFNKNLDEFYNGYRWLNWEKDVAKLKGDQVFSFYPYLWTEQGKNINTVSKKEVPIEENYKLIFEFRKKLFDVDNK

SEQ ID NO: 919 - protein, 395 aa, Chryseobacterium sp.
MKLKLRKIAYQLHLWLGLTSGLIIVIMAATGCILSFEEELKHIVYPNRYFVENIGRQKLSLSELTEKAEKALPEGLKIKRVVMPSDPSRTYVFRTLKMDNEAWTYWGTYLYYYRIYVDPYTGKVQEVEDAKKDFFEIVLDLHRRLLLGEKIGKAITGYSTLIFAVILLSGLVIWYPRKMSKAMLKGMFFIKTSANWKRINYDAHNVLGFYAIIPLLLISYSALIWSFEDVDQWVKNTLNGNIPTEKKAKSIIPSEKFLNRTHILNLIGNTMEKGLKEKKSALINFPRSEDGTYYAELTYDGRQYRNEHFNFDQYSGEVLKSQSYKNKNIGYGTALKERNYDLHTGSILGLTTRIIYFLAAFIALSLPITGFIIYLNKKKKKPKHKKNKVVFPTHH

SEQ ID NO: 920 - protein, 82 aa, Chryseobacterium sp.
MLIKRGLYIKMMNNLLKSFKYLTKKKQNVVPVIDFFQNHKIFIGGLKTITFILSALVRNLNSKNSFSAGKFYVHLVYADFTS

SEQ ID NO: 921 - protein, 54 aa, Chryseobacterium sp.
MKTTALILGVLSLFTFTSCRCNLDEDENRKRDQKNNHATTAKTGIPESDTLNIR

SEQ ID NO: 922 - protein, 194 aa, Chryseobacterium sp.
MKKIFLGLALVAGTFAFSQKTSASAASTSPVRFGLKAGLNISTISNNNANSKAGFYGGVFANIPVAQDFSVQPEVLYSGQGAKAKANSNIKLNTDYIAVPVMLQYNLIPNLYVEAGPQFAFLISAKGKGNGATVDVKDDFKTFDFGLGLGAGYYFTQNIGVNVRYTAGLTKIAKEDDGDSSKNGVFQIGLAYKF

SEQ ID NO: 923 - protein, 636 aa, Chryseobacterium sp.
MKKILLPVILISSYISAQAPAGYYDGTAGLTGYALKSKLHDIISEKMINWHYNDLPGLYGQTDLDKYYDHDASNTEYLLDIYSEIPTGPDAYEYKVNQLIGNGSMEGMGYNREHMMPQSTFSTSSSISDYPMYSDLNFIIPADARINQLRNNYPYGIGGNTNFYNFTNGSRMANAAIPNYPYTGRVYEPINEFKGDIARTLLYFAVRYEGKLGSFNTAYSTSSTITPATDQCPLDGTEERAIDLAYIAMLKQWSAADPVSQREIDRNNTIYTIQKNRNPFIDHPEWIDMIWSESPDNIPPAAPGSLASTQQNAHFINLSWTASPDTDVLGYRVYMNGSTTPVAVTKGTSVSIDHLSPSTTYTFTVKAFDKGYLESPFSTTVTASTIASDTYAPDLMITKYISGTNTEFIKNNALEIVNKTGHEVNLNNYRINIQFKNTNTGAIYNGDTYELEGKVGNNETFVILNPKGTLSCYTPDQAKFVTASDPMMFAGENYVELAYNKTVTVDAIGVKYTINNNGNVSLYRKNTINQPTSTFTIGEWDSYPSNYCQNLGTLSTSELIADHNEFTIYPNPVDDHLYVTGETDKIKTAQIIDLSGKVIYTEKDPFRHKKDIAVQDIPTGIYFLKLDEKAHQFIKK

SEQ ID NO: 924 - protein, 75 aa, Chryseobacterium sp.
MKEVLLKQREVRTIILNGEEYFYVEDIKSNCPELKIETLKIKYHEKIPLIMAEYIHVKTDFDNMITKVWNHKPKS

SEQ ID NO: 925 - protein, 308 aa, Chryseobacterium sp.
MFINTNIKSVLELIQAFPTEQACIDYLEEIIWTGIVVSPFDATSKVYKCKNNRYRCKNTRKYFNIKTGTMFENSKVSLRKWFLAIWLVTAHKKGISSMQLAKDIGVTQKTAWFVLQRIRACFGIENCNELDGIVEADETFIGGKNKNRHKDKKVPHSQGRSFKDKVPVMGMLQRDGKLNAFVVTDTKRKSIQPLIHKYVKTGTRLISDEWWAYRGLHRHYDHRIIDHSKKEYVSLQDNTVHTNNIEGSWNILKRSVSGMYNHVSKKHLQKYVDEFVYRYNLREITDYKKFEHLLNNNNVRTRYKDLTG

SEQ ID NO: 926 - protein, 151 aa, Chryseobacterium sp.
MLLFGAFCFSQTITEKYNSTYGRYDYIDSYGNLIAFKKFNSLSKQWEYYRVDQAQQRKPYQYRDPEKLDISSLGNAATTLQNRYNNNQKNAQAVIDDIVGQIKSLDVSETKKEKILNDFTQTVNSNMQTIYNGNVNWLYDAVNTIIKNVTD

SEQ ID NO: 927 - protein, 60 aa, Chryseobacterium sp.
MDPTAYHNHKANFNRLTGKNADEELAAFFSYLNMLNLFDIKDLLKDLRIMIKNVETNTKN

SEQ ID NO: 928 - protein, 47 aa, Chryseobacterium sp.
MKNFTEAQLRLLCLILAKGNIQNANENYDWITTGELPLKDRVLSSNS

SEQ ID NO: 929 - protein, 349 aa, Chryseobacterium sp.
MCSKIITPGKKKLVKKGVKLANQGVMGFELKNSERIFTAGFDENDFNSYGFKENVFKTDIPFGQITTKQWLFDGIRMLYSETELEKSTELDWKGDMELVTMHFNLQGKTSIQQHGMNSSFELNGNQHNLFYGTGAEGKMKWDEPQMKSFMIQFSKEAFLAISKDGNESLKQFADKIVSGIPVAFSASNLNIGLPLRTCIDSILNCEFSSGSKRLFLFSKTIELLVLQAESFNTAENQKSKYIKHDYDKDRIVFARDYLVKNIGSPPTLPELAKIAGINEYKLKRGFKEIFNQTAFSYLSDLRLEKAKNDLMDGKKQATEIALELGYCSLQHFSSAFKKKFGIPPNQARY

SEQ ID NO: 930 - protein, 384 aa, Chryseobacterium sp.
MTLVMYQVSALLQDAHSNPGISQSFMKEDFSKPIFFPLLLVSDHEKIYSSANTGQIPAGSLIISINGKDIESLFQNMKKNIGGTSQFRDIISLKLFSHFLYLENVTAPFSVRYKLPEGDIKEITINEGMKFRDFLALSMPGIAKPYDFKIINHKLAYLDFRSMSGNMDDFDKFLSETFATIRKENIKDLAIDLRNNSGGNSILGDLLLSYITDQKYSLQGSKRWKISQIYKDKLIADHNTESEYLKMENGTVWETGNCKPDFNKFKNDPVFKGKVYVLTGPFTFSSANLVADGMKQYKLAELVGEPTGEYTNDFGEAFMFTLPNSKIQMRSTSSMSFGADCNTSSYTPVVPNILIVPTLQDKINGIDKPLEYILKTVKTNKGTN

SEQ ID NO: 931 - protein, 123 aa, Chryseobacterium sp.
MKVIVYQISQIDKQFLALANHKRHKITIINVPLDEITVYFARSKDVVIITGDGGSVSCSILKKFVSLGVRYIITWLKDPFTGNLPEIKHDRLQWTHIRNTNPSDAYEVISVINTWQKDDDDHN

SEQ ID NO: 932 - protein, 220 aa, Chryseobacterium sp.
MKTNEQLQKDVQEAIKWEPLLHPAEIGVTAADGVVSLSGTVDSFAKKKQAENAARNVAGVKVLVENIQVKLPDSKAKTDIEIGAEIISALTSNVIIPQDKIKVKVENGWVDLDGELPWDYQREITENAIQFLPGIKGIFNNITINPDTNDTVSKKKVEEALKRSAVDEREITVSVNDTTVTLTGTVHSWQQKEEAGRIAWKTPGIKHLKNKLEVDYEYNL

SEQ ID NO: 933 - protein, 181 aa, Chryseobacterium sp.
MKKQIVITALTIGAIIFGTNNVQAQNTTATTTVNITLNDVISIDAGSTAIGNTVDFNYVTAADYNSDQTVTKANSLKVTSTKNFNVKVKAGGANFMNGTNLIPVNVLTIKPSTAAGSMGGTKTAVVLSATDQTLVSNAPLGSALTLNLDYTIPAAKSSSSDILGKPAGTYTQTVTYTATAL

SEQ ID NO: 934 - protein, 49 aa, Chryseobacterium sp.
MLKTNCSDFCEKNNVHLCIMFNIFADIFCIDMWKGLYVLTENSNNNGAA

SEQ ID NO: 935 - protein, 66 aa, Chryseobacterium sp.
MKKAALYMLLLLMLSACTKSETQYTDQNNRKETVNDKASDTIQTLTELSDTLQQENDSIKVRTGNE

SEQ ID NO: 936 - protein, 281 aa, Chryseobacterium sp.
MNKDHYPVNPKGRLIIIGDSTPYTCLEVEQAPDINQIPSQLFKLLSEHKNIRIEIIISDSMPGYTEKYSAVLQKYGYINLGIIHVHQESNFNDYYARISQSGIVFIANENPEICEMLKKSEILKLLHKKYIHEEDFTIIGMNAASMYIPKILVNEKGIHQGFGFINNCIIDTKFECGTRFKKLIRAIMLHPECLGIGLNNGMLMVIEKGYKASCYGSSTVMAVDARHIKKSKAGKGTTVFIKNLRGHILTEGSGINVCTGDLIKDNQFHNSLNFTRRNTIQ

SEQ ID NO: 937 - protein, 162 aa, Chryseobacterium sp.
MKLEIQPIGNSYSEQAIDLILTIQQKEFNIPITIEDQPDLLQIESFYVEAGGNFWGAFVNGELVGSIALVKFDERAGAIRKMFVKKEFRGKELNIAQELLEVLISFCRKNRIDDLYLGTITVLKAARRFYERNQFVKIEKSNLPAKFPLMSADDVFYHLNLD

SEQ ID NO: 938 - protein, 94 aa, Chryseobacterium sp.
MENIEAKLDIIEKWFSVPSKKLINVYNIVKEKGIMSSEDYQQITDIGIPIINKLSNATGLSIEKVRTTIIQKGISFNYFHEAIISYSEFCTKEK

SEQ ID NO: 939 - protein, 341 aa, Chryseobacterium sp.
MIEFDQYPYKYENLLIEILEYFSAHHDIGRTVENNERRTIVKFCQYYHSKYNPDEMPPFSSIAGICEILVKNKYLSVVVKDTPHNFDDTYIYLPADGEGKLFRNETLKNIVNERLNCLVYGFKYINQSYKDIVRPICHYLDKDPGIGTCFLFHDGIATAKHCVEHAKKLSIKDIPKEVLEASEFLVHENEKIDLMFIKFPQGFDQDFTLIETEEGQVLDEVLALGFPKVIGFHTFMTAEKATISSRFTPSVGTIASLSEDLWIRQDLMLITAKIKGGNSGGPIINNKGNVVGIATNLPGLKDDYDDLGYGIAIPIKHLHEIIEGKSKILNTSNIEFVDFIE

SEQ ID NO: 940 - protein, 117 aa, Chryseobacterium sp.
MHNFRDLEVWSKSMKLCKIFYLASNGFPKDEMFGLTSQSRRSLYSIPSNIAEGAGRDTDAQFSHFLNIALGSSFEFETQILIANDLGFFKNDDFNIINSEIKHIQNMLAKLKQKFNT

SEQ ID NO: 941 - protein, 129 aa, Chryseobacterium sp.
MNNTEKIIREIIEFHQNIEKWFQGKTENQQALYRTLLSGFSPEFRMINGNGDTVTLSTLSDWLPTVFGKFPQRTIQVENIEVNHSEHHGLATYTETQVTGETVTRRASSAVFLLNEEKALWLHLIERWI

SEQ ID NO: 942 - protein, 124 aa, Chryseobacterium sp.
MKPTVKSIRPFIGAQDFEISRNFYRDLGFEEIVLEPKLSLFIRDETGFYLQDYYAKDWVDNTMIFMEVANTDDFWRELLSLRLTDQYKNVKLTPVRTMDWGKECFVHDPSGILWHFGEFFKKEI

SEQ ID NO: 943 - protein, 509 aa, Chryseobacterium sp.
MKKYLLFSLLAFSSMNAATLYVNSSATGSNNGLSWANAYTDLQTAMSNAIYGDEIWVAAGVYKATSTTDRTISFNMKNGVSLYGGFSGTETSIGQRNISQNPTTLSGDIGAIGDSSDNTNTILKIINTTSGLTVDGFRFISGRAGGAGGISLNNNTGIINIKNCYFYDNQGSAAGAIFQAYQGNYTVNVINCDFISNISVYGAVFSDDSNNNNLTISNCKFKGSVAGGNAVLRFLGANFVMDRCVVTNNTSNQSSLFYIDANNSAKISNTILAGNSYHECALALYSSNGIPQILENVTVVHNKKVFLTNTFETAVYSANGKFNLYNSIVYGNTNSSNNDQVDAGNIVSHSIVENGYTGGTNVLNVNPGFTNSNILSAAPFDCTSYNYQLDISSAAINAGNNSFVTQTQDLLGNNRIFGTAVDLGAYEATTNLGTNENAYKKITLFYDFKSENLIIKNRNSNNIVTIYDSMGRIVLKANISDSLSLSEFTPGVYFVTLQNTSEKIKVLKK

SEQ ID NO: 944 - protein, 83 aa, Chryseobacterium sp.
MSQMFSRITPINSLIGMGGIPTALAEIYNYIDYLIPQISQIGMDDCVYFLKKRILIFVKFVRKHLCYLWFNGLNTNATNIFHE

SEQ ID NO: 945 - protein, 53 aa, Chryseobacterium sp.
MKKCLFVSYKYRKNTDFGKELLLLSLSGTYKKQNKYVGSELQWDKKGNRVGGM

SEQ ID NO: 946 - protein, 663 aa, Chryseobacterium sp.
MTFFIILVILFFIIAISKNQKKTPENKVTFKNTSSSPIKVQPQKTYNEKRNEIIPSQPKNQINSVESKMKDDSIIDVSNLMSTLISNIKITSEYSSSSSSYSSVPYWPHQYVYSYDEINYATQEQRNFYDKFRAEFLKGNILSLNGNTNYAFILLFDLLNDFEVHKDYIKIEYQLEMLGNTFPRTKSYGVSFLLEKLEEFNMDDEAEYFREKNQQYDYDYWKLGKKYKKKLNLSTEQEEILNRIWLQTNVFNNVEFCRTEILKQFLRAVEFLQSNYVSSDNSFVNLMDELSDLIVRKYYRYRKGSQNYKYTFDSVKGEIYGHILKLSENNVREVYSNKRKLTAEFNYSSPEIFTSYYEKVISKLDVFLIDDQKNIVSPDIETEKLLNESNTTRWKSKFETITQTYTDIADFENQIIRLADENIKNPSVENIFYEASKFMAKQDKPSSLKLYVYYIDSDLKSSKFDNKQMNKTIQKSLFKTDEQLKDFEEILNNFIKDRQLENALNRIASVYEPKRKKIIIDRNSIQEVQKQHSGTVNLLNEYLQDELEDEIKTSDSIEENETGEVQIQIASDNNTESAISRFNLDLRLSELQKEVLEIFEKNSFSIPQNELEEVLKSKNQMMSSVIDSINESCYETLDDVLIEEEDDYLTIFPDYYKKLLNND

SEQ ID NO: 947 - protein, 79 aa, Chryseobacterium sp.
MFTAFFVLVQVPVLKFQPFSKSGSIFRDEVMYISKIRSKDTYHKCPKNLHSSGYIDYQPSYNPFRHRLSHVPPFKFPKN

SEQ ID NO: 948 - protein, 69 aa, Chryseobacterium sp.
MKKFLFSGLLMISSLSFAAVWTVTTTCGVVGKIEIADNATTSQVAQAVSQYNYNQCGVRPAKINLSLEP

SEQ ID NO: 949 - protein, 254 aa, Chryseobacterium sp.
MNLQKILFFFFICMINFLSSQDLKSNYVCTYKLDYIINGKKENEQFIMHIDAKNKRSFFQSSINYAKDTIDIKNPMQLANYESDFNEKVLFDNNSFKVFETVIDAKLSYSENQKLSWIILDKIKKEESVTIQLAKTNAYGRTWYAWFSKDIPIDFGPYKFNGLPGFIVSLYDEKKNFIYTLQKFKKKNKTIKLPNPKNYKNIPKKAYNQSRFKIQTADSGVIIFNNAKERENWMKKLEERYIVSPLLDIEFPIK

SEQ ID NO: 950 - protein, 644 aa, Chryseobacterium sp.
MSQKQYTASSIQALEGMEHVRMRPSMYIGDVGVRGLHHLVYEVVDNSIDEALAGYCDTIFVSIKEGNGIEVSDNGRGIPVDFHEKEQKSALEVVMTKIGAGGKFDKDSYKVSGGLHGVGVSCVNALSNEMITTVYRDGNVYQQIYSRGKAQTGVEEIGHSEKRGTKQFFQPDDTIFTELVYNYDTLASRLRELSYLNKGITITLTDEREKLEDGSFRSEVFHSEGGLKEFVAYIDGNRESIMEHVIFMEGERDDIPVEVAMRYNTSFNENLHSYVNNINTHEGGTHLAGFRRALTRTLKKYADDLGIPQKEKVEVTGDDFREGLTAVVSVKVMEPQFEGQTKTKLGNSEVSGAVDKIVGEMLTNFLEENPNEAKQIVQKVVLAAKARQAAKKAREMVQRKSPMGGSGLPGKLSDCSSKDPAESEIFLVEGDSAGGTAKQGRDRHFQAILPLRGKILNVEKSMLHKVYDNEEIRNIYTALGVSVGTEEDSKALNLSKLRYHKIVIMTDADIDGSHISTLILTFFFRYMKELIENGYIYIAQPPLYLLKKGNKKVYAYNEKEREEFTLEMSPDGKGVEVQRYKGLGEMNPEQLWETTLNPEHRILKQVTIDNAVEADSIFSMLMGDEVPPRREFIEKNAKYAKIDA

SEQ ID NO: 951 - protein, 155 aa, Chryseobacterium sp.
MRKQLLSLSSLLIGFLGYSQTDVYFKYDEAGNQRYRGLDANAKQAGENFSKAESKTTSLFSSQSIDEKAFWKQIRLYPVPVKDILTIDWTEEVEGIIQTVSLYQHSTVHWKFQQENIPSLNQQLKINMSGYEWGVYVLRFTLKDGRVFSKNITKR

SEQ ID NO: 952 - protein, 2200 aa, Chryseobacterium sp.
MKAYHKRMKVFSSIISCIFILGFVPLLSGQNFHDTKGNIEVNGAGQLQFSLPVALPPGVKSVAPQVNLVYTSGSNNGIAGYGWNLSGLTAISRTGKTVEKDGESKGAQLDYSDYYSFNGQRLVLKSGEYGKDGAEYVTEKYSNVKIKSVGTAQTATPQPMYFHVTFEDGSQAWYGDIQADDPELNSLNGRTSIEYNIVKWKDPQGNYIIYSYDYTTGQMQGRVSRISSIEWGGNETLNKPHFNKINFNYTDRSLIEDTYVGGYRFVQNQLLSEIQVNTNGNLFKRYTVNYIKNGTNYQQIDKITEYNADNSAANPITFTYPLPTQPALEFSNNNVDSFDNVRLTGDFNGDSYLDFIMNNGVVKLGGLNDTFTDVSTGKVFNSDAKIVHTLLDEEGQVYNGNGIVQYESGKITGYIFRDNTFVKVFEKALFDPSTCTSQPGGVGCSTTVSLFNEGDINGDGISDIFVTLKQRICEFVQIPGCTDIDPVLSSASKNDGDGIIKPPLCQQLQCNSYELGNFIVDLKNANNPLGTYVLDTGINQNSYTNQKYLDVDGDGKVDIIDVSNSTYTVFEFIKTAPDQYLKKIKFFGSLAETKASEYPVLFGDFNGDGNLDFTIPTTETKEKDNWRFYMGTEKGFSNFLKTDFLKYRKPDDYKNSSYPTFNIYRNFYSASDINKDGKSDIIHINSFNKAGQVNSSGMIITRYFGYNIATYAANGVLTNGTPDFSAANDFGGTNYVTFNVGEFTLFSPITSQVKVNNNYYDVLLFWKERMHKLKSPSSVARLSQIQSITQGGITTSADYLEIIPNNSLTPGFYQKIKKEYYPYFSLNRMDQSYAVSQLRQEGRKQDFRYRGMTGHMQGKGMMGYHQSARSSWYADGFENIKVWSGAEIDPLFDGVPVKEWSIKTNDESKIFPVDLSENNTQLLSFKSTVYQTDKLVNGQVITGPVSDTDKPNLVTATVAKNTRTKDFLTGTLTNTSITYGEYYLPKQSVTNVNNGYAITTSNLEYIHNLSGSGSDYFSGRPQSKTDIIQAYGDTQSSKEEFTYENNLPKTLKKWNRNTTGYVLESYNYDGFGNITQKVVSNSIDSQTRTETNLYEPKGRFVAKKTDHLALETLIEYNDWGQITKQTDPLGNTLTNTYDGWGKLLTSSTNLGGTTTYLYNRDNNSNITLTQNDPDGNVSKKYTNRLGQEYKISAKAFGQGQFISKDIQYDVLGRKLKESEPYFEGQNATQWNTIAYDDSVFPITKATATAFNGKKMETTVSGLVTTVKELNGYGRTTTKIQDALSNVASTTDKGGTIQFSYNASGQQIKAQYAENIVVTKYDVWGRKSEFNDPSNGLYKYEYDGFGQIKKIISPKGTKEYIYNSLGQLITQKELSTTDNGQATNKTISFTYDNKGKLISKSGTLKGQLFISNFTYDSYGRLLSSSENSNGRSYIEKGITYDNKGRISSYEKELQSSGIITKAEIENVYSTWNGELYQIKDKVTGKSLWEVKETNVKGQILNAKLGAADINNTYDSDGFLTNVNHSSAVKPNILQLSYSFDAIKNELKSRITGGDFNIVESFDYDDNNRLINWTDPVTGIKPSAIRNVYDIKGRITQNDQVGDIKFENSEKIYQPTGMTLNAAGTQNYNGDLIQSIIYNENNDPVKINGEKARISFEYGLTSMRQRLDIDKLVQIGGGGGSSDSKTTGVWDPNAPLWQRTLTKLYNEDGSFEVIRDQATNQEKHILYIAGTPYESNVIYVKDYNESNASYRFLHKDYIGSILAISDEIGNKLEQRHFDAWGNLTHLKSGNDTTITDQALIRTSALFVDRGYTSHEHLMDVGIVHMNGRLYDPLLRRFLNADENIQDPYNTQNYNKYGYVLNNPLMYNDPSGEFLQFLAIPIVKALVFAVVSYTATVLITGAKFNILNLYSTIVMSLISAGITTVIGDVFSTASATIGNEALKSLVHAGVQGTLSFMQGGNFFTSAASAFFASFVSYGYAKAVGSAAYSGVGQVAFGMLAGGVGSSLTGGNFWEGVKIGGIVALFNHTMHKITDNLTIDKATRKEFRKLVRAKNYQGAFDLVNAKYDLDADIKGKYTMKYEDSNEFSGLTGGEAFENQEVTIATHVFKSSVAVFIRVVHHEFIHVYQRGVMGFAGNLNIYEVREFLAYHDTLFNDKLPKATFSGMEGYWNKAKQFYKYMTDNPALIKAYQSQYNDFANSSFFK

SEQ ID NO: 953 - protein, 150 aa, Chryseobacterium sp.
MYKFLLLFFVSFVSAQQTCKLSFSNTPLSENGEIMFTVKNLNNEKIHVPKRYSGIWARPIDIQVYSDEKREFQDTKYSFDGAGCLDTKKCLGQMECLKNGESKEYKVIILPGRISKAFREKKKYRFKLAFETYLFSGCADYKTDWLYYQN

SEQ ID NO: 954 - protein, 1161 aa, Chryseobacterium sp.
MLGSGTSQSGVAPIDVNYGYSYTQQIFTKSEINANAAGNITGLKFYLPNNADISKSVDWVVYIGHTTKTSFSGTTDWVSVSGLTQVFSGTVSASAGEVTVNFTTPFAYNNTDNLLIAVDENTPDYTASANRFYTFSGASNSTLYYRSDSTNPDPSSPPSGTRTTTKSVTNLLGLAPVAPVCPVVSAPAAAATNVSVLPTITWASASSASSYKISIGTTPGATNVMNMQDVGNVTSYTLTNSLSFNTQYYYTVYASNSTGISAACTERSFTTTSTLECPSVNAPTAAQTGLPLRTPFSWSAVSGALGYRLSIGTSAGSSNILNNFDVGNVTTYTLTAAQQLSPTTQYYYTVTAYNGGVVSAGCTERTFTTTVSAPANDDCSGAVNLTVNPSLTCSATTPGNTLGATESMAAGTCSGTPNDDVWFKFTATATSHVIALSNVASTGSTTGVSDMYFQVLSGNCATMTSILCSDPDTNIVTGLTPGQTYYIRVYTYSSTVTANASFNICVSTPPPPPANDDCTNAVAITINPDMGCGSVTAGTTLGGTSSGVSLGTCSGTADDDVWYKFTATSTGHTFQLKNIVSVGNVSTTSLYAQVFSGACGTLVSTACISSNTNFTNLTGLTPGQTYYVRVYTYDANSGASFYANSFNICMGTLPAAPANDECSGAVALSVSPTLTCASPVSGTTLSATNSGLAVSPCTGTADDDVWYSFTATGTDHMVMLSNVTAVGTSTSTSVYTQVFSGTCGALTSIKCGTTVNTPLSGLTPGQTYYVRIYNSNTNGSTLYANSFNICIGTPPPPPVNDDCTNATSLTVSSTDAFVNALNGSTVSATSSSGVTAPTCSTSGINDDVWYSFTATAATHLVHVLYSDNATTTQVYSGTCGSLTAVTCFAGDYGNSNVLLQNLTVGQTYYVRVFSTSSTATTTSNFQIAVTTPSAVANDTCDTAVAIACNGTVQGVNALAGDETLPASTCGSTGSTASYKGVWYTVTATENGPITIDACGTQYDAYLRVYTGTCGSLTCFSNSSGVGYADTGCAVTLYNAPTLTFTGVAGTTYYVLLTGYAASRIGNYSISVTQGCSGLATAEVEKKNNEIKAYPNPFVDVLNISDASKVKSASVVDAAGRVVKTIEKPSSELQLRDLKEGLYLVVLNMKDGSKQTIKAIKR

SEQ ID NO: 955 - protein, 138 aa, Chryseobacterium sp.
MDFKEIHIGKLLQKKVREEKIEVSRICNFFNLSEKDIDNMYESVSLDINIILKWCKLLQYDFFRLYSQHLILYAPKGNKKLNNLKSSLPSFRKNIYTTEIIDFILTEIKKGEKTKQEIVTEYKIPKATLHKWIQKYQK

SEQ ID NO: 956 - protein, 55 aa, Chryseobacterium sp.
MSWNFFEIFDLVLNIFGLFSSESKSSHSKPKREALNHNIISKKKETKNQNILQKK

SEQ ID NO: 957 - protein, 160 aa, Chryseobacterium sp.
MKYLPFERITYRTNLSEQEVFTRLSGFVEPKKFGLGKNYIKDYEGSVDNNSFEISRVIQYRNSFLPQINGKIQNENNGTQIQVTMSLHAFVLVFLLFWCSIAVGIFIMIGSTEKKMSVEFFMPLLMLLFVYILTMAGFKTESKKSKEYLRRSFEAEIVKE

SEQ ID NO: 958 - protein, 43 aa, Chryseobacterium sp.
MINDLFDEANRESIINYQLSIINYQLSNLNTKLKHIKAHAKIK

SEQ ID NO: 959 - protein, 486 aa, Chryseobacterium sp.
MTIIAHSNGGKASDVAMLEYNKVNKIDKVITLGTPHWGTQLADFANYPGLEWITGALGLGTGSQLSTTYYCETYFRPYMDNHPLNQPQKFYSLGAWGYTRLTGLLSPAIIPAGTAIAALGGGKNDGVTPFYSSTRPGAKQLMTDTDLRGYINHIDIMEGVYVWDEAIKPVLDGLVVNTGVSGRSLQNESKEFKAVSNYQLISSEEPENLQLSKNARNIQFEIITKNSDASVDITDPMTGKVFNQIRPETKDNRNTENHLLSSNYTLENRQVKLSSNSEFIAVVKDGIDNPMEYKVIKENGKTYLEVSFPKLTSDDLDKVVIKSSVYRISGLKGERGKEKSVNAKFNLQDNRFLADVSNEEAGVYSIRLNARIGTNTKRTLLSGFVVSTEENNLDNAVESVKKDQVFALDTNPVVENSKLISKTELTGNISVKIYNYASKLMNEYTVEAKSEKNIELGRYTKDLAKGNYVVIIDYKNTKQSIKFIKD

SEQ ID NO: 960 - protein, 112 aa, Chryseobacterium sp.
MKKFLFLCLLIISGKFFTQHLPYATLPKPHLLSLNYLNSLGENNILYGSVPPNYNGKTILFTHGFVMSTASLLIGNSMYKRAYQEGYKTAFVATSRLKGDWENGEILSRAID

SEQ ID NO: 961 - protein, 210 aa, Chryseobacterium sp.
MKQLSERALNFLKRKERKKEFYIDKEEIENLLSLYPINNYSEILRFQEVYSGLIIDDNIIHIFNPAELKDYKTIKTVLCEEQILFPICGGLFISEDGRIAIKDNVSNDYIFYFEFFETFIEQQAFFEEYQDYKYLPAIGYYTKNISLISEVLPDYDFIAECSDRYNSLWKNISNFVHARLYPAGYTLIFDGISEEERSFLIKRLKSKQII

SEQ ID NO: 962 - protein, 1080 aa, Chryseobacterium sp.
MNTLFLFEAGRSSKHWLTYLVALLLISLGIFCGSQFNLSAGEGIYLNSPYTIGFMTGMLSLSVIFFATVYALQLLFRDQDSKFDSILFSFPFSKFTYLKGKFYAYFLQTFLSFNLLMTGFLLGQLMRTGSEMQEYFNILYYLYPLLIFGLINSFFVCSFLFLISFTVKKKLLVVVGGLFLYVLYMIILLFSNSPFMAGSLPQSLETQQFSALIDPFGLSAYFMQARDLTAHQKNIHMVPFTGYLLFNRILFFLLSFGFLFLSLTLFSFSNTSGQKVKTRGNLQSFSEIGTLEYSTVAPAFNWWSSFRPVLSFVKTDLTYLFKSIAVPAVSIMLLFFVGMEMYAEIEKGIRLPQKYASSGLISTTISENFHLFGLLITAYFLNDIYWRSQSSGFNLIENSTFFAKNRLTGHFVSVSLLLFFFTGIVMVQGIIFQAAYQYFHIDWNAYLGVFLFNTFPLILFSGFILLINDRIPNKFIALGVSVLAVFLLSGPVSGKIITYPLLRIFSDFKGTYSDFNGYGIYEKAFAQRLVFGAGIISLLWLLNSIAKTKKIRVSDLAFTIFLLIQATIAGIFFMKGYVPKNEAQNILSSVEYEKNYRKYENIPQPDITGITTEIKLYPSKNAYQITGKYILINQTNQPINKILINFNKDLKLESAVMTSGNERTKILQNITEVSLQQPLLPGKTAFLDFTLSYQWFAVNGHQPFNAIIKNGSFMRISRYYPVIGYQKDYEIQDKKQRDHFNLENRIGLKEPEAPEVEKKDFINLNMIVSTERDQTAIGTGDLIKKWTKSGRNYFEYKAEQIPFRFAVSSAEYKVKSMNYKGMAITVFYHQKHSENVSHLLENAKLTLDYCLQNFGPYPFKTISFAEISSFTRGFAATAYPSAVFMPEDMIFHANIQADKNQDVINELAGHELSHLWWGNSRIDPDDRKGTVMLTETLAMYTEMMLYKRMHGKEKMMERIKVHQQIYDNEKGLSENIPIYKTTGNMPHISYSKGAIAMVQLSNLIGEDRVNTALKNFLNNNRYPKKPTSLDLIREFYKVAPDASTRKQIDRLFKTTEDIIFTSGPDTASTEAKLKDPIDGF

SEQ ID NO: 963 - protein, 53 aa, Chryseobacterium sp.
MILRDVSVLLNGSEISKKLLCLLQLRIPCYIKTKKQPLSKLLFVFENLYRLFS

SEQ ID NO: 964 - protein, 105 aa, Chryseobacterium sp.
MNLPNVIAKLIKAQNNFDSAAYAQCFTETAIVFDEGRIHKGKVEIEKWIDKSNNEYKATMEALDYNEKENILSAEVSGSFPGNPIILKFHFEIIDEKIQQLKVTD

SEQ ID NO: 965 - protein, 106 aa, Chryseobacterium sp.
MIKDILDRWPDWREYFKGSAFLGIAGLAVLFIRNTQNKDIKVLQSKLDELMAARKEDKGREIENLTEAEQSRLYRFYEDLEKQRREKNIPDNSRPENLQMNCPRYK

SEQ ID NO: 966 - protein, 121 aa, Chryseobacterium sp.
MQSASNLVERAVAKSKKNAYKNDHWDLVDKAEKDAGFIATVKESELPAELKGKSKEEIQKMIVTKSAAREKIQKEIEELSKKRQTYIDSEMKKRGTDDSDDLGKAIESSILELAKKNGYSL

SEQ ID NO: 967 - protein, 440 aa, Chryseobacterium sp.
MNAIIVPGVTDLNKGDQALVWESWRLAKDTGLYDEVYILDAGENAEERELLCKQSEEHGFKLLDNILKHPRRGQHKSDEHIKESKLELLKQIRNAGIDFKNTRYLIKICNDLEKVKKSFDDKTYQTVKQFHDAKTIFVKGGGFIHAYGEKTAPYLMWYFLFYVRLAKALGKKVVFLPNSYGPFIGLTVKQQVRSVFNKLDLIYARENVSAKSLGQLLEKNIPVEMDLGFFLEKGSQDEALKILQKYNLSVEDKIVGITIRPWRFPGLSNPEVLYKKYIDSVAKLTKYLLDKGYKVALCNQSLGPNSHEDDRNAIRDLLNIVQDPNMIWINENLSCDVLKAVYSNFYFFVGTRFHSIIFSLTSLVPSIAIGYGGNKALGIMGDFNLDDYVVQIQDVQPELLIKMFDKAISEYDQIKSKLDQSMRLVTESRNRLIKDIQSLY

SEQ ID NO: 968 - protein, 303 aa, Chryseobacterium sp.
MKAITVFTPTFNRAKTLVRLYESLCSQSSSDFKWIIVDDGSSDNTRAQVEIWIEENKVDIQYYYQKNKGKLAAQILALNYIDTELFTCIDSDDYMPYDAVEKILNFWKTNKKANSAGVIGLDAYQDGSVAGEYLPDIKESTYSELVDYYKIKGDKKYIFDTEVYKKYLPYPYFENEIFHEVSWIFTLIDQDYKFLLSDEVYCIIEYQQDGLSNGLYKRYKNSPNSFMEYRKVKMKYGINKKVILKNSIHYISSSLFAKKWNFFKGSPNKLYTFIAIPFGIALNVYINYKVKQNTNRIKQGKLN

SEQ ID NO: 969 - protein, 365 aa, Chryseobacterium sp.
MDKLIIILFAVFQCFACSGQNTSTKEFIDIKNQYFKNAVNVENYLPKNADKKGGTDYTDFIQKALNENTKLVFPDFPILVSDKGLDLRSNQDILFQPNSKIILKSSNKPAYKLINIYNVSNVNIFYLNIVGDKYNHQSNEGEWGNGVSIKSSNNIQLFKPSVSKFWGDGIYIGQEQTVPKDITIKGGIIDDNRRNGISIISGINIYVKNTKITNTSGHNPQSGIDIEPNSKNNEITNVVLDSIITKNNAVHGIIISTGNLNGTNKPISIKINNHQDISSGIALGLSITRNKLNYLQPLKGKIEISNSNYNLPGKSFIRNYEGKKNDVNLILDNMNFNKSAVSRSSNNNVNQFLSDYKNNKGSDIK

SEQ ID NO: 970 - protein, 475 aa, Chryseobacterium sp.
MLNRVIIFLILLFEIYFSVTKKYPDYYDKDFLWLFIVLNTISLLSFAFLDKDENVNLKNNKIKFSVLFLIGFLIVTFQPFVDLALGYLEPSNRYLFIRPAVILKTLLCASIALNSYLFGTSLFQSRKVIRKHGVDVRKFIDVRALKVINVLSFVFFLSQINASFLNANTYGSGRKTSFFLGYSMLLYETSFIALILFVIINNGRKSKFIPYLKQYGYSLLFFVAYLLLIMFSGDRGPIIYLSLALFFGYIYLNDVKISSTKLISIFIVGSMVMTILGMIRRTGVTLDSAINSKIENTYYPDSILPMTKELATSVLTISVAVNKVPAVHGHFFGLFMFQNFSVIIPGLNNLLNSKLGIDATNFSSSVFLTYMSLGPNARWGVGTSAVADVYLDFGVFGVIIIFILFGYLTKKLEVYVLGYSSTNFLLVAVYLLFFSFSIYISRSNLVVPLTKLTYVLLFYILTLATNKNILKKWIN

SEQ ID NO: 971 - protein, 480 aa, Chryseobacterium sp.
MINKVLKSQTFTSLFWVSLEKFGYSGVYFFSTIVLARLLTPSDFGLIGILSIFISFSQMIVESGLGGALVKKKDVSNEDYNTIFTFNLACSCILYIILFVCAPLIASFYKNEELINLTRIVGLNIIISGFSLTQKVHLIRDLKFKKQTIISIAALLISVIISVSLAFYGFGVWALISQQLCYNLFFCIFIFNVVKYKPKIEFYKKSFGELYGFGSKIFASSLLIVIFNEGVSSLIAKVYSLLVTGFYYQAKKLVDFPINIFRALGDSIVFPLLSKISDQKEFEKKSSLLMKLILLISFPLFIILFEFSDEVVFLILGKQWSKSAEMLNILCLSSVGLIIDTVSRNILKSTGNGKAILQSEVLKKIIGIIIIFSAISFDLNVLLFSIVIANLFGCIINMIYVNKITSYKFKNQAKDILPIVCIAGLSGFVARKFIMIFNLSGMTNFILGSIAVVIIYLILGLVFFINKEMVLEIKSKIKFN

SEQ ID NO: 972 - protein, 194 aa, Chryseobacterium sp.
MKIKILILLLTMPLFYVNAQNTVNDYLNISGPIKLNQKEYKLVWSSHPNENYFKQEYISSNENINRYNSMVLIDFVKGDFNIKDVVDQKVAELQEMKKTNPVINYQIFENKEEYILDFLISENSKNGKEILIAERNIYRYKIISNEKNKGVLLFALSERGYPENMDSFFNNLKSNTSKLIEAVGNYKHPDIEIK

SEQ ID NO: 973 - protein, 309 aa, Chryseobacterium sp.
MNSSQKSNYLFSKIDPNSHLFYTLFSPETAKATLLIVHGMQEHSGRYAEIAEYFAAHGIAVLTYDHLGHGNSVKEKKDIGFFQLEKPDERLVADAEMMADHLAEQYPDVPHFILGHSMGSFITRCLLQKVSSKFAGAVITGTGGPLPGIDFLRGYLSLATAIAPRHRTFLNSVFTSVNNKHFKKDKDFSDTSWLSVNPENRKKFEQDDLCGIPFTHNAFYTLFTIYKKATSRNWASSVPKSFPFLFVSGQNDPIGDFGKGVIHTVNNLKADGFQNVDVKIYPEMRHEILNEEIREEVLNGIYNWIITKS

SEQ ID NO: 974 - protein, 743 aa, Chryseobacterium sp.
MKTKEELKKYFENGDIPVQEEFWEWQESYWHKDEMIPLNQIANVDAVSVGGLLDNIKTGGVRDWVLGSYKAGEVVRHLNILWKAKIDITSAVPGNNANWEIYFPFPKSPGIFTSHSTTLTIDTVTNTVTLIGTSTNKLITNQGVFNVRAQTVDTSANPTYYAIVYNTSSTNARAVTVYDNAARPLGINDYVLFYVLNLNSILQDVFGAKGYTLINTTETTTYPIKPVATADVLYNKTFLTWHESRTSDEKFWLSKAILDAEFYNVKDSAVVTLYGLGKNVTTTNSYLGFIYAERGKSALFLYADEFNNAFSAPYDPVLHSGVKTYFLRSGTKRESNTTIYGKVTIDWSQVPNQKRVVESNSGVTNNSNLSRTLYKKSEVFNNPLGFIKFAKSRSFNDYYSAPALDSYAGPDGSGIPKKPYEDCREWSLKWDELVTNVPPGYSISKETLTTDVPTDTNAEGKLPIYGYTFLPGKLTAGDPTGNNAQTLPRIVLNCSIHGFEKTPSFVAYELMKQVLTNWKSHPFLEYLRFNVEFVIIPFANPHGWNAGSGAGTRKNLNSVDLNRNFPTFWAGGGSTPADSTYPGQAALSEIESQAIYRYMQEKITPNTIMGIDFHNFHGTPQTDPKNYNMAWIVNLGSELGQSSANILMKELSAKYKAKSLLIPQSDDYCIGQSNNYNGPGFSGSAMKSLGALYASTFEVCQNFRFNPAFKSHDSDAITFGLETFTNYLRIFLAEHLEEYNRTK

SEQ ID NO: 975 - protein, 117 aa, Chryseobacterium sp.
MSRVKLEAIWQHEKVLPYILTTLKDKIDDITAVEKIFLFGSRGRIPFDKWDTLEGKDWDVLVQAKCKLKNAHALLDKDYYLDLLVLDEETIQKHYYNNKLTMVFPENVLDDFITKTQ

SEQ ID NO: 976 - protein, 898 aa, Chryseobacterium sp.
MAKIKDIIEFLRLNRRNEEANKTPVTPNYVILESLDTHKEYTVSKDDFENFDKYIRLVNVLNDYKANYIYILETNANKTFYIKNASSKFVDIITHQVNNAVTENSLKQYEIDFGSNFYFYDTSQNNVVISVTQLAEIKIFSDTIKYIPNEEPIKSFQNDDYAYNYDSHESISHSILKRIAVAASSRYTPSGIYSSDRMVKLTKSEENGKMFLIPDIKHDTLKGKYFLQYQFWKPKQDSEQKIKPFYAPIGDVAMTLEFNYIGAFLSFLNETIFSQPNFNYSSENDGKREEFKEQFKNIVIVPLENYALRDTDKYYREIIEVFYYLHEDVASTINPNIIWKLINKAIENDGLTNFSINEEDLFIKLLETLLATEGREEKFLIRLNETISVKNTTTVLEYLYDRLNGENGVKFVNLINKAWRKTRFAKPDIEKNPEFASTDGPLMFPYESEKWLGLYFSNAKVSFENNSKKERLLNVTVTTDQYKKVTKITPKGDTYETREKIKEHFWYHPFYPVYLKNVEKQDSELKLDSIVPAFVLKANEDKQFWSNVITSAEYALDVATTLSGIGNITKFRYLTRVTQLAEVIEGTNAISKVAKAANILRYVKGAAGVVELTSGSINLMIKITGAKDTEFGESLSKVLFYLELITLAGELTTSMKMGLKKSAKEAIEESNGAMRVKHPELFAELYRIAGLKKVYQHVDDFMKTRPKFHDLNLINQLWKEKIVTKLIFPTNLRKLYFKYLDEFPELKKGFNQAEFKTTIFNQGEKVKEVVEFSLSGKREKLLSAFGDPPNLPENTIDILSDYENFETFVKGAEDFGGIPRNYDSEIKYIFNFLKNHIDKGDEFIIETRNIFKTCGSCRREFVMLEDYLKLQGKKVKIIVMSDETIEGGRMLRDKLKIK

SEQ ID NO: 977 - protein, 783 aa, Chryseobacterium sp.
MKTKEELKLCFENGDIPTQEHFWSWLDSYWHKNDLIPINQIQNSDKIIQQNSSFNDYMNPTLEVGALAISGSVGFPTGSTIRGRTDSFLDIVYANQIELLGDMLLQTIFYYTDTNVFISKQDINAKTFTPTIPVTAKKWKVSLHHIDKTQTVTQPELNAIKMNCYSSKSITFNDIVENAKASIKVISEYNNLEINLGENIPTEIGRIAVNNGFNSTSDTGIRTALIPIVSGKYLISQKSGYKISRVVFYKDGIFANQNVTTNDFSVDNLTSNQVRLVFEKNTPTDIVTEQDRLDFTYILKNVSVSKYDQLLNESKKSKPLPSTIYTINEQVAILNTNDTDINFDLANRKIIISGGAIIDTGNTTVGRISLPISTAGIDMPSAITAGVVLYNKTNNTIIVQNQTSAPLLNHLVLFTYRYSGAFTSFYVTGLKNYSVNGVPVSQKDIRQMNKFAVDNFGIKYWSAPVYPAFNPLTLTTDVLYPMYDRVIAPFSNNVTKTVIGQTEGPTPYDILRIDISLNRKTPPTQRRRKPRIFVCAGTHGGEKLSVYTTYLFFKLLLENPNKDEMIDALRTNYDWTLIPLVNPYALNVGNVGGTESVRWNHNGVDINRNFDYRWAEYADGGAGSQSYKGIAPFSEKESQLVRDTFNAIKTDTVLFIDCHNFGSGVNIDYRAAWFASSFNTVQNAIYSLCDRLDAEIRKRYSYLADKDLLAFSDIDGSSPMSQAWMGNQQVVAMTMETDQSDYYNPTDPTSFNSNVITRSIETYVNAFYSMGKYAVDFYNNRMY

SEQ ID NO: 978 - protein, 487 aa, Chryseobacterium sp.
MKKIIISTIAVSALLFTVTSCNTDFDTDVRDIPVTKGDADFSKYISLGNSLTAGYRDGALYSSGQNESYPSMIAAQMQLAGGGAFKQPMMPNDTGGFTNLFNPATGDFAGKYVLSVVNGALTPGPTAPGAALDNVSAGGPYQNMGVPGARVAHLLAPGYGNPAGLISTPATANPYFVRFASSTTTSVVEDALKQDPTFISLWIGNNDVLLYATSGGADPNVPITPVDGAVGVGFSNTYAYLVDKLFPAGTKRKGVIANIPTVTNVPYFTRIPAMPLTGLTDAQVTQLNTGYAQYNAGLLQAKTLGAINDAEYQKRLIKFTAGAAVNGAVIVDKDLSTVPGLPKYRQTTAKDLILLPASKVLTPQAGGGTSVPLEDKLVLTEAETAKVIAATAGYNTAIKKAATDKGLAFVDMDAKMMELNSKSGIIWDGVKYTATFVTGGAFSLDGVHLTGRGYGIVANEFIKSINAKYNSTLPQVDPNKYSGVKFP

SEQ ID NO: 979 - protein, 158 aa, Chryseobacterium sp.
MNPKPIEFTAIIQQNGEMNAAFVEFPFSTEELFNKKGQVKIKALFDDKVEYRGSLAKMKSDCHILGLTQEVRKQLGKTFGDEVSVALMEDKEERVVEIADDIASVFNENPEAKALFDKMSYTHKKEYIRWIEEARKPETRENRKVKMVQMILDGKKGI

SEQ ID NO: 980 - protein, 203 aa, Chryseobacterium sp.
MTVYNILTGTAAEAYMEESKEQILVKHLLKKEEAAWKELFGAYSGNLSYVCSRYVTEKEDVHDVLQNSFIKMFRSIESFEYRGSGSLKAWMTRITVNESLKHIKQKGDFRSAVEVDDLPDIPNEEEPDFEEIPRDDIMKMIRSLPEGYRTVFNLFVFEKKSHKEIAGLLGIAENSSASQFHRAKGLLVQKIKEFKMSKKAQYE

SEQ ID NO: 981 - protein, 55 aa, Chryseobacterium sp.
MMVESKKETTEAIAGLLKEGVLKPFVYKTFPFEDLAMAHLEVETNRVAGKVIVNL

SEQ ID NO: 982 - protein, 139 aa, Chryseobacterium sp.
MKKTITFFVFLGFGLTFSQVKETETLSAKDQSEESVLSKDEKSAEYPRGWMALRKDIADRIRTKKINMRGIEGTITARAKFIVNIKGKIEDITVTGDNADFNKEIERAIKSLKAQWKPAESKGRIVRSYYTFPLTIKLD

SEQ ID NO: 983 - protein, 290 aa, Chryseobacterium sp.
MKKTYLLLPIFFLASCSSSNDETDLSNNNGNNNGNNNPGTPVLISKLTVDGDTSVFTYNGSKISQVKNINTGEVSTYTYTGDLITEELTTGGSSTFKVNYTYDGSGRLIKKVSVQHMLVNGYTATDEYNYAYTSNTTLKITYTKTVAGNFTGSPSITTGTKNATLNADGSLNSWTETASIPIPGTSGFNSATGILKPIVYDTKNSPHKNITGYLKIIDTEDENGSSHNILSYSDKLDLNNGSGGAMWGIFKSTYEYNTSNYPTKNVRVYYDKTSTNVTSSEVITYEYNHL

SEQ ID NO: 984 - protein, 148 aa, Chryseobacterium sp.
MITESLRSLYSRDLNKLKAEIEAYQNEENLWKTDKNIANSTGNLTLHLVGNLNHFLGTHLGNTGYVRQRDLEFSLKDIPKEELIEKVTATATMIDSVLSQLSDEDLKKEYPLVVFENAMTTDYFLIHLLAHLDYHLGQINYHRRLLDI

SEQ ID NO: 985 - protein, 35 aa, Chryseobacterium sp.
MHSAIKIITRNPTGFSNTIPLISFMIKAVKIKCHF

SEQ ID NO: 986 - protein, 32 aa, Chryseobacterium sp.
MFLKNGSFIDNTLVKIEPYIFKKNQERTGRDF

SEQ ID NO: 987 - protein, 339 aa, Chryseobacterium sp.
MRNFFFLLLMSVFASAQKIETIDLSKSIKDGKNSIKSLTVIDQRENQEIGMVMHHKDEVKIIFENGASKDIQDWFYKYNPVRGNSDMVILLEKLNISEDKKEKYSIGKLELKASTFIKKEDGYHFVDRKDTVATVSSRITPYLAQSLARKVTLILTDLFKESYKATPWELSISENELSDYVPILKEKLSILKADELKEGVYKDYYSFFTHNPEPGFTLQINDKGIVTKAVKGEEKTAIRHFYGFVYKGIAYKNIPVGYTEIFKDDIGVFIEVTKAELFPETATTGVTIGAAAGGLIGGVIGAVIDVSLSGKRKNTVGPKVYLDPFTGNYVLPEDFGKTK

SEQ ID NO: 988 - protein, 284 aa, Chryseobacterium sp.
MGSTRYDLDARYDRARKAGYGTKSAGEIFTQNAKRMAHESMNPHGISFRESRDSEVHPNSVPIILGLDVTGSMGHIPYELIRDGLPKLMGGIIQGGVPDPALLFLGIGDHECDGYPLQVGQFESGDAELDMWLTRTYIESGGGGNAGESYLLAWYFAAFHTRTDAFEKRGQKGLLFTVGDEPCLKTLSASAIREIMGKGQQTYTHSELLEEAKKKYEVYHISVLHSDQALRADRGWKELLGQNCVSITDHREIPNVIKNIICDKFKNQSFGTMGTGGLDQFQML

SEQ ID NO: 989 - protein, 156 aa, Chryseobacterium sp.
MKIIQYIKGDATRPNAEGNIIIAHICNDIGGWGKGFVTAISRRWKQPEKEYREWFRNNKNFNLGEIQIVQTEDDIWVCNMIAQHKIITHSEVPPIRYDAVEECLLKLAHEAIQQKASVHMPRIGCGLAGGKWEEIEPIIERALLAKNVEVYVYDFE

SEQ ID NO: 990 - protein, 197 aa, Chryseobacterium sp.
MKEFEIRADYKNDTLIVYQAYNKAIAQSAVEHQKFTAPFSFNRMTWIKPSFLWMMERSNYGQKSNQECTLAIHIKREAWEKALGKAILTSPEKRVYPDPRNWEKDFENAEIYVQWDPERNIKGTKLNYRSIQVGISRSLIEEFNEEWIVKIEDYTPLVKKILNLTKSGEFDKAKKLLPVEKNYPLSEELAHRIGASV

SEQ ID NO: 991 - protein, 900 aa, Chryseobacterium sp.
MKKNISLFLMLFFTVLTFAQKTVSGKITDDDGVAIPSASVTIEEPGKDAILAYGITNSKGEYKVTFTSAESNVDLKVKAFNQKPLIKQISNSDQTLNFKMQSEATEIKEVQLKTKMITARGDTISYDLKAFNSKNDRTLADVMKKIPGIEVNNDGTILYQGNAINKFYVNGKDLMEGGYGTINNSLPKDAVQKVEVLENHQPVKILQDKVPSDQAAINIKLKNSVTMTGRGEVGTGFGDPWLWNVKLTPMFFGQKSQWVVNYKTNNMGEQVENEGNILAFGNRFEGKRINASQNDWLNVENADTPNLPVKRYLMNNVHYLSANYLTNIDKKKEWELKANANYTNNAVNRESYSQKDYFGGTSNIVKILNNFYTDKAKGELIFTKNAKKGFFKNTTSFSQYWNADRGIVDRTDAKTGIQRSANEGLESPTTSFQNSLSTIIPWKEKMVNLLSYVSYQTDRQTLEVSPSSYLDIPGFKPVPNTEFATQSLRLKTFEANHSANIGFSAKGWTFTPEVGFNFKSTGMMSDLSNVKAIPSNNPNVQDPKPEAYSNDLNYTTATPYGSLGINYKSESWMIYANLPVNSNNIKAEDPLRLVSKSVNKVTFEPNIFAQYSFASFWKASVNANINNNFGEINTAYSGFLMTSPGGIIAMDVNNPIPQNNNKSAGTRLEYRNPLNNLFFNVNYRYSDAKRNLISNPEINGAGYTIMKYKEQDNHVLNNGYSVEVGKYFPKFKTNASLSYSNNTTKSDAFLNDKSYTNKNNGQSFGIKFNNTYFSWMSVDYNASLTRTKQTSVGELNSNATRTGFTHNLGVFFYPMENHTVGFNWDQVNTNAAGQKYHNGFYDISYQFTWAKKKIDFELKWMNIANKKVFETYEINTTNIAYTRYQLRPSQVMLTVKFNFK

SEQ ID NO: 992 - protein, 299 aa, Chryseobacterium sp.
MKKLFSIFLIALFAFAGAQESKETANRFFYELTFKPKKDSAKLDKIITILDITPKKSIYQDYTMPAQDSIIKVQIEEMEKTKSFKDMTKLIKWPKFSYKIIKSYPDMKVQYVDRISRNLFSYEDDPKLQWSILPDKQKVGEYNAQKATTEFGGRKWTAWFSTDIPFQDGPYKFKGLPGLIVKIEDADKNYSWQLSGNKKIENYDELSYADKINAKMGMVSNTITPTSKEKFLKSYEGYKADPFAESRPYMTAENMSRPMPGTDGTVGDFMKRLEKQVKDFFGSNDNPIEKEQPSDKKKK

SEQ ID NO: 993 - protein, 90 aa, Chryseobacterium sp.
MKKILVTVLLTTSALLFAKNESPNKNPELPKVKETVLVAKKTIEKTDQLQKPITLSAAAEEKELTTEEKCIIEIALGPVIAGPPYHCTQI

SEQ ID NO: 994 - protein, 261 aa, Chryseobacterium sp.
MFAGLAFINPVKRWVNYSDQKGNSDIKVVSFNTRAGGRGNKEIAPYLKSQNADVFFLQEDAGNEYQFEGYQKANPGGGLTILTKHKIIKQQILDPQDEDVRIPGVLADIEIKGRTYRLIDVYLNPFRFEKEMVKLNGNTDTNEQKIKDVIKRLIPTFKKHQDQVALIREAIENSPYPVILAGDFNSVPNSYEYYHLSDGLEDTFLTAGKGSATSFHDYKFPIRIDYVFSSKSLKTISYKVDRSVSISDHYPVIVKFSSESK

SEQ ID NO: 995 - protein, 97 aa, Chryseobacterium sp.
MKIYYVYIVKCSDNSYYTGFTNDLERRINEHNDGLNPESYTYTRKPVELVFYHEFNNVNQAIRFEKQVKGWSRKKKEAIINNNWDLLPLLSKNRMKD

SEQ ID NO: 996 - protein, 227 aa, Chryseobacterium sp.
MKKIITSILLVLAIALSAQQMTTLSYDGSRLLNHTFYQNGDSSGKGISYDDIQGSPYYEKVFSPAKFIVADKAETAVARYNMYFDEVEFKKDEETYSLVPDSPFTRIEFTRTKEILVKLDTDDDLKGYFFELVNGKNALYKKVKSQFNNAVAAKNSYEIDRPASFNTLDPVYYIKTESGYIKKPKKIKEIAEAFPAKKEEIEKFAKSNNIKINKEEDLIKLVKFLNQ

SEQ ID NO: 997 - protein, 488 aa, Chryseobacterium sp.
MHYVCPACESENILDLTFPVEEYVCMTCSHLIDVAWNKKIKHLKVPTENVVLDVGQKGKIDGTEYTVVAITVKKYGNSIFWREYSLKDSKGNDAFLSESDGHWVFLISIHPDDFKGKDSKLPTYLGRTYRWYENTPCTIDAAAGFFDEHLDFTIATYKEYVNGTRMISQEKTAKKSQYFYGVHISKYEVKKAFKIANLPNYTGIGIVQPYYFDIRQAVNIFCVAALMICLLQMYVYTSRTNETVFAETINFADVKDKELVSKSFTLSGGSAPLKVNAFSGVDNSWANVQLSLVNENTNEIIYTSKDIEQYHGYEGGESWTEGSQSEDFNLCGVGSGKYHFIISAEKEGGLPSFSSLTSPDSKVMISRDKSGTIEVTDIFKVQTKTFTDGQTLEKDTSEVIRLAKASFGTQKLDSLINSEALKLTTDPISSNTYVQLKATWLPVSFWNFGIILFIMIAVFVAMWIGKHYFNVNKWKNSSNSPYPANDDN

SEQ ID NO: 998 - protein, 689 aa, Chryseobacterium sp.
MKKILLFTAILCCTLFSSQSLNTDWQLTTPFLKGERVMKMEILPDGSYLVKKRNEYDDLLITENDGKTWRQINEMSSVADFTIHNNKGYAVIGYNLIITDSKFSTPGISHPLPSSYFPQSLFVLNDNTIFISTTNSRIMKSTDGGVTWNVYMIPTVYADKITSVFFTDANTGYCVTDATLGKSFIFKSTDGAATWTKVSETTEKFDKIIFKNPLNGIATLTGGTTRYTLDGGNTWIDVSINGLRDIKIYNNEFVAVGLGIPNKLYRTATGEVWDSSLIYPSSYYIFTSLAVSGGKFLLGTDNETSDEINHSIFKSTDLINWIPTNVKWILRGGLIYNNAYASKHLATVGGYVSVDKGMTWKYMPPNVPTGSLSILSNGKGIGIRNSSYEFWRTQDSGLTWTAQNIPYPLTGALAMKPNGDFAMATRGDNANSYKGYVTTYNASTGWSTPFEVGRHVRVMKFVDNNVGFLLTSEKMMKTIDGGITWAVINFPGVFDQPRDIVFGNSSRIYIGQYCSVDLGNTWFINNNMTSSFKDFEIFDDGIGYGAYKGDVWKTTDYGVSWQKILNTKLLYLIGANMGKFAIYKDYIIGTAPYGFYALDLVNGTLSTNDERIETKNTMRIYPNPTSSVLFFDSKEQIKNIVVADMLGKVFKNIDHPKGTSIDISDLTKGTYFVKITTNNKTYFEKVIKK

SEQ ID NO: 999 - protein, 331 aa, Chryseobacterium sp.; identical to SEQ ID NO: 5

SEQ ID NO: 1000 - protein, 156 aa, Chryseobacterium sp.
MKSRILLLAGLLLSAFSFAQDTKAEKPKYNQELATSLGADKYGMKPYTIVMLTTGTTHIEDKAKMSELMKGHMNNIGKLANEGKIVVAGPFLEKNKENYRGMFIFNTKSKEEAEQWVKTDPAVQAGIFSYEIFPWYGSAALPLYLKHHDEISKENP

SEQ ID NO: 1001 - protein, 55 aa, Chryseobacterium sp.
MKNLKSLNRKELKTVLGGAALACEAPVDGGCPAGYTFCSNPYCCYPPRKPFICFD

SEQ ID NO: 1002 - protein, 251 aa, Chryseobacterium sp.
MKTIEEVLKKLDEIIIWCKENQSPAGYFACTYRIMTAQVLKGIQQKKFEDNPRMTTLDIAFAQRYLQAWDSYSKGEKCTNSWYIAFEAAKNKNLLILQHIFLGMNAHINLDLGVSAASIMPYRKINPLKKDFENINNVIASINQNVQDSLNKICYPVDLVDKLSSGKDNAVLDFAISKARETSWATAVIASNTSIFLRESVIGIVDYAAAKVATQILNPKILTPSLLKELKKCESSDVVKNIEILESTKNS

SEQ ID NO: 1003 - protein, 278 aa, Chryseobacterium sp.
MFSFASYPYPKSESFKEIFVSSLGAGVSVYLFLIIFQPFGTENFQHPYKFLLLFPYCVIFGTVFLMANLITFRFTHWNIGAEFLKIIFILFFGSILSYFYNSLFLSHVELDLGNYFYMFLYSLAVGIPISIIYILSRYIYLNNIHEKKAHTISQHLPVPAPEQQNLLKISAQNTELMINEKDFLCAQSMENYCTFYFLENNSLKKTLIRISFSNVLQQIETDSVKKCHRSYIVNLRRVKNLKGNAQGYKLILPKIDFEIPVSRSFIPSIIPQLQQPNP

SEQ ID NO: 1004 - protein, 263 aa, Chryseobacterium sp.
MSKNIRFFFIFILGFTIYYFFDFFFFKNIQTFSKNWFHSKAIAHITAYSVTLIPLMVTLKILLPKRNILDLLSLNRPVIKGFSFAVIGTLPMFIGYMIHFKAVSKINLETLFINTFSSAFFEEIIFRAFLIGALYRFTRLGFLSSALFGSLLFAQVHLYQSQNMTELIEIFTITFLGSIFFAWAYFESEFNLWTSIFLHFFMNLYWEIFNVSENVSGNFYGNLYKLISIVVLIAAIIWFKRKNKIPFEATWKSLFIKTREIQS

SEQ ID NO: 1005 - protein, 95 aa, Chryseobacterium sp.
MITKEEAYNKIKSYLDKNINYSSIDGIDKIALTSKEEMTYPISYGKYKGEKIDHYAISYGEIWGIEERSMGILIHAKTGELLYIITPHGYLDIEE

SEQ ID NO: 1006 - protein, 744 aa, Chryseobacterium sp.
MIQRLDYVLSRDIDSPLGENSVFYETFVVPPELKESYPKSEKYSVVHHQAVFCESGTEVFDRYEKDSIESNYFTIYYEMTSKSTSNFFGTACRVKMGEYARQRLIKDYNSTGKTINYDGNTVDGSVSDFNGLIKLIAKDYGIDDTLLKGAIYLEILEKSKINEAFKKVSSLNNQLADWLRGGIEATEKWKFTEENYDYIKFYVEPMYNNFQNKIGANGFPKQEVKYKPIIPVLFPCNEYKNMSDNAQNIAEAGLKKLSEFVASFDEISTAAVFNIVAATPTIADDILFAVTFLAKNFIEDNMPDSIKNIYNQLKVLFKEILDIVSGIGSIISEKLNQEIAKINAFLCGILNGLISLVQLIIMLLAMVVDNLPISELERLSPLELTKHQENLEFIEDFVDLFNENAKEFLDGVRKLFTDDKIWKEVSSLISFLRKKFSNLNEYFWAYFIGGVAFELILDAVIAYFTGGSSLVAEASAKISRLTAKAEQAGAKAMNFSKNLGKKISNTAQDVYKWLEKEFLELIEAVKTGNLLKYFRKKFYELIGETPSQEELLAQWDEVAVSGRGRRLGQKLRKVDIEYLIKELKKLKVELELHPLEGSLPIEGFFVREGVPAMMPERAAAIFITDGTKMKIVLREEATIYEFFHEFMHYRHSQVLGLEKYLSLGGRGTLGELEKEQWVFDMLMKNKDYLTKSEIVHAFDYINNPNPSLGVRARFGKDPVSVDFDINKIPEVRKEIKASEILKIK

SEQ ID NO: 1007 - protein, 54 aa, Chryseobacterium sp.
MIKYIFSILCMMGFLNSYGQKLYKIEKDQFGEPLLNNKAQYSFTGKPSGEDLKN

SEQ ID NO: 1008 - protein, 76 aa, Chryseobacterium sp.
MYFGKLNEQRGKNSVYYGEKYRIKNNIIQLEQFGKSPDSKKWYTRRITNGRIDGNKIIFNEGLVSVFEKRKNLPAK

SEQ ID NO: 1009 - protein, 274 aa, Chryseobacterium sp.
MKKIAFLILAFVVFFINSCKDEAQVYDGESYLHFNKGTRSEAVVKMGSGPTTVGISFGTAHALSGSAQVKLVVDTSLSTAVEGADFQIVNQNQTVDAGKIDGQFQVKLLEAGATVDPKVIVFKLQSSSIANASFDQVYTLTYTKACPSSSFVGNGVFKNTLASWGTAGVNYTIQDLGVVNGVGTFKVIGFMDDGSDLTLKYNPDTYVVTTPEQSLGSAANGGINYMKDAADGSKSSFNACTRILKLRVNYFVKNPTTGASLGSYGDYDETFTGQ

SEQ ID NO: 1010 - protein, 512 aa, Chryseobacterium sp.
MKKVLYILSFFLVLTSCNDALEIVQDGEINDANVAFQSVDDMQKFLNGSVYPAVNPTNEIFFTSLFTDEVGFGPSSVSTSDILTHRFVLNSTTSQVSGIWVSNYNIINKVNILLEGSALIDYNSLSPANKALYTGILVNARAVRAYAYITLESYFSTNMKDPNALGVMLSTKPADIFNTKLPRVKNSEVFALIESDLQYALTNFNSSVVSTGVSAQHYFDKKASINAIAARYYNYKGDNVNAKLNAEAAINTSGLALTPSSSYSAMWADTARGEILWSLYRPNSSTGSWSNIAGLWTTNSTDLNGSVNYDMGRKLFSTINNQLSNSGAGDIRRDVYVDATSIFDAFYPNGANAREDDVIVINKYPGKSGTLASSLMQIRNDIKMFRLSEMYFILAEVAANQGDWVTAADNINKVRKARSKNGASPLPVYTGAQQAYADILLERRRELCLEGHRYLDLKRMGVAAGVGVDRDVYDDDNKTLPLTLPASDYRFTLPIPLDEINANPNIQQNPGY

SEQ ID NO: 1011 - protein, 457 aa, Chryseobacterium sp.
MYNVLIRPLQKEDALISYQWRNDPEVWKFTGSRPDIEITEEIESEWIVKALQDEKSKRFAILCDSEYIGNVHLNNIENNTAEFHIFIGNKDFWGKGISQLATYQILYYAKEVLKLSEIYLYVKPENIAAVESYKRNNFVVIEENLGNVKMSLQLSQLKKTTVSIFVMVYNHGQYLKDCLDSLLEQKTNFNYDIVVGEDCSKDNSREILLNYQKLYPGKFKLLLHPNNIGAVDNQNITYENCSGKYIAICEGDDYWIDALKLQKQIDFLEKNPEYSLTFHKIKEITTREERYSYDNPNEEKTYTLEDLSKENFIVTVSVVFRKNFEKLPEWMKYSPIGDYPLHLLNASFGLIKYFPEEMAIYRVGSGIWSTQNIVDQIVNTMFSLKFLLQHFKNNKPVYDNLKIQYGNFKTALKKPFEEKRELELKIKDYNYLERNISTNYLLKMLKIKILKKLKFNF

SEQ ID NO: 1012 - protein, 308 aa, Chryseobacterium sp.
MIFPKAKKIARDLAWHKTDNGVFGLYKGYFFNVSDASLMSSPQYKFVTATTGNLTEGQKQQIVTELVKNKKKLKFTGLEIRDTTIFFQFVENLIPTKLKTVYSLLDFLSDLFKKLNIPEQNKCHSCGTDQKISYYNLGDNGVIFCDSCFHQTNNKFYEIEKERISKEKGYLTGFLGTLIFSIPGIILWVLLAIYVGKLASGMAFILAFFAFMGYNLLKGREGTLKKYIIFLTNIVSIIIANVITVLALLLKQGSTIKQAISELQTSESVKEVFYANMVFSFVLALGAWIWILFIMKDDKLSIKPAEKF

SEQ ID NO: 1013 - protein, 250 aa, Chryseobacterium sp.
MEKALSQFLDQWRSKKYVIGILLTGSHAVGLQTDNSDIDIRIIFDSSKNKTLKGLEIIDNHKFSYLGRNIESIKKKFNNEFLNRQKFEAYIFNVGKILYDRKNVMSGLKELAQVYVSTPLLKKTHIKSEVKAGLYGLYNHKNHILSLDESSPFFSYHYYIFLKKILFYYSSYLGYETFLDTKTEKVLCDLTYREHYHWPEFPDKKFTEQWIYSINPENINKNSLINIYHYIENKIEKINEEKFSMQWNEH

SEQ ID NO: 1014 - protein, 79 aa, Chryseobacterium sp.
MQKKKLALKKTKISKLNITILDKSKKANIRGGDVVQPDTHPTPVYGGDGGSAHGAWYHESYDAQTNSIHGPTCYYDCGS

SEQ ID NO: 1015 - protein, 78 aa, Chryseobacterium sp.
MKKKLTLKKTKISNLNVSILSRNLQGHIKGGDVVQPNTHPTPVIGTENASGQGYWQHASYDTQGNPIHSEECYYVCVS

SEQ ID NO: 1016 - protein, 295 aa, Chryseobacterium sp.
MKDKIQRIFTPGDQWLYYNIFCGYNTSDDILINYLSPLTQSFLSRNIIDQWFFIRYNDPSYHIRYRVRIKNIAYIGEIIHTINNVLEQLLKDEYISKLQIDSYIREIERYGYNTIENAENIFFHDSNNILKIIASLDENKPNIRSLWGLKLVDFYLSTFRFSISEKVLFSEKLRNYFYNEFKVDKNTKKNLDRLYSDYQTSIHSFISNKDRKIYKSEIIKDVAKIVAIKEKNLLRVDFDSLISSFIHMSLNRLFVGDNRLHELVTYDLMWRYYKKEFYFSNHTTTHGTESKRILS

SEQ ID NO: 1017 - protein, 302 aa, Chryseobacterium sp.
MEQNQRESYLSIVDALKKISFAYPFLGLNGRCGGAIFLFKLSQKLNNTEVYDLAIELIEQELNEINIIENLSLYNGLCGIAWTVQYLSDEDFIDLNEDSFIQYMEKHFIQFKDNNHEIKNLYQFQTFIDLLFYFSSRYISVTKKKEKVKYAGLLNQILIILTHQFYKIQTFEKLNNLSHQNLYSLLQTLIYLIDIDFQSPLIKPLIKISVKQTEKNREIENINSYPKYILQKATLYTSKARLSVAKMPLIKGSIQNDKKKELNNNMGIWDNSIVHDAIKNICSQKYKKDLGLHYILECQYNS

SEQ ID NO: 1018 - protein, 139 aa, Chryseobacterium sp.
MKNIILLVMIALIPFSCFSQETPKKDKEQHEMKPSKNEDGEWDLTVIDTQFDYFLSAVAKPISQYSESYLKTKNTFLVNEWNSYYYSSRYRNIIESGIDYDPKENYGIKFEYKLYQVFVYVNWKYKLRLNGLSGSDAIR

SEQ ID NO: 1019 - protein, 124 aa, Chryseobacterium sp.
MNTDNNYNQMLAQKTKSLTIAIINELSEISYSDKISNISKQVFRSVSSTASNYRAMCRARSIKEKYSKICIVVEEADETLFWLELIDELHLLKKEKLGILINEATEILKVTSAYKKKLSEELKR

SEQ ID NO: 1020 - protein, 34 aa, Chryseobacterium sp.
MKTMQGFFYSLKLKKAAIFGCFKHNELYIPLERD

SEQ ID NO: 1021 - protein, 159 aa, Chryseobacterium sp.
MKNIIKGFSLALVVTTVGFMNAQHKKNNHVSVTAETSTEFIPAIRLINNPDGSCTFEKGKIPTLKHMNTTTFWMSNKTEEWEKNAHPAPRRQYVITIKGNIRFKVTDGSTFMIKPGVVLLAEDLKGTGHSWDMVKSKEWERLYIPIAENADDFFIPDAQ

SEQ ID NO: 1022 - protein, 139 aa, Chryseobacterium sp.
MERRKFLFRSVQASALLLISGNMFASALPMFNPIKKKKMYFHYLLFWLRKDLSESEVKEFENFFKGLKKLPYQKNLRYGKPAASSPRSVLDSTFTYNASMEFDSLEELEAYGKLPEHLALVQQYKPFFERMLVYDTVYN

SEQ ID NO: 1023 - protein, 442 aa, Chryseobacterium sp.
MKTTSFKTAIALFSLLGLMGKLEAQKKNDFNNPGLTHYFNEDHSRYISFSGYAELWARYTQLNPGSLVNNEAKSDLSDLSLRRVRVKMTYKPTEKLMFVLQGGTTNVNVNAKGSNYFDLLDAYAEYAFNDKIAFGAGRSTWRGLSRFTTGPLNTLLYDLPAYATSNAGTTDYTVRELSAYIKGQLGRFDYRLVVADPYTMATSDPKLNVASFSKNSPGKDFSGYFRYAFLDKENISTPFNSGTYVGKKNVLSLGAGFDYIHNALWHLDSGKNTVNDDMKSFAVDLFYDAPLNKEKGTSISAYGMAMHNDYGPNYIRYVGTNNPATSADVTQASLNGAGNAMPVIGTGNTYYVQLGGTLPYLDKEKKSLQLQPAVGIQLSDLKGLHDNAVIYDAGISLLLNGMSSRLTFDAQNRPVYTNDPSNNAVVSDRKWQFVLKYRIDFN

SEQ ID NO: 1024 - protein, 619 aa, Chryseobacterium sp.
MKNSFTLLFVFISLFLFSQTTMFGPVSGLAFRKNSVKQQVLQTDTLQNRLMNYHLIKDNPSVIFFKKLNTSLNQPTLFMVGNKFGGTENKVYAKIGSSIISTLGIADFPDSLKITNQEINAKILTFTKKDVNKRINPIVFFNKRTDEKVLIPEVLVFDKNLSDVEAQKIETYLAIKYGIMINDVSEKNYISSDDHIVWDSKKNKNYNFRITGIGRDDAFELYQKQSINSNGGNVAVAIDSLKLTNNFNNGTIENGNFLLWGDNNQNLVFKDADLLSQHPKRDMLRVWKVQNKTIDNKIIKANIYAVLPVQPPGNFIKLRLFQNETDYQNDLSTDITGKKINDTLYVFKDILWDINKDGNDYFTFSLDDIQSNINIQMISTCEDLGNNLIKISVPGSILPFEYSLESLTTNQMIANNLQGTNSQIIFNNLNPDHYKLILKKQGYNDIIRTFDLQGIVNQNIDTNYLWQGTPIELDLNTSSFQYVLTNPNGQNTTAAPYFLNGVGNYELKIKNKLGCEIIKNLSVLNAADYDALQNNSLFKKIQVSPNPSRDGNIIIKVELKSAKPLAVKIFNGLGILVKQGEYSSASEFTIPMSIAPVAGYYSIKIFIPEEGKSVNFIIY

SEQ ID NO: 1025 - protein, 3477 aa, Chryseobacterium sp.
MRKRSFFNIKNIDLLPVCIPIILSLCSWTLYEVSHKDDKIRIIANQNFSPFKINCDFLKPFSGGKKTNYLDSGNGLSDSSSVALNKNSSINKDFLFPPQKNIFYNKTSINSEYIGEIGNKDTKSWDADPSDNIFNVKLSDIKKNTSYTLTYEVDGYSDINSVTRSINGSFAVGGYIKVKQSGWTEIKENIDPTLLKTGNNFILFNTLNKGDYYKIKNVRISENGIADQKPYQVISQIYQDKTLYIRGFVNPTSSIDAVEIANKRIELHGNEFEYLSLTENNEPSINVKFIGKNNSLHAETIFKDNKNIVSTIDIYKESGRNVIFSNESGVVFGLRNIDLPPVDQSISNVSADYYGFRFKNNSLKETIIHLPYDESKLPNGYHENDITTFTFDYTHKKWMPVSVDSINSEKKYVVFKALASGAADYINGVVKQPESPESNASASTSFNNAPVANPASKINLISPPSANQQGSAVVQYPIEIPKGTSGLQPSVVITYNSDNKSGWAGTGWDIPVETIDIDTRWGIPAFDPLKESEIYTIGGEQLVFKDDYLPNKVQFQENRSAGDRKFYYRTGVTEGLLITRKGSTPSSYTWEILDKEGVRKEYNEFLTDNTSSNSSGNRISWYLTKVTDRYGNTIVYNYTDSFEGGGKGKYLSSITYSNNTVISFDNESGVRQDRAFTYKFGVKLTEAKILNKITVSRANTKIREYQLSNTTIGQFGKRLLTEIIQKDGNGNEFNRHKFSYSTARIFEDPPKTYNTGNDIGNVGPFNGGNASAISGDFSDNINKIRGSLTFGSGSGCFFIGFNKKNTFGINASYSENKTYGKGQLMDIDGDGLPDKVFYGGNGKLWFRKNSMSGFGSVSSSVNWPAGTPLSKTSSYIGSAGLEFVYKHYAAGVNVNWTNNNTPVYFSDVNGDGLPDLISYGDVYFSRIRNGVPEFEPQQDGGPNVTETTPNVILSGVPAVQVIEPGQTGPQLLGNIVRMWEAPVDGKIRVTTNAQLEQNSTDGVDVWMELGGMTKDYEDNPAYVPPHSTMIGSKVTLTSPGQPISISETVDVKKGQRIFVVASAKENPIKDRIVTNTEISYFSSNPTVIPKDANGNYYYGFNSSESYLASSKKGNPVADKATVKISWGGLTNQVFTDDVNFKIYKIVVPKTDTTGFIQPSTSNLIYHYKLPKGATLNTLTTTSNLVSGVDLSNILVNQVVSDSTVTFFNFDVSADTNVSWEKIKWKPQIEVTTATDVLLSNALVQYNPYGERLTNNLPKDFTQYAIFSECRFLLYPKFTSDVSQPLTINLPTLHNTTVTFSLKLKNAGGDIPFFAKNTVNVVNNVMEIPKLNFCDIFGVNGVPGMPYDQLWQHLFYFEITSPDYEVAKKLAQLNPNIYNSWFEQPPQPSSLADTGHKADYFAYRANNIHYNISTGLVYQGWGGFSYNGSKYKNETIRESEFNSSMAGFNVNMQNPSIPCSGDPTSQAYQDCVMDYITQMMNSRYFTPIDLKIDAETYSSPLESAELDQYHLQPALLGTFTEPDTESQYPGYSVPNPRGIIKYSKGTGVNMYGSAFIIGGNAGFSKDYTKDHFIDFNGDRYPDVVSGNSIQTTNLLGQLGSPGNTFEREMYNTTTNFGLSLGVPVPTKFSNTLNGGFKSGGEKGTHTTTSANAVGIGLNVQLGQAKSKSKAVWFDINGDGLLDFVSDGTLYINNGKTFINEAHNWNVSDLSNNNSSSLSGGGGFSWPNGSLSIGVGLAQSRSTTNTAFIDLNGDGMEDKIVRSGSTYEMLINTGTTFTNDMMSQDFELENKQNSSGFNLYGTLCFCLGIKVCLGLGYNKDKSVSKQTVDLRDFDADGLPDLLISDDESNLKVYHNSLGKANLLIGITNPLKGTMALEYDLYNTKNNFGSLIGGTYQMPFSKLALTKVTISDLASKNTIAQGIPRIIPKSQVTFEYEKGIQDRREREFLGFGIVKTKTYGGAEGQAFTLHQTHVTEYETNFNSSDFFVNYNDTKVRQYFYKKGLVRSSYLLDANGKKRSETNFTYRYFDQLSNTGYQLSEGQAEPQYKDIGRIIPLLYKTETITTEVVGSTSHSKTLISTIDQYDKYGNVTSYTDRGTTLATVSDDISVKTEYHDPGAKNIVGVPSKNTVTAGSITRVTTSKVDANRNVINVSKTINGQPAEFDMEYDAYGNLLKVTEPISANNQRFSKTFEYDPTYHAYMIKVTDSYNLSSSTQYDANYLLGVPTVITDANGVSSNYNYDSFGRVTQYKSPVDNDWTIKFYYYPNEIVPVAITERKAPVVNDVTPALNYFSSLFTTVWGEELAVKKLFKNSGTQFSYANNVFQLKDNLGRPVKTILRDKVTTSTNASTIIPSLKTYDDYTNSEDLVAKIFVSTTYDNMDRPLRVTQNNVQTNNGLENLATEYKYGFGPDRDGVTQFMSTTISPLGNTSVVYTDERGRTTSSKQTDGTQNLWVSNKYDILSQLVQVKDQNNDITTYQYDNWGRKTKVIQPDAGEMNYSYDRTGKLTSSDNALLLAAGQSVTYSYDYNRLMRIDFAPNDFVRYEYGIAGASDFSAGRLVSQLDKTGFQTFKYTALGQVRENTRVIVAPNNTPKLFKTSFVYDVYNRINKITYPDAEEVFYNYNEAGLLKNIYSKSPVNQPLVPIVSAITYDNRDQMVSFAAGNTTQSNYNYDAWGRLAELSLFYNNTGAQIRRNQYTFDKNGNVLNVSGTTPMSGSFPASMMTAASQKSYQYDTFGRLKSSKITATGKDYTQYYELDMTYNAVGNIDAKNYRLKSYQNNIACQNPGNLGKDAKYYYNITGHPNAVSRIEYKRNYPFDSPMDCGPGNIFPSDGAEEFTYDVNGNLNKLYNIVGGKAELHRHLFWSESNNLKAVGERGVLSHYVYDAGGERVLKSDGVSKKMYVNGNDPEKTTQMGSYTYYPSGFMVLGEKSMSKHYYIGGQRIATRVSAMPSHRFKIEENGTYSGLRHVLEEEVKGIAVQAQYPQIVWVPTADTQGTYTPPSNTLVNEPDCAYVIEQLIINFSQDNDKELCYKNFLDKYNEVLNNGGSFCALLDEITNSNPDGCLTGETIPEILSSEMYWIHPDHLGSSSVLTNSISKITNWYEYMPFGESLMELSNNEYGNPYKYNGKEFDSQTGWYYYGARYYDPQRSFWLSVDPLVEITMSPYAYTWNDPVNYTDPTGMMGERIGEPGGPNTNKVYDGGVIEEIVLKGKKLNWLQRVGRFLGFGNSPSRNATAGEIKSSNKLPWYLNNSKYGGKPVLTLGAHNIEFPYIEREEYGNNIFENGDAFLKNTAGAMYNGLASTWNDGMAGKEGCSFMYEGDSDIESTVRHISRGNINAIEMEGIAAAVIFHKVGEFGELRGSGPVPGVLEVSDRVKSVGQFKNYFPKEGTMIEFVFDADSNTFVVGKPHGREAGASPHQRLVLSLNKKGNYVGGMFKRQGNTIITDEYSGHYGHKWNDQIRKQFVNYMEQKTGLKVNHTIWK

SEQ ID NO: 1026 - protein, 136 aa, Chryseobacterium sp.
MEMRIIYISEINYECYFYDSCWKVVYEGKTINININNFYGYPFYIIFENIETVSKQLTMLINKKNILLSDIFPIELILKDIIDHDQGYWLNLCLYFIIKMECLDSNIIQLLIKTQNNKKLSQELRHKIRKVILLNN

SEQ ID NO: 1027 - protein, 158 aa, Chryseobacterium sp.
METTRKFKQLSVQITLKSIDKEQSDWITFNDKIHTKIIGDDYCRSGIMLLVNELPIMECDLKNSYFLITTDRIISVIDGFYDEVFFIEMNNVSNEYNTENFKQINGKYPKTNIIAVKKNDNTTLIAKIDSYYPAYFAKMLIYNIFSYKKLGKWYVNPK

SEQ ID NO: 1028 - protein, 31 aa, Chryseobacterium sp.
MKIKDVLQAKPDSEFLYEKLVELNEGGVFTH

SEQ ID NO: 1029 - protein, 154 aa, Chryseobacterium sp.
MDYMSWNYRGISFFKEEVIHLNGEDNKEFPSIKDFQQNGVYTSEVRKKLCKYLENCPAIVSTSYRRLNAYTLEPIFSLTYFTDGEFIFTNLLQEYICYDNFVLPQKWYELIKIRNYINDNFELNYEKISSGEIDVFDNFEKSFDDNSIICDVIL

SEQ ID NO: 1030 - protein, 132 aa, Chryseobacterium sp.
MDKFIILKSSWGIAISYEIIEIINHNQNDENENEVSPPVFVRLKENSLDNSSLECLTKGIKSITQFIKIFPVCFSIEKLEYNVCDYQPEGMYYMFRKWFFENHNMELPPINVYYDKETNKYVFPDLINVEEL

SEQ ID NO: 1031 - protein, 1967 aa, Chryseobacterium sp.
MKRFSKIFLLLLVMLSFSMVSAQKYYDTQWKKIAENSTKGAYKSNLPIILDIQKQAMKENNAIELIRSLKAEFSIVNQTVDDDQNDAASQFFKKLKDTEGKLSGEGKLVYKVLLNGFFMDYYNQNLWKINGRTNINSQDVSQIETWSKLDYKNYLTKSFQELDQEKPEMKKILLEKYKDIFSGTNDITYFPTLSDWYALKKVEFLSENNIFTKNELTANRTAINAIYDELIAQNTGNAKLYFMKEKITENCNFNHCKDRLEQLQNLLKTNVEGDYKVVIMGDIMDELVNRKKPKEALAIAAKAKSEYPKSPFIENIKSKEAQIVNPYLTIKYESQTQNNLSIHFVAQYQNVSEFTLNIYEVKDDFTSMLQYVQNPYSDTFGKLKKNLVRKEIFQLPDPKDYQTHKTSLEVKPLPSGLYVAEFTVAVSDMKETDSRENFYFLVSGNRIIYQNKTDRNPLSDELKLVNSENGKPVTNEGLKFYEFVSNKTLNKIDGTTNANGVFKFPSTESKDYYRTFLIQQPKTNDFQIMQVYGNRGYDDDYNPNKQTRSTAQIFIDRGIYRPGQTVYFKVINTRQNKEVEAVISGLKQKITLLNTNNEEVSSQEFMTNEFGSYHGSFILPKGKLNGNFYLRIEGESQGYKNFRVEEYKRPKFEVTFEPVKEEYKYGQTIELKGKAVMFSGVPLSNTTVNYEIKKQNIRWRYFSWYPQNDDNENSILGEAKTNEKGEFTIRLELKKDEKLEGIQIDNYTINASVTDINGETQTADTQLKVASVSHYIQAENISNTFADENVKVKVETKNYNDQNLKKPYQVKLSKLTAPDRIFRDNFKSEVQNLPKYSKEEFISKFPHDLFDKNDEIKNWKTEKVLFEKQQQPSADNTQLDLGKLEAGDYQLELFNIEGKDTIKSAQNFSVWDKKALKPSQKIFLTVIAPKEELSRGEKAKVYVYSAVPDAMVNVFVQDGSGKTVSEVHQMKKGILEYTAEIPKDKSVSSLNLQFQLVAFNDVNTESVSLKIKDTEKALKIETVTFRDKLEPNVKEKWTVKVTGNDKEKINAEVLANMYDMSLDQFAANSFTWRKLYTPFVIVTSYGINNYLQQQNYQKRLRYFEDRYITVPQFNWFDGDFSYILQGEVAGLQNREGVKAPAYALPPSPIAGQAKGIRRKAIAEDKIAVAQNVLPEAMESDADGILDHDDVEKGLDKVAVRQNLNETAFFYPDLKTDVEGNVNFEFISPEALTKWKLMFLAHTKDARAATLEKEVVTQKEFSVTPNYPRFLREGDELNLQSKLSNLTDKKLNGSAELQILDAFTNENISSKFGMSSGVQNFSLTENGSSALTWKLKVPDNVSSVIFKVVAKAGQYSDGEQQAIAVLPNRMLVTDAVPVFVKEGETKTFVLDNLKNNTSTTASNVSNTLELTTNPIWEIMFALPSLKNDQNNSVDVIFNKWFADVLASEIFKANPKMKTVFEEYQNKGLLQSNLEKNQELKQLLLEETPWVLESKNEGEQMQKLALLFDVNTMKNSINQDWEDFKKLQNPDGGFSWYPGYPSSYGTSLYILKNLGKINSWLKDNVKDYQSADQKALVAKLIQYVDNEVNKYFDVKKGNVWNNWAIDYLDTRNYWEKQYPLKGKGATLKTMVKQKAKTAKITDFTFFGLHRAALLMNDYGLKEVSDKLMTYLKETSTDTKTQGVYWKQNLNDWGWFGSKVVNHAGALEAFNLLKANDQSFIEDMKIWLVTQKEVNSWGSSRETAEVIFTILNSGKSWTGAESDKATIVWGGKELNPQTQATGYVKSTLKPEAIDKSLASVTVTKPGPGIVQGGLFWQYYEDLDKIKSSENYISVTKELYKKVKTVNGEELQKISSETPLKVGDKVTVRMILNTDRAMEFIHIKDMRAAGFEPVDVLSGYQWKNNLGYYQSTKDASTNFYIQYMPKGKYVFEYDVVANASGKFSNGITTMQNYYAPQMNAHTKGSNVTISE

SEQ ID NO: 1032 - protein, 159 aa, Chryseobacterium sp.
MMNIQLILFTVILGTSATSCIHRNNSENNTKNITTTVQQQKIEKIEKIQLVERTRGFSKSIIVTPSSKESNINEEITNTKIAPAEWKTISQLARTIDLPKIAELKSPTTGRHSDQAMIASIIITSDGKEYTSSDFDSGHPPKELEALYNVINGPEKRRQ

SEQ ID NO: 1033 - protein, 55 aa, Chryseobacterium sp.
MPKLIIVPKNKEAEIALYYDKVESEHIIEWNVSNEEFKRLWIEGVFSLINKVFRD

SEQ ID NO: 1034 - protein, 114 aa, Chryseobacterium sp.
MLSLDFHLLPKHMGRFLFHTLIIFCINFLYFLLVYYNVFKLDRFINVSKVKNSVTVMENMMIIVYLIPVSLSYMYYVIFIYRRENLFFKLSFFVLAFALSQQPYSYWIKIILGK

SEQ ID NO: 1035 - protein, 64 aa, Chryseobacterium sp.
MKRGLKILQFICIISTLFFGLYLLIALSSSHNIPFQTYLGIGISILLSIVFYFLIEFIKRRKGF

SEQ ID NO: 1036 - protein, 356 aa, Chryseobacterium sp.
MKVRKVFGTETTDYLDGFQYTDSVLKFFPTAEGYFNVETGKYVYNYTDHLGNTRLSYAKNGAGTEIIEESNYYPFGLKHEGYNVLTGNPAYKYKYQGQELQESGWYSFKWRNYMSDLGRFFNFDPLSEKFQYNSIYAFQENKMGLGKELEGAELLQERGLITSIGMTEYDVYTKEQLQDYMSYLNYKPSTPDPELMTAEEYPTNSVAKGAENSSSFKGVIGILELYNVVNKGIEGVKGMVATDKNVKAVNYMDKLTGEFKDMKTALSVVNKADLKLDNKTITEITNYIFDGSLPKDINKRNNSVVSLQSKTNIVNTANTIMRKNGIIVRNGPEVKKRTELNEAARQQKEKLKKVGQ

SEQ ID NO: 1037 - protein, 143 aa, Chryseobacterium sp.
MRMWLLIILFSVISTSCNNNTLAERKIKKTVITFLDAVEKKDGNKYKSLIYESEVYPGVISMEKKFFYKNYKKINSDVNLKENIKIKDTIFNGAKRKYVQYRIKNNNADYFQKPLIITFIFYDQIGYDKIYNHSIFDNMLDWE

SEQ ID NO: 1038 - protein, 364 aa, Chryseobacterium sp.
MKVRKVFGTETTDYLDGFQYTNSVLKFFPTAEGYFNVETGKYVYNYTDHLGNTRLSYAKSGAGTEIIEESNYYPFGLKHEGYNVLTGNPAYKYKYNGKELQETGMYDYGARMYMPDIGRWGVVDPLAEKHPELNPMMYAANNPMMFIDPDGRDWTITESYDKKTNTTHYQLSFTGAVLNSSSNKKIDMKKFAKAIQSQTEEIFNKLGTNPYITVSANIDIRAIDSKDDLKNNDTLIEIKDSTAPEFDAFKNGKKANAYTLNGKEISVNADYASDAIDGKNIKFIPHEIGHSAGLHHPIAEAKASNGGFLDLNYYYPAWDVPKNNFMFQGNMKVSGLTVNQLRRMNRLYKAGKLNKKTINPAYEK

SEQ ID NO: 1039 - protein, 103 aa, Chryseobacterium sp.
MVLPKERMYVELIDYYPAVSKNQSNFYIVKNIHNNDTIFVVDINNLPVYDFIKNYEGVNNSTITLEKGNYVNKKKEYIIRIPVKYNKINSKKTYLGELINLVD

SEQ ID NO: 1040 - protein, 47 aa, Chryseobacterium sp.
MKNLRKLSKRELKTVQGGIPMCLAGYFWCSLEKKCIPVGAPCGLIID

SEQ ID NO: 1041 - protein, 126 aa, Chryseobacterium sp.
MIVIHGGHFSSLDGFYEEASSVLMKDVDWKVGTLDGFDDILYGGFGVFENKEEIEIIWKESQKSKEDLGFAATHEFYENKIRQGQPFNIKLIQQKLSELEEGKGQTLFDILVEIIGSHSNITLTLE

SEQ ID NO: 1042 - protein, 276 aa, Chryseobacterium sp.
MKKIITLGLVACSLLGYSQKNAKIYYEQKNDTIAYYADNTEIYPISITFSEQPQLENLKSPESFKMIRVLPPKSMKKRIAYFVINDKKKGWKVKKMPYYTLAGDATIKEFDTSYQYDLPFKKGKSFNVYQGYNGVFSHQNENSLDFVMPEGTEITAAREGKVIDVIQNNNTGCPTISCANLANYISILHSDGTIAQYFHLKESGAKVKVGDEIKKGELIGLSGNTGWTNGPHLHFQCFLPDPSKPKQKNTIKTLFKTGNGTKSEYLVEKKTYSKEY

SEQ ID NO: 1043 - protein, 30 aa, Chryseobacterium sp.
MLSYNQNNGLLDSIFYYEKTQSFIFSDGLY

SEQ ID NO: 1044 - protein, 296 aa, Chryseobacterium sp.
MKVFISWSGEVSRQIGEAIKDWLPAVLQNVKPYFTPKDIEKGSRWNADISKELEHSRLGIFIYTKDNLDSQWMLFEAGAISKTLDNSKVCPILFGLDNSDFKGPLTQFQTSQFNKVDFKKLVKTINNSLSENKLEDKVFDDVFEMWWPKLEVKVTKILEENKVVNEALRDDRELLEEILALSRITAKRTTTNVKNQNLIKKYNIEIFENLVSNFISATEAIFEWDWEHTKSCIENGNLKHFVNDRGNFLNPDVMDEGNNWGNRPSYLESYRKLRDFIDENNLRKHPFIEIDDDFPF

SEQ ID NO: 1045 - protein, 280 aa, Chryseobacterium sp.
MKVNFLDKNIRNKFWIYFSVISGILSFILLFNIVHDEYKDYLRYSGYILFVVLILIYLIIWCKANKLTDINIDIDGSTVNIKCGDLFSEPGLKTIPFNEFFDTIVDDKIISNSSLNGIFINRFFQNKIADLDNFLINNSDNSDIVDSQYRRASGGKNVKFKLSTIFVYQDFIITAFSKFDEHNRATLTMPEYIEFLINFWDRVNRVYAQKNVSVPIFGSGITRIKEHKNIGDEDLLKIMLWTFRLSEMKFAYPAKLTIVIHEKKIGQINLFNLKSMELGL

SEQ ID NO: 1046 - protein, 188 aa, Chryseobacterium sp.
MSKTNNYCAFYVSEPFNESSLGAHATKDFCYYNMLKAWKGADSTFPFNNAHDTTYNVRDNSDWESTLKPRLRERLRNSKNIILYLSNNTINSRALREEIDYGINNLELPIIVIYPDFKNKEDVLNYSKTELNSTVISLWDKLPIFRDSKFKIPALHIPLNKEIIRKALNDTDLRVGSKIKNGDYFYKL

SEQ ID NO: 1047 - protein, 132 aa, Chryseobacterium sp.
MQKEKLRNARKVKGITQQQIADIIATDVSNYSRKESGDVSIRKDEWEKIARFLDVPVEDIYEEEDAKQINNFENNTNSNNIGTLSNNEIGTVSGNYYCNIPEFLLENQRDYIEHLKKENQRLQEEIKALKNQ

SEQ ID NO: 1048 - protein, 132 aa, Chryseobacterium sp.
MEQKIHQGRNVKRFREMLGIKQEALALDLGDDWNQKKISLLEQKETIEDPLLQKISEVLKIPVEAFQNFDEEQAINIIASNFHDNATGVIVNNYNPIDKIIQLHEEKIALYERMLKEKDDMMTRLEGLIKSK

SEQ ID NO: 1049 - protein, 827 aa, Chryseobacterium sp.
MKSGLYITTGLLISIFSFAQKGGKYKLWYDKPAKQWVEALPVGNGNMAAMVYGDPYQEKLQLNEGTFWSGGPSRNDNPDAPKVLDSIRYYLFNGNYKRAQILADKGLTAKTVHGSAFQNIGDFTLDMDNLKDIRNYYRELDIEKAIATTTFTSGGINFKREVFASIPDHVIVIKLSSDHKNALNFTAKFNRELKKNIKAIDATTLQMDGVSSTLDDIQGQVKFNALAKLMTKGGKTQISKSGISVSNAHEVMILISIATNFTDYKNLNTDEIVKSKKYIEAAAHKNFKTLVQNHLSAYQNYFKRVDLNLGTSEAAKNPTDVRIKNFATGYDPELISLYYQFGRYLLISSSQPGGQPANLQGIWNNSNKPAWDSKYTININTEMNYWPAEKTNLPEMHEPLIRMIKDLSETGRETAKTMYNSRGWVAHHNTDIWRITGVVDFANAGMWPMGGAWLSQHLWEKYLYSGDKNYLRTIYPVLKSAAQFYENFLIEEPAHHWLVASPSMSPENIPQGHQGSALAAGNTMDNQLMFDLFTKTKKAAQILNTDSDKIQVWNTIISKLPPMKIGSYGQLQEWMEDLDDPKDNHRHISHLYGLFPSNQISPFTTPELLDASRTVLVHRGDVSTGWSMGWKVNLWAKLLDGNHANKLIKDQLTLVEKDGWGSKGGTYPNLFDAHPPFQIDGNFGCTSGITEMLLQTQNGFIDILPALPDEWKNGSISGLKAYGGFEVSVIWENNKAKEITIKSGLGGNCRIRLPNGMQLSGNAKLKKAEGKNPNSLFEIPETPKPLISDKAKLNPVEIKTDLIYDFPTEAGKVYTLRWSDKSFEGTI

SEQ ID NO: 1050 - protein, 572 aa, Chryseobacterium sp.
MKKSLMNPVFLRNKTNVIAVAALLSISNLSAQTFSNFNYRGNDKIYNDNPLKPDEFYSPILQGCYPDPSITKKGDDYYLVNSSFSMFPGVPIFTSKDLVNWKQVGHVLDRPSQLKVEKGGVSHGIYAPDIKYNKHNDTFYMITTQIAGGIGNMVVKTKDPAKGWSEVQKLNFDGIDPAIFFDDDGKAYIVHNDAPPQGTEQYQGHRVIKMWDYDLEKDQVVAGSDRIIVNGGVDLSQKPIWIEGPHLYKYKGKYYLMCAEGGTGGNHSEVIFMADSPKGPFVPAKNNPILTQRYFPKDRKEKVDWAGHADLVEGPNGQWYGVFLAIRPNVNNRVTKGRETFILPVDWSGTYPVFQNGLVPMRPKLKMPQGVQNQTGQNGFFPNGNFTYNDKLTDKNLDFRWIAMRGPRENFITATKNGVKVNPMETNIKALAPISSLFHRLQHEDFETSVTLDYKPKSEKELAGITLYQSETFNYVFGITKKDKDFYIVLERTEKGQSKLIASEKISLSKSIKFQATGEKDEISFNYSLDGKNFKNLGGPVSGDILSTDVAGGFTGSLIGLYSTSSNDIVPN

SEQ ID NO: 1051 - protein, 684 aa, Chryseobacterium sp.
MSYINISVTILKMFRFKLFIFSFLIAGYCLNAQSTVWLDQLDLSVVTQGHGKPGINTSVDGKPITIAGEVFKRGFGTHAESSLLITLNGKVKKFSALVGIDDEIKGQNPAVEFEIYGDHKKLWSSGIMHLGDKAKPVSVLLEGVKQLELVVTDGGNGPYYDHADWADAKFETAGGAKLTTFNPISAVPYILTPKPAATPKINSAGVYGVRPGSPFLFRVAATGDRAMTFTAKNLPKGLTIDSETGIITGKIDFKGSYEVTLNAKNAKGSASKKLKIECGDRIAITPTMGWNSWNCFGHEVSADKVKRAADALIKSGLINHGWNYINIDDSWQYNRDGKDPSFQGKMRDENGYILTNSKFPDMKGLADYIHNNGLKMGIYSSPGPWTCGGCAGSYGYEKQDAESYAKWGVDYLKYDWCSYGGVIDGLPDNDPNKVSSLAFEGGGDPDKGVKPFKLMGSLLKQQPRDIVYNLCQYGMGEVWKWGDEVNAQSWRTTNDITDTWSSVKNIALAQDKAAPFAKPGNRNDPDMLVVGVVGWGNPHQSRLKPDEQYLHMSLWSIFSAPLLIGCDLEKLDDFTLNLLTNDEVIAVNQDVLGKQGICLQTISELRIYVKELEDGGKAVAFANFGREKVTLSYKDFKKLGISGVQTVRDLWRQKDIAEINTDKKGLSLDIPAHGVAYYKFISLK

SEQ ID NO: 1052 - protein, 645 aa, Chryseobacterium sp.
MRKKVLYIVFSLFLISKSFAQVAEISSPDGYLKLQVFSEEGKASYNVILQGKAMLEKSPLGLVTSESDFSKNLKFLDSKKDIISKKYTNEKIKKSEIDYKANTLSVNFINADQHQIGIEFQVSNNNIAFRYNIPSMKERLSVVVQSETTGYRFPSQTTTFLSPMMKPMTGFARTAPSYESGYKADAELGISSDYGYVFPGLFHIGNEGWVLLSETGVNSSYCASHLETTAEKNLYKVAYPNIAENNGFGSTGAAVSLPGKTPWRTITVGNSLKPVVETTIPFDVVDPMYEPSQEYQFGKSTWSWILWQDNSMNYDDQVKFIDLAAALKYQFILMDALWDKNIGKDRMKELIQYAKSKNVGVLLWYNSNGAANDAPMGPRNKMNSSVERKKEMKWLKEAGVKGLKVDFFGGDKQETMRLYEDILSDANDFGLTIIFHGATVPRGWEVMYPNYAGSEAVLASEMLYFSEDVRKQEAFFATLHPFIRNTVGSMEFGGTFLNKYLTKSNRDKNKRHTTDGFQLATAILFQNPVQMFGIMPNNLTDAPEFQLSFMKEIPTLWDETVFIDGYPGKYAVVARRHADQWYVAGVNAEKQSQKLKIKLPMFAAKNLKLINDDAKGNTSEKEVKVNAKGDFTIEIQLQGGFVLKN

SEQ ID NO: 1053 - protein, 145 aa, Chryseobacterium sp.
MKKLLYTFLIFFSGVLLAQKNNTVKFAIYNNVIGTVSMFNLYKSSIEKINVFKTKASLPSHLKKFDYLADNGLVEIIFKKNAGYPDSLSLEMLNEQNNLPKERPVYIDGYQFNDTSTLIYNDMITTIEFKEVNGQQCIHISTLAN

SEQ ID NO: 1054 - protein, 940 aa, Chryseobacterium sp.
MKNILFSLLFLLLSIHISAQRDTEHWFAPYYASTNYTQALYLSTDSTTPFVVTVNSNNLPIGTVTISKGSPQTFVVPISNIEAMVTSEAFTVINKGLYVKGTKPFYCSLRMVSSTPHAEIITSKGKAGLGKEFYVAGTPSTSSLSGYNFTAGILATENNTVVTTTWNGNVTFFGAAPTTHTHTITLNKGQSFIFAGGPGVGGQNLSAFIGAKIVSDKPITLTNGNVNGNFGNNTSSGSDAILDQSVPIERLGSTFAMVRTRSTNADLEGGIIIGTENNTQIFINGSNTPIATINSGEFYRILGNKYVQQGTSGHFNMFISTSKKVYLYQLVSVNNSSATCGFNYIPPLNCFLPRKIEEIGKINEMPTGPGTTSVVTPGTIVKLNILTEAGANVTVNGVSPTAAEGPFPLTGNSSWVTYGIPSIAGNITIISDKAVTAGINGGYRTSGYGGYFAGFSSIPLITKQAGECIPGIVLEVDDSYDTYQWCLNGNPIPGANSNTYTPMVAGNYTVKIAVGTCTPAITPVYKVYTCLTESTKALTVCEGYKTIVPEFTNSTQTYVPSTVTILTPPLHGTVTIDPTGVITYVPNSGYLGTDTIVYKFCGNNPVFTDCERVTLTLTISEKPIVNNAALKSCFLPSNPLLGNFNLTLAGVSLQPGIIKQYYPSLTDANNGTNEILTPANYIAPNGIVYVKVSNANGCYRVAEVTLTVISAIYSDTLKDKIICMEDTTTLDAGPGYTSYEWSTGATTQSIKNVGVGTYWVNLKTRECGIKQTVKVYASENPVISEVNINNNSVILKITAGKAPYKYSMDNINWQNENIFTNIPRGSHTFYVKDSYNCTPVKIEITVLNLINIITPNGDGINDILDYSALANKPNFTFSIYDRYGSKVHEGNKSNGFKWDGTVDGKKVSTANYWFDMSWDEINQKQIPIKYTGWITVKNRN

SEQ ID NO: 1055 - protein, 794 aa, Chryseobacterium sp.
MSKKLITLLAISTIYGLNAQTKAEEALKTFEKKYPQEKIHLLLDKSSYVAGENLWFKSFVFDGYTTSSISTTLFVELYDSNKNQISKKLIPLINGEGSGNISLAGFKEDVYYIRAYTSWMANFNEDFQLIKPIAIYNPSSPQKLIDNPTPWTVTAYPESGTFIDGINTKIAVRLQSNGTAPSEWEGYVIDSDSPDTKITTFKGFDQNIGIFNITPKTGKKYQLIVQDKNGQKQNVILPEVSASGINLQVTSDKDHVKYTIKSKSLSQDSQYYTVLGTINNQLVYKAKINKINNETQYSISNSQLVNGILQLTVFDDKENVILNRLAFVQPQSLQFKQPSLQSVSLKDTPRGKNSFDIPKDANYSNYTVLVLDSNTRSSEEDQSLLSSLWLTGDITSPITNPAQYFTKTRNTDALDALLISEKWKRFEWKSIMTGNYPMIKYQPESYLSYKGKVNIQGKPAPNTEVNLIFGSEPGSRMSQIISDNNGFLTLNNLVFEDSMKFFYQLNSEPKDLNNNYSVYFQPTSNFVPYKKNLPTSSYKLVQRPSDDKPSSEVSRSLTALNAQKVISENITNIEEIKLKGEVKNKTKKLNDELSSPRFKSMNEQVFDFVNDSTMVTSTNILKWLQGRVAGLTIQMQRGSYTASLRGGQVGIYLDEMLVDPSQVDNISTSDIAMVKVIKGFFAGGFGGGNGAIAIYSRRGASSDRIVSSKLRQITLTGYDKEAPFESPDYGNEKFKGVSQDTRSVLYWNSFLEAQPEESSKVQFYNNDDAKKYKVIIIGYDKNNDTPLYYNEVLP

SEQ ID NO: 1056 - protein, 487 aa, Chryseobacterium sp.
MKKNIIKISLAALTMFVSLTSCDRNLDQTSSINEEQNQAMTRPESFRQAMDGAYTALKGVGYYNGDTGNQLIMGDLTTDNLVRTASGRNTNSAASNFEFSSDNSQTTGLYSAAYLVVSRTNFVLSYINNGVLSGTQKTNIEAEARALRAAAHFDIVRAYSQIPTQSAGAKNATGIYYSENYNPSNTTSSRNLTVDQVYDKIIADLLFAVDNITQNDADKGRLSKAAVYGLLSRVNLYRGDYANTIKYGELALGLSPSITTLDNFTRIWKENEGLSRITDGVLFQVSNAPAELNTVGVAYNQSVPSIRSEFVVDYDLYTAYTANDIRKGAYFTTSTYSGQKYNHVTKYAGNGGPANIVPIKYLRSAEVLLNIAEAYYRTGNGAQALVLLNKLRAERYTSFTPGTETGQALLDAILKERRLELAFENDRWYTLKRLGLSVQRSGKGDLFDGTGTPAVAQNLPAGSLKWQWPIPITAIQANPNIKQNDGY

SEQ ID NO: 1057 - protein, 177 aa, Chryseobacterium sp.
MNEEKVITLKPDRKTFEDIYFSGNQGSLLFSPTTKSKTIATIAAAVIVFIVFLFKDLLSKESVGILYFLSFIFLLCAVFLSVSVNKVSRWKKQVNHYLNSLEKCKVYEILFDKNFFTVNIDGEKETSEWKDFEYFDSNHEFISLEGKYSYMFPRKAMSEREYSLLKNILKEKVNINP

SEQ ID NO: 1058 - protein, 92 aa, Chryseobacterium sp.
MARNFTILWIFYKKILIPALLFSLLISFLLPHRFETFGLSFLLILALLHYFIYEVRFKSEYYFYANSGFSRTFLWAGTIVSGIIVKIITLFL

SEQ ID NO: 1059 - protein, 334 aa, Chryseobacterium sp.
MKNEIKSLTGLRGVVALWVAFFHFSFFRNEFIQDIVGKGYVAVDIFFVLSAFLLTVSYSEKFRNLNYKVIEVFYKKRINRIYPVYIISVVFIVLFLEKSSIIGFLINATLVQCFFNPNYLLNIVYWSLSTEWICYLIFPFTLWIILRYKIRSEILIILSLILRWMLPHLPGHLYIGSEMPLKEGESTAYLDLPYGLVSLLRTVSSYFLGIGVALLTPFKTKKENLIIYIVTVIFMSLLFIDKGPLFIPLLSALMIKCLYEGKKNYLKTFLETKTIYFLGNISYSLYIIHYMVKKQNFVIVHNYHLNNLLLLSFSLLMSYFSYMLIERKVKIFKV

SEQ ID NO: 1060 - protein, 393 aa, Chryseobacterium sp.
MKQNYLFIMLCTLVLLFNCKGSDDSISPEDSKIPTGTVEGKVFAKNGTKPIGGAIVFTIDNKNQVYHTYSNADGTFSLTVPEGNTILHIQTGNGLNFRTEIPITVNKNETTTVAGKDSKLNQIAKIAYVEGSYDEIEAIITSLGYTATEISYQDLKNFNTISQYDIIFLNCGSRNPAQTGTNSPGNDLSVFSNLSTFITNGGSIYTSDWAAAYLVGGDKYVSGCSIYGGFLDLTKICFNNTGNSAMYNNCSVTNTAMAAALGFSTLDIQYDMSLWEKIQHYDPNFWEVLVQKGNEPLMIRTNKYVDTTAPKIPVGTSLNKNHMTICHHTANGNNVTITINQNAWSAHQAHGDYVGSCSGTTSSGNIYYTTFHNHASGNIGKTGPILEYVILNL

SEQ ID NO: 1061 - protein, 270 aa, Chryseobacterium sp.
MKQTIGFLFLFMSIIISAQSLTLSDKELKKKLDSIKTEGNLLYSYENASWHAGDLVGSNKRLAENIGSYITYQKNDTIKTSFLNKAGDMIIAELSFKNNQMKPVKENFKERGLNENENILKNIRSTIIPQLSDSKYEVTVPQGYSLNMIIIPFNENYKVYLIPGTAQHGVIPFGNDYLFVSDKKGNIISHKKFHSRLIPAFTSLENGGTVTMSTHSHLVTNPFISATDICTFKLYAPLTSLEEFSILSTALGSYIKYNYKKDNIEVVKNP

SEQ ID NO: 1062 - protein, 268 aa, Chryseobacterium sp.
MRKLLFLGMMGAVLFFNSCSSNDDNEGTNTSEQPQLLLSKVTTIYYDNPSNPETIVSTLSYNNQRQLIKTISEGRTSTFEYDNAGKPSKTTYYKPDGTVDYYSVYTYNGDQLANVKAIYTNSNYNRTATYNYNANGQVISSTLCQNPDCSNPGTDTYVYNGNNISSETSTWGGTITYSNKSDFSYDDKLNPYTNINKYIKIMMGRAYTLSKNNYLVEKISFKNNGVWQQSQTVTYTIQYNSSGLPVQVVGKEADGSLSVQYNYEYITQ

SEQ ID NO: 1063 - protein, 125 aa, Chryseobacterium sp.
MHHSGFHMKTYKAVVTMLILVFSLSPCSVKRNVLDIFDIEFISGLNKVKTTSSFSFSCDMASASSGLSVSKIKVQNQYNKFLSGFTPAVHNSVEEKIFLNIYSGHSTGKSPPKYILFKRLKLNLI

SEQ ID NO: 1064 - protein, 240 aa, Chryseobacterium sp.
MPSLPKWINDTVENVWSSKFKDCTVTRIESITPGLRRIYFESDLQDVQFEPAYAIGIRVSDRDFRNYSPFNFNRETGTFEVIFHVHDDKAVGSQFISRLSTGDSVRILIPRGKRFFEPHARIHFSVGDETSLGSSLSIKEVVEENGLQFICLHELEEASALENLNLYGYHIPKNNTMRMIEALNDFLTEEKEAISDDEVIFYITGNGGRMSLIRKFLKARGISPKCIKSQAYWIEGKKGL

SEQ ID NO: 1065 - protein, 300 aa, Chryseobacterium sp.
MENTIPKSEIRKNIATYLILTLLFCLPVYYMCIRTGKLGGGIISYATIVMWCPAIAALLTCRIRKIPVSSLGWKWGLTKYQIMAYCIPILYSLVPYLIIWISGAGGFYNHQFVAEAGKGMGWDLSDGQTLILYIILMSSFGMVRSVGSALGEEIGWRGLLTPQLAKINSYTFTSLWMGLIWSIYHYPLLLFSNYNTGGPKWLALLCFTVMIFASCFIFTWLRLKSGSLWTGAILHASHNLFIQSIFTPLTLDTGNTNYYIDEFGIALPIATAAVAYFFWRKRKELPERDTEDTSVYSYKV

SEQ ID NO: 1066 - protein, 191 aa, Chryseobacterium sp.
MSKLKVIREQKNLTQEELSEKSKISVRTIQRIESGTEPKGHTLRVLAQVLDIEESELLYTRVQSTNENTGGEETDEEEKGPQINYSYIKIINLSSLIFTLLPPLNIFVPLMLMFTLKQNNSLARQIISVQMIWTVMAPITFMLGIFLKFGKQFTLVLMSLIVLSNVFIILRNAAEIDRNKKLYFRLKFSMI

SEQ ID NO: 1067 - protein, 50 aa, Chryseobacterium sp.
MDSYGMTSVVDRLGEWLILCLEKVVSYTPTYTRPPCHSAGISIILFKSFN

SEQ ID NO: 1068 - protein, 136 aa, Chryseobacterium sp.
MEHKIHQGRNVKRFREMLGIKQEALALDLGDDWNQKKVSLLEQKEIIEDPLLKRISEVLKIPVEAFQNFDEEQAVNIISNTFGENAFSNSFNYGTINFHPIEKIIELHDQKIELYERMLKEKDEMMGRLERLIEKR

SEQ ID NO: 1069 - protein, 129 aa, Chryseobacterium sp.
MPNTGDNFTTTLKQAHLEWGAHRHTSSREIRYGEGYLQIPSTYAYNFEITNDKELTRSQIYTFSTADGFIQNGFLKASGNQARENYAKQFHGNGALKLLGDWFYHIDAQEGDQIKIEFTSPTNILLTKV

SEQ ID NO: 1070 - protein, 433 aa, Chryseobacterium sp.
MSVWDRYSEEQRSEYIQFLQVYGALSNLFRQKKGEDIPHLDSKFQETIFAKIFNCQNVDIGNTPHDVLSVFDDKRIGIGLKTWMASKPSFQKVMQLKRYQKEINKFQDNNEALAYKVSEIKNERMTSDYERLGLSETDNIYHYVTRDKGLFNIHECAYPLIDLSNLQIIDSTSSALTWSDGRKDYKYTYGDSQIWQKFDPSKKDTLLLNRFDIKIIEDPFTFLLQSYLNLTDSIHQSEDDFVEVYLPLYSYRSKEVEEKSGLNAWNAAPKNKGSDTLRPLNEVYIPIPREFHKKFPDFFIEDIFEFENYRNAYQGEKKDKPEVRFRLLLPNGKEIPALVTQSNMKALQSGSNTEYDENGKRFGQSALGQWLLVDVLGLKQRKVVTREWLQMKETDSVRLWRKKNDYSLINIDFAPIGAFEAFMNGEPIPQNEA

SEQ ID NO: 1071 - protein, 194 aa, Chryseobacterium sp.
MGKFLFHYFVTIMKDYIKYLLPYKKSFQTINLTRREVVYLEKLVINHLKVRDINELRDKFEGQAFLDNFLYKSIPIMGLQKHLKNTFIDFENISVDKFLPEIIISDKVVNVVMFGSNLPLIDIDNAYPCIFIHSTENSTLQLCGYASSQIIKDNLLNIKKYGFGSKETIKGNFHGFNHLIAFNNLNELEGLVEA

SEQ ID NO: 1072 - protein, 192 aa, Chryseobacterium sp.
MKQLLLILFSTIITISCKAQIYPLNTSPSDIPDNAYLKDINNELDKYVGLWKGTWNGKTLFLELKKIKSYSSIPGDTHPYYRDEILGERKIINSSGVVEIDRISNFDDQTPEFRGIGINLKNGLQKTLTFSPKNMCRKTATLIITDFTPTQMTLHFEYLPSFYNDVCQHNVYVEQNNDFPMNFPKDIVLTKQ

SEQ ID NO: 1073 - protein, 317 aa, Chryseobacterium sp.
MGTVESCSYQTVDMYFSCYTGDHNQTNESTWGSCNWQSQGGYPAQHLTVVALVCTASTALGDDGTGGGGELGPTTGLGSGTNDGTPTTPTLTLPKNTPCGRIKKSTNNEKFKANITELQKKTGFSYENGYRLGTSQTGTENQLLQNMPGTKQVDVRFFPNTFAIQHTHYDGLYPIFSPGDILQFNKWIVWANGLNNTPTSTSQIPLNELTYTVVTSNGNYLMAFDGTDVVSLPNYTAEQFEELNTKYIDYLSSAVKVTNVSQEVIYDMDKLEKEFLKFMKDKMNMVGFKLFKIDSDGTNIEIYLENGSRKTRQCPKI

SEQ ID NO: 1074 - protein, 58 aa, Chryseobacterium sp.
MSPDLKDSVLDEELEKKLLQFTKSLDGWMPKEIQGLKVDYYQYLTYKIENGKVSEVLP

SEQ ID NO: 1075 - protein, 627 aa, Chryseobacterium sp.
MNPRVLELIKNPKNIQLEDLGLLKEEIHTFPYIQNIRALHLYGVHLYEKENYQKELSTTAAYTTDKKILYQLINGKIRQEPKAEIAEEKKPSKTVERPAQLALKTKSFPIKREEEAAVEKLAEEKEKTSVLPIAHEVKPIYVNGERNRILFEGEENFLNEKNSETIDIESTLESGTLVTQKAEPAAEQPVQESKEEAQAETEEKAGENFTPEIIIDEDQISDEKEVNGNEETHSADVSDAEVSFHGTDSFMPDVKIQANNEETVETVEISQPNVNKHEEEMRRLIEEVEKKMKETKSVSQEEKTEPESIEDHEISFAETQSFHFWSTSDEKPAQIEEEPVQEEIIENPLPVEENTDDKAAVEKEEKMPEVHSAWKPMSVESNVPDSLINKSEKVSAPEIKAPAEEVTPVAEPEAVIEEAQHSEAAEDVKTAAQDEVLQAEETQEESVSTEVIEEEKAESETLKEDVPVMNVSFFGTDISTLKVEEKQEEKKEEPVEKVQEVTMKNTTQSPVDSNVPGFINTWQSWLKIDRKQEIEKEKSVIKEKAIETFIENNPRISQLKEESTYVVKEKNDDISHLMTETLANLYFEQKLYTKAIKAFEILIKKTPEKKEYFESRIQDIKDFRSKN

SEQ ID NO: 1076 - protein, 80 aa, Chryseobacterium sp.
MLKNLKKLNRTNLRGIHGGIDKCDIGPIDCPCKIPPGHSCLGGGGGGTPEPDKGYCPDSQTYILCTETCPNGMSPLCALS

SEQ ID NO: 1077 - protein, 172 aa, Chryseobacterium sp.
MMKYFWSILVAVFALISCKSDDDSLQRIDQVLNIYMRNSAGQDLLNSKKAGSYTGFSVNDIFGAKDNSPVSIPLKMTTDSLFYMEYLAGAKRRRLDSISPDNPGTGNSYYSRMQITFTKSTNASDNVVDTLEVQYRNTPTVFQVSKVLYNRVQVFSKDADAPTSINTVTITK

SEQ ID NO: 1078 - protein, 45 aa, Chryseobacterium sp.
MVFILHFSDKSTGRGSMRKQHLDEEHNYSCQKSFVGKKQVFIENN

SEQ ID NO: 1079 - protein, 350 aa, Chryseobacterium sp.
MNYAFRDLYLNMNKKQIIWLQIIYWGFNFIGTVITPNFFVPDTNRREVHILRVTFFIVKIVTFYISYFFIFPKVFKLEKLYSAVFVFILTLLCFAGMRYALEELILPSTLGFRNYDEGTGLLYYLFDNIYNSSLTTFIAGILWILEKYGVAENDKKQLLIEKKQAELQALKTQINPHFIFNSLNNIYSLVYQKSDKALPAIEELGQLLRYSTKDLEKDTISLDKEIGYIDSLIALEKLRIRNPELLIIEKNIQYPHLKISPMLLVPFVENAFKHGDFRGKGFEMKISDHDEVLHFYLFNYKTQKMKDVVSGIGIQNVKKRLEILYPKHQLEIKDSETEFVVDLKIDLKNE

SEQ ID NO: 1080 - protein, 201 aa, Chryseobacterium sp.
MKKLLLFVLAMTMTVAVTAQKVKIQSGDLKFLKGVETVNVIFDYADMKLLKENYTEEQYIPKRVEELNRKIEGNGDIWKKQWERSKEELWNPKFITIFNKTLEKEGIKMKLKEHAQSPYTLKVNVKWVYPGWDAGIMKQAAKVTTQLVFVETATNKIVCDIDSQEAPGDQWGSNFNNETRIGEGFAKTGKTLAQKIEKEVK

SEQ ID NO: 1081 - protein, 48 aa, Chryseobacterium sp.
MLIGYARVCKFEQNLDLQTDALKNIGIEKFLLIRLVVLNQKNRNLTIY

SEQ ID NO: 1082 - protein, 631 aa, Chryseobacterium sp.
MQKTPNLERLLELIRREDVILFAGAGLSKYAGYPMGAQLQSIFYNSLPASAKEYIEPTRSLADLTDDIFHLYQSNNEVINILKENYAKLPESTFVHDIISSIPHFKTIITTNYDGLFEGAYKENCEVLYNNSHISLANTKKTHIYKIHGHLADSNSIIIRKTDYTNFFSPNSQNSVFWNAVKDKMATNCILFIGYSLEDTNIDFIFTDILKQLGDNKKEVFFIAPSLTQPKKNKLSSYGINFIEGTGEELFPLIFDHINENIFLDLKSNKVSTDSTYKFAKKLGYNVTVGTNTASNFFIEKIEKIDGVLQQKVHFTTKNNKDFISKLKSFMEGKTAEKSFRIPKTELSDFVMHVDNFKLQDLSDMEFLYIMKLPSYEGKIDIIFEDGMSVMDFNVKVYKDIVEGKVVLSFETDVAKGSITFMQGAKGANINYESEINEVIKNPRVLLEYYKSFAKIIEGIRFSFLVNGESVFTKKLIANKIPEDLEFYINYLEKLCKVETLHMIRFKDISRNDINENNYHTLESIIAKAENTLIELPLPPLRAVLDESFDKGFLNINQEEHIMFFGGNAEVKVNVHDKEFNLGYMRSYVFDPFISNMEEIKNKKAKEVLITNKSGKRKVGFYDVYEIPGDN

SEQ ID NO: 1083 - protein, 362 aa, Chryseobacterium sp.
MKFEELLKDKIFELPLHQTTNDNFKTFIITKLKLLLEKVNDLDPGPIYIEKNYISSDFVKEVQGKVIESLILCFEDYYNGNPFKAYEKLHTVFRNDFKDLYAIINQKEYALNESFFRIRLSDKNYLYKRSEMFHIPFELRNKVSTQRFSIPGFPSLYLGRTIYICWEELNRPSIDKIQAIKFKNIKEIKLLDLTPPSKDCTDINELYRFFMTFPIIMCCSVKVKDPMDTFKPEYIIPQLLLQWIRNNDRLDGIQYKSTHITSKIFNENTELINIVLPVKTSGDSGICNRLTSYFESTDVISWNLYEFARGGQIFTYGENDAQIVNRKIPNLEIIDGKKYPYFYSTLGKLEYYLEISQTAPIL

SEQ ID NO: 1084 - protein, 357 aa, Chryseobacterium sp.
MNNVDFSNHSEFKMMFKDEELSKYLFFYSGTIIMLGDEDIQEDEIKQPISLITTDKTGEWKKYKVIDKTLLFNCNLEIEHKTLKFNTKEIKNKDFVRINAYYNANKLGAKFHHRIINVNSVEVIEEKEAPIYKFYIIFFSIVLLFLASSIMADFFPSDKNEMYSSKRLNYKLEPQYTAISNFEPMNKKDSLRAKRHNYNDLYIVNGEKLESDSIFVINRKLNNKKNAFRIKNEYKKIDSTFKDRTSEYDKFRIDLEKQLIKKKDSLYFENDYSISDKTDTIIYGLLKKNLSINKNVKYKINDTISVSFVKKADESTKQIDTAFLIIKIILFLFMVVVNVILIFKVYLLYKYRKVLND

SEQ ID NO: 1085 - protein, 266 aa, Chryseobacterium sp.
MKIPHKLKFILFFLLLSTSFFSQKFSFIYEAKYRTSKEKPENINTENMILDLENNTSIFRDSMSKNADSLKLINKSGGYIMGVENQFYIKKDIINKKIEKIITYLKANYVLPIDEQLNWKIIPEQKTIGKYKSQKAEVSYGGRNWIAWFTTELPFNDGPYIFNGLPGLIISIEDTEHDYSFNLIQVKKGSNWFDIRTKTIKIDWTQYEQLGKSYYNDPWNTKTAKKVIFTDPEGNEKDMNEMIREAQKSILEENNPLELNHKINYK

SEQ ID NO: 1086 - protein, 62 aa, Chryseobacterium sp.
MKKLNGMKNFSSLENKKLNDLSKITGGLMAETSKQWTYETGSGSDTGVYVDNKLVAVITEPA

SEQ ID NO: 1087 - protein, 303 aa, Chryseobacterium sp.
MNYKKICIKISGVILLISFSFLTSCRNNQHDYIAYYNSVNSIDSTYRLKNDTLAAIKKFRKLFRKYQPRNDERMEEYENYIKFSDKYNKNFGGKKSLYKLIPLVAPYWKFKREDKDFFKLYKKYGIDSITVEQKVTEWKKSLNKQLIDSFRIAFIRDQAKDSITGQQSLKNFKKNAELLKWTLNNYGYPSLQKIGLETDDGVLMPMLVYLNHMSQIEDYEYFKTKLVDYVRSGDLPPRDYVEMVERYVQINHLRPVYGVKSTDEEIIKDSANINRNRRLIGLQSFKVRRKITKEFLKNNSSKK

SEQ ID NO: 1088 - protein, 300 aa, Chryseobacterium sp.
MILIISDNNDISTTDVIKWLIVLEKKFIRIHEDEIFEIKIIKKRFFLESSSNRFFLDDISSVWYRRGGLNFKRIRYKNNSININMNETQHWLEDYVKKKLETIKHINKESNSLVNKLLVLEEAEKVGLDVPSYYLAENTDDVILGETIVKTIAGNAMLESFYKNSNGMMFTSVVEEFENEDFFPTFFQEKIEKDFEIRTFYLNGKCWSIAIFSQNDEQTKVDFRNYNYEKRNKNVRYNLPKEIEEKVHQLMQLLDLNCGSLDFMKSGEKYYFLEVNPIGQFGYLSKICNYSLEKEIAEYL

SEQ ID NO: 1089 - protein, 60 aa, Chryseobacterium sp.
MINTFGEKHKLPLTFKNITKFGSRTNVKRNSNTVYFLESKKYRSNFYFREKPFKALTRLL

SEQ ID NO: 1090 - protein, 353 aa, Chryseobacterium sp.
MRYFNLFSNTLITRGAQRILISDLQRETSEVYPLEFYDIIEELKVKSIEEISTLYDDESKEIFSQYLNLLLDKEYGFITENDWDKSFPPISYEYNNPSFINDLFIELSDISILEKLKQSVENLGIKYLVIHSKNYFTVEDIIRIEQTFADSVLSGIEIFSPYHNNIDRNFIEELNVKTIRVYHLTFYNCKKVPFRVKDEYRFILNFIKDNIDISSCGKIDIKYFNTNITKVLEAFNHNSCLHKKIGIDNDGNIKNCPLMPENFGNIHDTSLENVIKNPGFKKYWNITKDQIEICKDCEFRYICTDCRAFTEKTHINKDSLDTSKPLKCGYNPYTGIWEDWSKNPLKQKHYTKL

SEQ ID NO: 1091 - protein, 57 aa, Chryseobacterium sp.
MKKLKKISREKLKGVQGGLKDFCQPGAGDVCAQYGLECGFWYTVQNGQVIESHNACM

SEQ ID NO: 1092 - protein, 265 aa, Chryseobacterium sp.
MKPLLFILLFVANILTAQNITFIYELTLRTDKKNVRHEYYYLDVLGKQSVFRSEKAREADSLMQKNGYWQSRKPTFESIYSFKNLISNTVYKSVTHPAFYDLYYININNKLQWQILSDKMKIGDVECQKAVAEYGGRKWLAWFDGASPLQEGPYIFYGLPGLIVELSDEQKDFDFKLIRIKKSDKNNMFYLRKGKEITWDVYKKLQIDYYSDPFAEIKARNIKTRTGDVNENPVNISFKEMTESIQKQIKEDNTPIELDKAVKYP

SEQ ID NO: 1093 - protein, 60 aa, Chryseobacterium sp.
MIKTTAVSRGFVLLSYFGKEFCSPKSPDFGAYCIGITFVIGSKSGDLCSDKFNFFFNKPV

SEQ ID NO: 1094 - protein, 166 aa, Chryseobacterium sp.
MKLNFFKNYFSTTKQKNKLENINVTENLEDIGFTEEELFECDKHVDFYYTNIVNSLILYTYNVDQLDEMAPILIDPLAELYEELHYAFIPVLFETIFRNKRINESLKDDLLQFKNNVEDIPVEIWDWDFLDEHETWKNIRLEAEMLLNKLNIETRTYNTDYTTILF

SEQ ID NO: 1095 - protein, 281 aa, Chryseobacterium sp.
MIVKSYMNKTVLIVILISITLSSCTSNEDSQEVNMEISANDLSPDKLLKSIVGFDEDEPNPLHDYYQLFTYDSQGRLIKARKDYGYIYPIYTNLSYIENTVVVENKSDDGSSVTPKTIRYVLNSNGKVIEKYIPVPDGGNIYDVRKYYYEYSSDGKLTKITLKYPNITPGTPNYSSLGFLEKVDILIYEGANLKKIVRQNLNDYNENKSTRAEITFFDYDNAKNPFKRLGLLDTFFYRSLSENNYREIKTELYDENNIKWGENGGKWKFSYDQNNNLILKF

SEQ ID NO: 1096 - protein, 145 aa, Chryseobacterium sp.
MKNRIFKYRIVGIVVFLFELFLLFLFGYGTYDSFIEFSIEQIFSVESFIFLFAGSIFISAFLSLILLLLKSKRTILYLNINYILILLFLVLGCIKIFIEKSFEEGDTLKFFSIFSTLSVFLLITNVFKNKRVQFLELDDIGKSED

SEQ ID NO: 1097 - protein, 78 aa, Chryseobacterium sp.
MENPLLQKKNWFQSNTNYNKLVKAVSKGTAFFFMLNRKYEKNKAFLNVMHYLSLFYVFDFLVFIYAAHNLESLFFRFD

SEQ ID NO: 1098 - protein, 126 aa, Chryseobacterium sp.
MTMEKLRTLRKHKGYTQQQIADLLATDVSNYSRKENGDVKIFDDEWEKLAKILDVSVEDIREEKAATVIQNLTFNDSSSNTSNQSGNYNQYCNIPEYLLDNQQEYINLLKEQIKALKEENEKLKKG

SEQ ID NO: 1099 - protein, 31 aa, Chryseobacterium sp.
MDKVELLVESIYNMLFFSIITYLYNVALIAY

SEQ ID NO: 1100 - protein, 340 aa, Chryseobacterium sp.
MSNENFNPLELLHTKFRYPFPTLKNPHADQLQQITETEWIDGEYRWLYQNNPDLRKKYKKTKTAHIAAQWFPTASAERFRPICRLMLWTLYNDDLYEESKPEDIDDVHAQSIAILNGEMSVIQSTIPLASMLATLRQELLQFIPQESMNRFSQMISRYFTGLKKELEYKKDKFFPTVEECIALREDSICLYPFLQLTEVETGVILPSEIHEHPVVRRLQALACHLVTFFNEVQSVKKDEATGSIYYNIVKVIQNEHHLSLEEACLEDLRLHNEDLKEFVTLQASLPDFGPWHEDVVNWVHYMSMVLSGWKNISTKLDRYNKTEFPSASELKETLRYNQFQ

SEQ ID NO: 1101 - protein, 333 aa, Chryseobacterium sp.
MTPEQFNSADYLPRGCYPWPDLINPHAEQMKKDMDGWIDNDYTFLTEKQRKIYKKMELHMCTARMWPHLSYEQAIPCNRFMLQYVALDDQVEHSSLEEIQKLRIRCTDILKGAQAMPEENALYHHMEKIRDEFRAFMPDLWFDRFVYYFYQSFRYGIELEYPYKIAQRPPSLNLYKTIREYSVLMRPYLIFGEIESGLVLPEHIFEHIVVQKMISHMTLVVAWQNDIHSLPKEMAKGTEVFNLVFVLQQEYNLSLEDACAEALRIHNEELASLNGLHQEYKEFGEYQEYVDKFVYYAGVGLQGVNTFYLETNRYKHGGVGFAWPEDHAANKSL

SEQ ID NO: 1102 - protein, 121 aa, Chryseobacterium sp.
MKLTSLRLISKDIKAAVAFYEQVIGIAATWYTEDFAELSTDSITIAIGSTRTMQMFSEGLTDFAGTKSTIIEFLVKDVNEEYERIKEIASEIIQEPTTMPWGNRSLLFCDPDGNMINFFTR

SEQ ID NO: 1103 - protein, 51 aa, Chryseobacterium sp.
MLHQLRTHIEKIIPLNDDEFEFISSCFTYKKYKKHQFLVQEGKRFLTTILY

SEQ ID NO: 1104 - protein, 87 aa, Chryseobacterium sp.
MLTGSASKGKMGIYYNDYHCSSSCGVHFKAETANELLVKQLKYLIPKEGMIGIFIEAFIKNFNVQTKSQNQERTSLLRQIEELKKLY

SEQ ID NO: 1105 - protein, 1306 aa, Chryseobacterium sp.
MEAINQNNSSQTLFRFATMRSAELSDPKNREKRFIFRNYLRQKGVIDPRVEAGESLKNVCEKITGLTIETEVSLKAKSIQFYELSVWVAKNKVKATKEEFDAKIKAYRETPKPIIEIDSNIWDNLIYQVVTQKDFYAKETLMQFLHLDHILSNYYGITQAEYEDVINAKVVLPKELFSAKSASSNRAVSREKSIIQSIPFNDSALKFAEATVNLKGNEELKRTLEQLEKNYQKEYAAAYNTAYKQYQEEVRPEQARYDALVKEQEYQKEIFLAADNREGLSSLKYIPVPEVKAFTFNFRPEIQAEDLQRQLSQGNNESLQRIFGTPDLVSALNKVSTFTELFQTIEQNSQQLQQTILNNTNLTPQVSTTVGGVVIPVTQSVNTEEISFFARTIRWGMGFGSHTMLLTTDINAPKHIISGSYNIKSYDQQILVSGTLAYTYDVPNVTTLFSNGEDIPNDSLEKQEILLLEGEVTLNDGLVYLMKGKLLQTADRIYRFEGSGTFTLKNKETGNCLPVLLRTRSFQNYSDRWLLSMTPQDTTSLFSSASGTINILDNNGNVVQTSNQLQVAGGGDYLSLFSDGILPQLQITDAIKNGCQLEAELTLDDGQIYTCKIPMTIYTAGGIDSVTKTYNLTGEGSVCLKNKDTPTTPEEDQPFIPSGFGMKNIGIADYRKVEQSTYCYVEGDVSHIENIMAREYREKSSRRLKRSESQTTKSTESEKEKLTDTTSTERNEMQSEISKVLQESKDFAAQAGFNASWGGSASPRYMLNTAANYATHSSKEESNRQAVTEAKDVTARALERIVTKVKEERIDKILEEYEENNKHGFDNTKGSNHVVGVYRWVDKVVKNQIFNYGKRMMFEFMIPEPAKLHSLGMKVSNAIENQLVKPIDPRESAGMQIKDWSALTDSTKLKYWLGYYNVEVDEKLEPVVYVGKSIDYSSTESKQASSKSDLIAIPEHYITESYVVQSSNAFPGYNGWGNGASLLVGGNGASNAFLKFVREVPITIATTNAHYFHATVNIKCVLQEEYKNGWLQKAFNKIIEAYKVELSKYETALADAKAVGAQIKGSNPGFYRKIENTILRRNCISYMLNQSPDALLTFGKKRYYTNDNASVETFQNTDIKVDEKLDQYAAFIKFMEQAFEWEIMSYYFYPYYWGERKSWADLYQFDDNDPTFRAFMQSGMARVIVTVRPGFEEAVRHFLATGQIWNGGEVPVIDDPLFLSIVDELHSPKATKEGEPWREKIPTSLTILQAGSIGLKVEKALPCNCEPGVKFDDELGEICGTNFESNDNLLGVESLEGQKVISGDWK

SEQ ID NO: 1106 - protein, 498 aa, Chryseobacterium sp.
MPIIGKIIRVNELPPIGERETNAIYQVAAPGSLSYTDYAVDENGDLKTHAVVDGTIPLELADSHVSISNADLLAEGIASQAKYNIKTREKLAKKLEIPLTDGTVQDYPKIIGLNDNGNVAKLPAGDLGKNIANSSLTSVSGAGLTLGANWTLNASGFYYSITGLSDKSADTTFNRMMVQNPSGQLSWSNGKNMISNYPLLLNDAEKTEWRNRMKLSTENYSTGAPRIDVLLLPFIDNSKNFIQYTTLVGLNLFVDNVSANAYIKVKRVKDVNGINLAVPEEYSVDNFTVMHNFPNNLNFGINWSTKPEGYYKVFVTHNGLTNASSPELIVKAGLTYSKFTGIANWTMLTGSSTITDTSISIAQGSSAQTDNLISISDINAGFMVSFSVNNSQSNFGANFVGPFSGGIRGDDGVFYGFSNYGGDGSWIIYQGDLLPIRNETFHIAYYNGIVYVIAESNGVTYQQFNSTFNLQPRRFYLSRGSGGQGSLTMSVLGKILLS

SEQ ID NO: 1107 - protein, 159 aa, Chryseobacterium sp.
MNKNLIIPENIKEILNSIENTPLHLAELPLQAHPRLPQFERHIRVLDIDAKSKLQFICLRYEQVLKDMETGKEVNIPLPTPEWLIYKETWSYLRDGDNHLIELPVAEPGDDMNTDLVKVPSYQYMLWLLKNNKAGFTELLVSYLDEFVEKHKENLDALS

SEQ ID NO: 1108 - protein, 109 aa, Chryseobacterium sp.
METLELRETSSKEWRKDNIIRLKTYLNKNTEIVDQVQVQYKLKNARLLSDEEYYLELLILDENQTEKFTENMVTKELFPLNELKCLTTKNKENGKTNISTKAIRRLENG

SEQ ID NO: 1109 - protein, 833 aa, Chryseobacterium sp.
MEKLISPQKLLEDWRTDDFINKQFLCSELRRRNTLFNYYILDYDVNNYDWHAEQTSIKDNKENIIRLKTYLSKNTELVDLVQRQNEIEFDIDLNVRKLYFRLKYFFHRNADTEELRRNKAIMLETFSYEEFKNLIQYVGYGDFEKDTSYNYLGYFSKIYEFYFNQASTPEQLIFLYTNTPDFVFERIALDNEKVMQHLITLTEYDDTGFFSGWKDGSSALVNIFKTSSPGYIMNRFKKEPELCNRIYYNLDDISYVDGKPQSNRIIFAGIMRSFAQHHTIKEDAPIFKIKKGYRVNTKVNELSGTILGLFGQSDEETFFLQQQQEQYIEEENYVTDDLGVSTIAKSSTQETIYKDLDEGRQFLPLEMVYLEEEFDGVTTITKVPAIYVKALADAEKWAIINDRLRIAADIAAIILGVGTLATTGNPYLLLAAAADLSLALPDLTIQAFREEIRKLPGGEQFLKDWDLIYGVGGAIVAAPQLIVSVYRGIFVLLPKAAKNVQQGLKASAISLFLDLNAGRFERSSLRLFQQTEWVIPSAGFISKTSECDALIQNGAFFMELDAAAIMESIGKKGGVNPDAIGSISSNRKFALVYKGEIIAQGSRYDKTYQKVLQDIRKVSYSSEKVGEYLETIVNRRRIVSVEDVSLLGKAPEKGVKMLFNLFDEFGNNIGQLTRSPNRNELFYKLIYRGKEIDIKSTIKLLDDKYRLRGLPIEEGEHLLYGDLNIPKEVTDKYAALGQIVYEDGLKYFLNAKKYGKVDGTVSVWIKADIYTDYGGQSINLDQFWKARDAGMSIEQAAFSTFAGKQAKKFGFTRIRILDDEKITRNYVELNFLK

SEQ ID NO: 1110 - protein, 141 aa, Chryseobacterium sp.
MRINIHNTIKGDKTIDEWTRNDEYKGASWRNFAFAEGLALDLFKEKLSKIPFKDEPLNKEETEKLKIILEDKIKELLSTRIPEPDVRTKIEFSGKIIGINFTPLGKNPQDNWINIFFRAYKICEECLEENKPIYLSITGED

SEQ ID NO: 1111 - protein, 136 aa, Chryseobacterium sp.
MFNPTEWVITSAWFISKTSECDALIQNGTFFMEHNAAAIMESIGKKGGVNPDAIGSISSNRKFALVYKGEIIAQGSRYDKAYQKVLQEIKRVSHSSEKVGEILDELVVLKNRTKPSRPKNILQWFVRFYFCLTCCL

SEQ ID NO: 1112 - protein, 553 aa, Chryseobacterium sp.
MAILLIIILFILMLYAFSTSGKFKKESLQKDTQITNLKGENSRLKIEVSKLQLDNNTLNRKIVELSQHNDALRKYQDIIDVKVECDYLLKKAERDSLRLRDKAGQELSSAQLEARELRRNAKESTEKKIREIELLYENAVNEAKRIVDNAELRAESIGGDAYRSLREADQIADRIKAMKNVIEGYGNEYLVPTYTLLDELAEDFSHKEAGDKLKKLRHNNKLMIVSRQAGICDYMDESRRNTAIDFVIDAYNGKVDSILASVKKDNFGILKQKMDDAFQLVNFNGQAFRNARISEVYHSARIEELRWAVVAQELKWQEQEEQRQIREQIREEERARKDYEKAMKEAEKEEQTLKRLIEKAESQVARANEEQKILFQQQLEELQQKLIQAEEKNQRAISMAQQTRTGNVYVISNIGSFGEDVYKIGMTRRLDPLDRVRELGDASVPFEFDVHAMIYAEDAPALEKQLHKKFLKSQLNKINPRKEFFRLNIHDVRSYIDSMGITCKWTMAAEAKQYRETLKLEEDMKTNKQLEAEWEQYQEVTDPVTYDEVLSEE

SEQ ID NO: 1113 - protein, 454 aa, Chryseobacterium sp.
MNNKKAKLDKLTSIVGTERLLPYIGKKYEEQSFSPLAVIFPKTTFEVSEIMKFCYTTNLKVTVRGGGSNVNGGAMSCGGDIILSLEKLNSILEINKIERIVTVEAGVVTEVLQKEVKKYGLCFPQNISSAGMSFIGGNIAIRSGSPKSFKYGTTANYILNLEVVLPDGQVIWTGKNVKKDSSGYNLTQLFTGSEGTLGIITKAVIKLIPLKKEWLFFISFPSISDMYDFINEVLTLGLNPSSIEFLDTKGFELVCNYLKDTRMIVNTGFCIWMEFETEVWQSELPELEVMNQLIGKYSNDNALFAESSREKEELWKYRNKIGEACLDYSEFVDYDFSIPFSVSQEVYEKITAILEEFNFESIIVGHIGDGNFHINVFCDKGLSSEQWESKIYQCFMMITSVIVNFGGSVPGEHGVGYLNKKYFNLSVGEKQIELMNGIKRIFDPKSILNFDKIF

SEQ ID NO: 1114 - protein, 261 aa, Chryseobacterium sp.
MSWALSCLQLRKFYEKVELVTDEKGYDILINKLKLPYTNVSVVLDELNHYHPDLWAVGKLHAYRIQTEPFIHIDSDIYIYKPFPLSLEKASLIVQNFEKGFFFYDKVFNELKEAFDYVPQALHDSIEKNNKIISVNAGLFGGNDIAFFQEYTQSAFEFIDKNIPHLEKIDIGMFNTVYEQFLFNALAEKSNKIISPFISDINPSFDGIANFTQVPNTVSFIHTVGFYKGLPTINEILEHRLLTDFPEYYYEIINLLRTKQL

SEQ ID NO: 1115 - protein, 659 aa, Chryseobacterium sp.
MNTDTADIINIIDEWEKKKLFEFLNQICNKLSLLTVEDFKEQHFKNKNSLTFNAPENICSGYSGVIILMIEFYHLRIISLEKIEKMADNLINYCLQNPSQDYSLFAGRSGVIYTLIQLFEITNNHQYINICLELVQISDLREFINSSYTSDYIFNGRAGTLLTLVNLYLLTKDQELSKYISLIYLKILNNCEVAENGISWKEHEEINIKNSVGFAFGAAGIKYSLLIIYTISQDIGIDYIIKNIDQYINSNWDFKQSNFKNFEKDILNKEMFSKYLTQYIENKELLSFSSFQTEWNQGLLGNLIPWNQNYCYDLSQLEINSFENTSLFNGSSSLGLFYLKQINTNQSFIEPLKEFTKKIIKDIQYNDISGGLFFGELSKVYFLLKLLNNNIDTKNILEPFYDHNIPANDLYFIDIIEVRTIILGHFFKRTLDFLKESLPRILNKYFSSEVKIIPEINNFIEFIENILKNFKGTKIAEQLEDIYLLEKKRYDIKTLDKESNITKYFENFVNKKNSLEFLDHDDSWFLKQSVEISKNVYINQSKWNWTYASDRKFLKENLQKDAESCEYIIMLNEKNELIEYYLGLESIILKTFRQNIQIETGINDLKSYLLSQPYEKLILFSRQSGSKDMDDFLGRLDFLLIQRIRYFIFSGILNYTKKD

SEQ ID NO: 1116 - protein, 217 aa, Chryseobacterium sp.
MKKILLASAIALFAGLNAQTTFGVKAGYALSTLNSDANSVDFGGIGASLESKSGFYIGGLVEHKLNNKFALQGEVEYANLGGKAVVKASGVTVTEKLNFNRIVIPVSARYYATPELGLYAGPYVSFRTNTKAKIEVSGAQSNPSAINEGEKYLENYFDNGLKSTEFGLFLGADYNVYKGLFVDARYSFGLTNMIKNPVDGEKLKMNFFQLGIGYKFK

SEQ ID NO: 1117 - protein, 220 aa, Chryseobacterium sp.
MKKILLMGAVALFGLSNAQIAKGTSYLSGQVGYYHNESNKFETQIKDDVIRILPTAGYFVSNNLAVGLGIGYKSAVTKYYVSGAVIANPYEIKYTDNAFVVAPFVRKYWTLSDKLFLFGQLQVPLEFGQEKLDFNSKGNGGDPILSAPFTEKNNYTNIGVNIKPGLDYFLTKNWSIEATIGEFGYNTYKKDMEGAKRTNDYKFGINLASVTFGVKYVFAK

SEQ ID NO: 1118 - protein, 214 aa, Chryseobacterium sp.
MKKILLAGAVALFGLSNAQIAKGTTYLSGSVGYSQEETNNGNDKKENFNVLPTVGYFVNTNLAIGLGVGYQTEKNTLTSTVGNTVSESVTKQPAFVVAPFVRKYWTLSDKLYFFGQLAVPMQFGKTENETNSVTTVGNTVVTSSTSTEAKYTKIGVTVKPGLDYFLNKNWSIEATIGEFGYSNYKPKDGDATNNYNFGLNLSSVTFGVKYVFAK

SEQ ID NO: 1119 - protein, 206 aa, Chryseobacterium sp.
MDPDYRKYDVTRFFDFTEQDEKLITEIYDLLSLSYDISVIDISESPYEQFSSFDMYPLFIPRICYLVEDVNNNPFYLFIISKVGINFKGGRLDRKYDTIQLWGLKNLKEDFGYISINKKKLMDKIAGIFSSFSVNFKDPDFKDFYVVGSDSFKTMSFLTQKRKEAIKSFPDESFKLEVRNSILSFGIPDILTVKNAEMISKFLNEI

SEQ ID NO: 1120 - protein, 486 aa, Chryseobacterium sp.
MKKLCTFPLVLLSSVVFSQYSISEIPQDGYLKDFDIAVDIIQKQHPNPYRFHSKEVIAKKIDSLRNIVKINPGYISLLMNNPARVIGDGHSSFSADSNYFENILSSLNFFPLQTYVHNGRLFVNGSNPYAIEVGSEIMEINDIHSKELLQAVPKAADGNIKVEDIDVSFYIPFVLKNRTNDFSLQYKTPSGEQKTLKVKGIKYPRFYYESRHSVLPVDLISENAGIYGYTIDSYTYYLSVKSFSYDESFFYERLKKYFQEIKDLKIKKLILDIRNNPGGAISNVPLLYSFIAKDKTFNNEYKYGTKVVDIIYKDYLVDPQTNRYYSDTDIADQNNFMRQRFDKAEKGDYYFGNSRLDNTYIKSYPRDGAFFDGETVLLINNRTFSAATYFASLFQSEKRGAIIGKETGSCSNFTTAAWFLTYRLPHTKSTISIPRTEIFFNNDDKENAANCKGVIPDHTVNTQFFLQSLKEHKDPELEYSLTLFSK

SEQ ID NO: 1121 - protein, 273 aa, Chryseobacterium sp.
MILYKYFPENINSLKALSCKSVWMNSALKMNDPLESLTLISQEYSQEDLNQYRKYIKENEINTKSDWLNYNNEQLIECLNFLRRNILTGLCFSSFSEDYNNILMWSHYASSHTGFCLAFEFSEDLLVENDLIKVKYSDKVDSLNIKSLMCDDNSPYKDLVEMKRDFYNSLTVKSPHWSYEKEWRKWGHPGYEDFDGRAKIVKIYFGYRIDKEFENIVRNILKSVELEDIEIRYMDIMDNSTNLITINEEDYNNNFNKRQRLVEGKYINAKSFI

SEQ ID NO: 1122 - protein, 863 aa, Chryseobacterium sp.; identical to SEQ ID NO: 1

SEQ ID NO: 1123 - protein, 62 aa, Chryseobacterium sp.
MENQISQIGKKLNKKELRTIKGGLINCMEPVLCPTPCEPSSDPYGCTIISPKCAQKECRPEL

SEQ ID NO: 1124 - protein, 63 aa, Chryseobacterium sp.
MKKTELSKAKKLEKKQLKMIHGGLLDCMEAVPCTEFPCETYPPGDIRNCTIFSPSCAQKICRP

SEQ ID NO: 1125 - protein, 52 aa, Chryseobacterium sp.
MKNQNLTHRKKLNKKQLRVITGGKEMCLLPDLTCKKYSFTCAEIRCQPGIEL

SEQ ID NO: 1126 - protein, 186 aa, Chryseobacterium sp.
MKYLFFILTFFAISCNAQIISLEQAAQCLTNPNCPQYNYAKDINNSLDKYTSTWKGTYNGKTYEIQLKKGIYEEIGIRRDNLIGRMKVTDSNGNIIYNTFTEPNDIKTNFDGLNFQPDLKAYRMSFVGNSEFACGEEGIVYLRIKPETPNKMSILMLQDADITWGNCPSSYQPIIPYKTSISLIRQ

SEQ ID NO: 1127 - protein, 203 aa, Chryseobacterium sp.
MVLKPHVLKNKKNLIMKNIFLIITLLTLTISCKAQTYPLRTYGIETYPANSYLKDLNNELPEYEGTWKGTWNNKTIYIILKKIKRNFTHLDNNPYYMDILIGKFKVTDSNGSILFDNTNISDEQAKIEGGKFGKSDGKYSLTYTDSEICNINGLIKIYFTDSTKTKLNWKFSDMTDIITPDCPYYNSNPFPEPLPKSIILTKQ

SEQ ID NO: 1128 - protein, 308 aa, Chryseobacterium sp.
MGTVESCSYQTVDMYFSCYTGDHNQTNESTWGSCNWQSQGGYPAQHLTVVALVCTASTALGDDGTAGGGELGPTTGLGSGTNDGTPTTPTLTLPKNTPCGKIKTKFANAKFKEKVEALDKPEILAYDHEMGYAAGYPPANTGITETQYLPMENSIGTHNVRLPAGNQFFGYMHTHNNESGDSTPIKIFSPADVITFLTSCVRNADDHGNIGDAYAMVITSQGNYILQYSGLADFNIGPNQINNWNTWYKREFQKLADEDKLTQPNIEKTFARFLTESVKINGLEVYQVEKITGNASKINTDGTKTPCP

SEQ ID NO: 1129 - protein, 95 aa, Chryseobacterium sp.
MDLAPVLIVNISAGKSILSDMSGTFEIEARENDEIRFVKEGYYRVDKKITKEDISSPFNIILRKMEIQIPEVKIQYRPTGNLAKDNQHLNESRKL

SEQ ID NO: 1130 - protein, 318 aa, Chryseobacterium sp.
MKKTLFVISSLFFIGCASSNDMLYTQDEEQNLNLKEALPSVSNKMLALNGGEIPLMDLDLNKPLGQPDGGGCSFKTGHSVDNIYTSTAAFGPNPLSFFGYTFRGYGKPRTDGFNWKGIRFQAGNRPATVLSSRGQSRLVNDLFENALSIEFPFESNATYEIILDTIIEDFIYTEQHDQYDQNDDYHGLQQSQAFPTLAVELANTPEIYGSAPCAGRPVLNNRFISENYYKTQKVEITVPPSYEKKTFVFNFSTTESKAAFLIYYLPERGSDPYIPESSFKMNLTGIKIIKKAFDPTYIVPPKVTTPDPSLPCGFRGGC

SEQ ID NO: 1131 - protein, 277 aa, Chryseobacterium sp.
MKKVFILLVLLFGMGIKAQTHRFIYELQYRPDPKGTNYEKEEMVLDVNPEEVKFYEFAFLVNDSLNILHGEMSSQHTSQSGQTIIRKKGGNKNKNFVQIMMMPYYYVFETEDNVPWKIEADTQKINNYNLQKATAVFGGRNWTAWFTPDINIPEGPYKFRGLPGLVMYVEDDKKDFIYSFSRNINLSKIYDTTGFLEKHYSLSPIAIDFKKWVKQNLEFYNDPYARMRTEFQPDWNVRINGQQIKSKEEFAGLTKQTQIDIKKYYNPIELDKAIPYP

SEQ ID NO: 1132 - protein, 215 aa, Chryseobacterium sp.
MTEFQKFFLQIMYTGEGIAALTSIIYFNRVKKQYWKYFALYLITIFLCESAVKWGEKPLHINRVLFYNYFVMPLQFIFFYWLYAKKSLKKTKLFYTFSATHLLSYIPSLLFFPDNKIVFSFNYTFGCLFLMILVIMEYYKQVNSSEILKFSTNKMFYINLGVTLFYIGTLPFMTFMSLLWQYRNIWDLYFAYFQVSGAVMYILFASSFIWGKQSS

SEQ ID NO: 1133 - protein, 177 aa, Chryseobacterium sp.
MNTESNNPLQPGIMSNSLIQTLIDNYRQNHLAAINTALGMQDAHSIWFDLPKLKNFIAKIEEEVAKVNPAASAEDLGIRFYYSAYPKQENWSIMQSHPVPTEYAEKHTLVLIPTLKRANETGELIDYDFNPFQNTEGKSLALNARNGKGLGDDDDDTGLGENLGTLIPPGNSISETY

SEQ ID NO: 1134 - protein, 269 aa, Chryseobacterium sp.
MKRLLLGILAFFLAVYLILCVGLYFYQEKIIFYPEKLPDNYKFKFDGDFEEVTIRTRDSKHLNAVLFKARNPKGVIFYLHGNGGSIKDWGEVAQLYRSMNYDTFILDYRGYGKSEDKISSKDQIFSDVDAAYKELLKRYPENRIIILGYSVGTGLAAKLASEHYAKLLILQAPYYSTEDEMSQKFSFLPRFLLKYNFETGKYLKTVKSPIIIFHGDKDEIINYRASLKLKNNFKKDDSLIILKDQYHNGITDNLDYQKAMKIILDSDKK

SEQ ID NO: 1135 - protein, 91 aa, Chryseobacterium sp.
MVSLLKKYWLVILIVIIFINALGFHFAKESIGISDTLEHAELDEVIAHLKSKDYFYTLFVEVVFILDCWLVLFIPYLFISNFIKNNNLSKK

SEQ ID NO: 1136 - protein, 97 aa, Chryseobacterium sp.
MGKIKFSPLGEKTFLISFLLGTALLLLFWITRAEFLMIFGFYYVMIAAVVNLLITLYELMEFLSDISGKKRNGNSVLLLLLNIPIAFLYLILFFNFC

SEQ ID NO: 1137 - protein, 234 aa, Chryseobacterium sp.
MKKLTESSRCKISMLLILMTVFCFSLSVFRYYISETKVFLFLNWNLFLAWIPLLLSSLVPAFNIRSKISLAFIIIVWILFFPNSPYILTDLFHLRARNEIPIWYDLVVILSYAWTGLICGFISLKDIEQRLSDYAGRNFITGLIIFFLFMSSFGVYLGRFLRWNSWDVLNNPFGLFSDIVVRFIYPMEYTKTWGVTALMGIMLNFMYFTFRWAETDNEKVMQPENKPFHELEQF

SEQ ID NO: 1138 - protein, 120 aa, Chryseobacterium sp.
MAAVKKSLPIDSKRMFIESKISKPCKNQIDRSSASIMDNIAEGFEREGNKEFINFLTMSKGSAGEVRSQLIRAFDRNYLDEEVFIFLKSQTISLSKQLSGFINYLKMTDHNGNKFKRNNN

SEQ ID NO: 1139 - protein, 285 aa, Chryseobacterium sp.
MKYLVILSLFFLINIKTKAQEINRFFYEVQYKPKKDSSRIETAMMVLDIKKDKSIFKDYQLIVSDSISNEVFKKMQKTGIYENQTTPPNVRFTYSVTKKYPDMDVQYTEDIMNGLTPLTFGYQEKLNFDWKIQKEKQKIGEYNTQKAILNFAGRKWIAWFCQDLPFNDGPYKFNGLPGLIVKIEDDQQNYSFTLKGNKKAKDNSEDSLIKKFTNGNVKIVEKVKFTKTFENYKQDPLAAMRSELTPQLLSMTMPGTDMKVKDFIEKQGKEIKESYKLNNNPIEKE

SEQ ID NO: 1140 - protein, 108 aa, Chryseobacterium sp.
MKVIIYDSECKFCTRFSKWSQSNVKTLEIISVRSKEARKLLRDKGIKFIDLQTIYFVNDNEVWVRSKAIFKIFTNFTSPWKFISFFSFLPASITDFGYKIFAKYRYYF

SEQ ID NO: 1141 - protein, 178 aa, Chryseobacterium sp.
MDNNLLSLEYIFITSIVIALSFTGCIYGIAYYLSYDNFSMTAVAFFPILLLFIAFMIAAISLFLSLKKYRNAKKVNHIGNFYYAICTFILSSIMIFLIDVFVYALIDKTLSFKYAETLQIISKQYAVTSKNINYMKKIPFILQSGVMVFTGLLAGTFFSLFILSQYKNIKKQPDLQAI

SEQ ID NO: 1142 - protein, 299 aa, Chryseobacterium sp.
MLKRYLELRLKLLLKASNQNMDIGVMVSIMLLFLLFFKTNNNSYYALISSTVLFIIHFTRKDIDFLKNILGKQFYIGIVSEYLIIWIFINLFFIFKENNFIFLGNIFICFILPLLKLKKYFANPSFINKIPNALLEWKAYMRKNIIIFFSFVLLSVFLGYHPATLVILGLCWLHILLHVYSLQENKEILILQFSRLRLEKKVIYSFLICWIISIPAIINFAFLNPLQKDYIVYFSLYLFLSNYVIIINKYAGYNEKIKVTHVNDADFFKFTLIIGLLIPAIIYIINNRKSALTKIARYV

SEQ ID NO: 1143 - protein, 254 aa, Chryseobacterium sp.
MKAAPVNQTFQIFGIQQSTIFQNINIILSIIMLLSILFAFGIFRYFTPLLLYICVEIVQRAYPFILNGGDNLLKFLLLYMIFTDCYRYFTLNNSSGQKKDSISYFINQISVLSIKIHLSLIYFVSAIFKLNAKVWFSGVATYYTLQLERFKGTEMNNILAKNGIFVTLSTYITLIWELAFPFLAWHKTGKYIVFALGIMIHMGIYIFMMIHDFEILFMMCYGFFISDEEWEKAGVYFQKIVSLFKRKIFSKEYA

SEQ ID NO: 1144 - protein, 212 aa, Chryseobacterium sp.
MKKVIKIFIVACVSIYWLLTFLYNSPNNFIKIEHQKELKIFSTFFAQKWSFFAPPPQFNYKLYFTYLDENKNEIAAFEVYSSIIESKRNTRPFNGRAEMVDYTIYGSIEGVVNTIVKERTEINTKQPELNTDNANLLAVQRLNEVPERVQGFLLLKDYAKIVGKDKMSAEKLKSVKYVTININSEEIKKFANRESKKPNVESKIIAFNPYPF

SEQ ID NO: 1145 - protein, 128 aa, Chryseobacterium sp.
MTFLFLYLRNYKNKITLISKNPCQGLYGKINYHKNKIIMNKKIRNSVFAGGMTFVFALNFLVPNVVKAKGIAYGDQIQSSNTSREAIAPDSNVSAVAGTVLLAVMVVSAIVDGLHATDDVSANIQNLD

SEQ ID NO: 1146 - protein, 575 aa, Chryseobacterium sp.
MYKILFVLIFFYSSLCISQSIKGFQIADSLKNQDFEQLEKNFEKNIYTNKTKAEIYANTILSKGKKNKNDKKIADGYELLYKISRDKQALLFLDSMIIVSRKIQNLEYLSKAYRYKGVYYYYTADYLKSLDNYLIAKSYAKKGSEVYQNINSCIGLLKLELQNYPEALKLLLGYKDYLEKNNFTNHINYEKCLYNLSYAYHVSNNLDSSNYYVKRGFEQNLKSKDQDLYASLSLVYGINTFKQRNYKLALPILEKASKIFTKDPDNIQNVALSEYYIGQILYNTNNKNFIDRFEKVDSIIIASKNVSYELRNTYPLLIDYYKKTGDKEKQLFYIEHLLSVDSILNKNYSFLSAEINKKYDTPLLLNEKENLIADLHSKNYTLFGLLGVGILLIISLIFLQIKNRKKIKLYQSKANLLVRSQDIKEVIPEDVDVTDNKLIYLSSKQETEKSKLSNLPDNKIKQLRIQLEEFERTKRFLDKTINLDLLSKELNTNRSYLSKLVNELKGQNFPQYLNELRINYIIDELKENKNLQKLTISAIADEAGYNNVESFTKAFKKITDTLPSYFIKALKDKKI

SEQ ID NO: 1147 - protein, 50 aa, Chryseobacterium sp.
MKQKKQPLKKLSLRKIQLTKINNLNSIRGGSNDLNFFNEDDEPTGTGKTR

SEQ ID NO: 1148 - protein, 282 aa, Chryseobacterium sp.
MKMKRTFIPGSEWLYLKIYTGVKTADLILEDAIQPLVEYFQEHNYISKWFFVRYNDPKPHLRLRFKLQNTEYYNQTFDKIAATFEQYIDSGEISTIQVDTYNREIERYGEYTIEDAETLFCRNSKFTLQCLHYDDEEKILVSLFYIDEILTHLNLSVREKLEWIKDFNNAFKQEFHADKKLNSQLDKKYREFKLKFLEFLHSAEFSEERDVIVNNIEVSNTIFENIIYQFENQSLEMSLQNFFQSIFHMNINRLFISNQRLFEMVIYDYLFRHYKTIAHYSY

SEQ ID NO: 1149 - protein, 223 aa, Chryseobacterium sp.
MTWLTRTLGVLVLLMVSLILMVLPLILCKTITIFVIAALVYYPVLGFGLYHFILYQKRVRKREVRKIVVDDTGVHYERRDGTIDRILYHGLEKSCLSDEYDINLSPRNKIEVLKVNYNGSVINVDFDGADAGYSCYIGNLKALQRRYIQGVVYFRPDLRINPSVYSAYNINPTDFTFAGKTYWLTFAKTLAVLILSGSILGLIMLGLAEWFSKYECIYSKIID

SEQ ID NO: 1150 - protein, 279 aa, Chryseobacterium sp.
MNTLKKLCYLSAAVLLTTSFVSCSNDDNEISIEQQTPSQVLSSTPWETTGAKDKNGNNVALTDASVAGYVGFAYFKADGKFAIYNLTDVLRSMGTWSVDAQGKTRTIAALNPDGTTIFTRDVEILVLNRNEFTYRIHPNPSDPSLYYDIIHTRTSHAEPTNGQLTLASTPWETTGAKDKSGNNIALSDASVAGYVGYSYFKANGTFRIFGLNDVLRSEGTWSISPDGKKRTLTTPTFTRVVDILVLNEATFTYRITPDASNPAVFYDIIHTKVNHKEPL

SEQ ID NO: 1151 - protein, 123 aa, Chryseobacterium sp.
MEKTKRLLFLDDIRYPIEAYHYTKQVIFLRNDWHIVRNYEQFVNRILEKGLPEMISFDHDLADEHYLKQDSQEFVEKTGYDCAKWLIEYCMDNYLDLPEFYCHSMNPVGKENILNLLQNFKEL

SEQ ID NO: 1152 - protein, 187 aa, Chryseobacterium sp.
MDIFRFIKDIKIHLKLTFDEVDGWFEKDKETLNHQPSNGGWTIQQILEHIYLTNFYLLILIEKGSKKAMKNSLDLDLQIEIENYIFNKEKFDKVGEYGAFEWIRPEHMEPKGELCLGKIRNLINQQYLQCLQYLEVMKNGEGLLYKTTMTVNGLGKINVYEYIYFLSLHAQRHVTQMKKNESETIKN

SEQ ID NO: 1153 - protein, 57 aa, Chryseobacterium sp.
MLIEGDFRTKFLNCKINEIVLFLKKLSKNKKEDTALLKKYINKERNQKMILSGCLSS

SEQ ID NO: 1154 - protein, 175 aa, Chryseobacterium sp.
MGNLLYRIEQDLKAGRKKKACDRLRNMINQFPNDLSLRKKLGQIYFEAGFLDEAGKFWMLSKPENNEMEAAVEIYRESLSNSGNAILKDIVFRGDKDLLDEHAKKVIIELEQDSFKATKQIPVFKAKTREKEKFQEHHTGFLSKIGIFLLIGFIILLPVLGIIKLFEIISSLFSQ

SEQ ID NO: 1155 - protein, 51 aa, Chryseobacterium sp.
MDAIIYLSRQRIATKVADEAKGYYTSLERINFIDSNFASLEFKKRNIKLCV

SEQ ID NO: 1156 - protein, 115 aa, Chryseobacterium sp.
MRQNDLLIRTFTFGVDCLKFLRTLPNDSESKLIRFQLGKSATSIGANYEESQAGSSKADFKNKVKIALREARESHFWLRVLEGLDGYDSEEFKALLTESNELKNILAAIVNNTKV

SEQ ID NO: 1157 - protein, 314 aa, Chryseobacterium sp.
MKNFFKRYLYLSLFLTVVLIVAVWFFLVAKGEYGVTMFFTIPVSIGFIIGYVKFFKKIGLMNVLKTILKIVLGLGIFSLILIGAGVEGAICIIMAIPFIGFAMFAGFTIGFSIGVLDEKRHTGSVIVFILFINPASYIFDSYTKPIEETITTEMIVNSSNEKVWKRLNTQINFNKPDFILFEKGVSYPKNIKLVNENGKLGYSCQTNNDQLQLNINEFIENKKVKFSLENQTVPMKEITPYKDIDAKHLHDYFIVKYGEITLDKLSENKTKVVAKTKYSYKIAPIWYWKKWSGYIIDKMQSHVLQSIKTQSENE

SEQ ID NO: 1158 - protein, 45 aa, Chryseobacterium sp.
MSTIYLNTVINADIHYVFDLARNIDLHQQSTSNPMKKQLQAVPQD

SEQ ID NO: 1159 - protein, 318 aa, Chryseobacterium sp.
MKSVVKTLNIESETLNFKTMKIIIAGGTGFLGKSLEKYFTEKGDQVYILTRNPKRENEIYWDAQTIGEWKNSLENADVLINLTGKSVDCRYHEKNKKEIYSSRIDSTKILQKAVDQCSEKPKIWLNASSATIYIHSEKNLNTEENGIIGDDFSMNICKSWEKEFFDVKSEDIRKVALRTSIVLGKNGGAFPKLKMITKLGLGGKQGRGNQMVSWIHIDDFCKAVEWIIQRETISGVVNLTAPAPVSNENMMKKLRNKMKVPFGLNAPVWQLEVASIFLNTETELLLKSRNVYPEKLIKNGFQFIYSGFEEAIINLLEA

SEQ ID NO: 1160 - protein, 93 aa, Chryseobacterium sp.
MKKLILLAAFGAAGLASAKANDGKAIKNDNSIEANTMQKTVVYQECGVVVTYWSGGQIVGQETIVSDQPDLQSCQQFQTGVKVALWAAGFWLS

SEQ ID NO: 1161 - protein, 256 aa, Chryseobacterium sp.
MKKILLLTLVFVSGLCISQQVHVKYQRVLSPFTTTHEDLYIKNNQVLSVQDSIIINNKLTDSWTLGVNLDNGKKPSKQYFVSDLDNSPERNFFFTSSVDTKEFFIYDKVPQPKWNIEEKETKTIAGYKCHKATADFRGSKIIAYFTKSLPYSVGPFKFYGLPGLILDIRVENKDYDIWKAESVSTDDQSKIVYKPQFLRKDKISFKEYVEAKEAHMNKIFAKVSDALPKNSKVTVRTNQRFSVEQKYEWENNSEVK

SEQ ID NO: 1162 - protein, 205 aa, Chryseobacterium sp.
MLNAKIDFDNSCERINKIHELYNHLSNELHFQSDFIVDLLRSEIVYMVSALDKFIHDIVKIGILESYNGLRINTPAYNSFSISMLHINTLANPTSQLTANQILENIIIENHKHLSFQDPDKIAQALSLIWPENHKWQKIADYVNMDQNNLKIELRNIVIRRNQIVHEADIDLFTNSIQDIENVDVENSITFIAQIVDAIYNLVKL

SEQ ID NO: 1163 - protein, 344 aa, Chryseobacterium sp.
MRIIFFNHKGGVSKTTTTFNLGWKLAEQGKKVLLVDADPQCNLTGLILQDNFEEYYINDNTKNNNLKDAVSPAFESKPEAIMAFDCFQTPRNENLFLLPGHPNLTEIEPQLSFAQTSNNAFSTMQNLPGAFNALIDLLVEKYAIEYVIFDVNPGLGAINQNLFSISDLFIIPTNPDPFSLMAIKTLSHVLPRWVQQSQMMQTMFAQSSYPFPSRHPKLGGLLIQRFNIRNGKPNTPFRNNMNEIIDEVTKSLIPSLKKVNMLLGKDSFIDSKIPDNYCLAEIPDFQSLLQKANLVGVPVFSITDSEIDNTGPVLAQLQKKRKFFDDIFNDFAAQIIHIKEYAER

SEQ ID NO: 1164 - protein, 1115 aa, Chryseobacterium sp.
MTSKQMRRFSIEDIENAYDKLKTTIFYDSGDLLLREQIVEFETNYSKNNFIFSDFELTNRYFKVKDKDKNKLDFPSFLQEITLQDKFEILTEKINNYNKDSEFFDELLEEISVTVYPKKFTQNNSIHSIISNKRIKTKYILDKVTAFIHAPIEIHIIAVLWTIKDGIKKDADLVDECVGNRLLLTKDKSKILFGSALYKPYFSQYQQWRDNAVNTAQQLLNNNKNTLFLNLDIKDYYYSARISETYFRYTDGAKEIYDNLNTLMEKLHRIFTQKVLQLKIPYDFKSEVIENDRINKFIIPIGLQSSLIIANEYLKDFDKIILEKYKPAYYGRYVDDILIVISEPNTTDNKDNKALDKYYTFFENYKESSFDKNRNFNLKDLTDIELYILKNFYPLIDVINSPFSIEKEFNKPENRIFKINGYSSLYCQSDKTLIYYFDKNESSVVIDKLKKEIEDKSSEFRDMPNDEDNLIEFEENAYHLSYDGTDGKIRTLKDYKEDRFGLSVYLSHKINLGLRKREKISEYEKEKILKFFKGENCLTFYKLWEKILTLFVVNDDPTAFTEFLFHCLEQIEKINVKDNDKTNNEYSLTREIAIQVHDALTQYLFFAFEMSISLNLKFLKNYDVNKNFEFQSNKTSRENFALLFAEFSFINPYKSRKKVGFRIREANMIRHHYVSIPLLNYTEDGKNGDLNLIDKNLHIKNYKLDRTLLKNSPRPIKFWECCIASAFEEFQKFNPENSNRSEVIETNILYDIMEEYEEEIYDEENNELKKRIAYNKKDYLDVAFDLYCLGNSKHKPNHELNQNLKNQFYTLQKIYGSEEDFLVNKFTVNKDEKLLNPRIAFANTDVLEENIEASILDSPILSNERINKLSKILSKARKSDAQLLLFPENFMPMRLISALGRFSTDNQIMIVSGIEHLTLKNTSFNFVISILPQKINGINDATIIFRLKNNYSPGEEHLINKHYLAVPKPKPSRYEIINYRNIYFSVCYCFELANISHREKLKSKIDLLIGVEWNKDTPYFSNIVESTSRDLHCFVAQVNTSKYGDTRLTQPKETATKDLLKLKGGLNDTILVGQIDIQKLRNFQRVKSSINTSKEFKPLPPDFSLEEILKRISNQ

SEQ ID NO: 1165 - protein, 56 aa, Chryseobacterium sp.
MIKMDTVSRNRQKKSQLSSGFINYIVFVTYIPTILKKLARVKFLAWQIRIIVRRAI

SEQ ID NO: 1166 - protein, 93 aa, Chryseobacterium sp.
MQIFGFESEIFIRISNLFVSMTEANRKIVEFIRDEWVIPMNNNSKFAVDHNIDEKTVRRIKDDKDYQIALLTIMRICHARNLTLASFFKMVGI

SEQ ID NO: 1167 - protein, 181 aa, Chryseobacterium sp.
MKKSKTNFDNRFRADKKYSGLQLVETFFQFNELDVSKERLSNIMNYAVKRNSWIYEDPAVIFQFYQSMRSLIRAGFLMMLKDRKWTVDTRPEKISPWVLGLLSEKEYRNPLLVFKTAFSAYTIKEFDYFMSGIVYFSMGVYENLPERNIVMPYIHTVKMLDAAHLILQRRREARGFESRRV

SEQ ID NO: 1168 - protein, 57 aa, Chryseobacterium sp.
MNEEDRFINIFSYILTVLNSLKNLNGSKNYKKLNFARLNKTKLIIETLRSSFKSGII

SEQ ID NO: 1169 - protein, 49 aa, Chryseobacterium sp.
MENFAKRLMDQQYGKGEWNKTKADVGPGSEYQGIKKWGDRSFQNPPKKK

SEQ ID NO: 1170 - protein, 165 aa, Chryseobacterium sp.
MNYFVYALEHIYTDETHTNRKFLGYYDDLEKLEKDKEKALALPGFKEYPNGMVIRKYELNSIDWEKGFDSVVGEIGRDYLIKEDIICEESRSIKELNLQYIFQVSHTYTINTFLDDERIIGVFLDKKTTDKVIESCKKKDGFKNYPDDFIVSKFTLNNLMWTSGF

SEQ ID NO: 1171 - protein, 127 aa, Chryseobacterium sp.
MFQPKSILFHFLLLLTISCSSNKLSGSWEFIDIYDGEINRVDTLKNKTNKSRYGTGILTFYQDETFTSMGNDGTYQIENNLLKMKYNDDEKTIPMKISYISKEHLLLFSMAGSPKTWFYKKVKKNSK

SEQ ID NO: 1172 - protein, 137 aa, Chryseobacterium sp.
MKVKVSRRATFNAAHRLHNNLWSDAKNKEIFGKCNNPYYHGHNYTLFTSVTGKVCKETGFVIDLGYLNNLVNELIIDYLDHKNLNLEIIEFRDLNPTLENMLIVIYNKLRNKIDEKYRLEVKLFETENNFAEISDLE

SEQ ID NO: 1173 - protein, 277 aa, Chryseobacterium sp.
MKKALSILSILSFFIFIIYACTNQDENIVNTSPETKVVNANKTMETENISPEELGQIHNNILKQYYSLYGENDTEDLLEMNKRLNEISVDLYPSKFTLLSDDEIATFTEFSYGATNVTGWDYRTHSINALDDALGNGTISQDFYDMFKSLVVDGGTYEETLGKLQDYKTALSNQPASTIKTTETNFINGAISVYTSSKEYWANDPDLQSSNTSGKYFGGCDPEDQIAIADTYGSIMGGLFGVATSGGVSSVVWGAVGSWGFSKAIRMQIKKNNGKCV

SEQ ID NO: 1174 - protein, 132 aa, Chryseobacterium sp.
MCLNEIKKKLDKLNFTYSCKDSTLEIKLGFGLIAEVKQNNTSISVSGILTPWNPISGLFRVDIEKSLVYNSISLIIFYILLFLMILDDFKLNSFLLIFASLICVHLILWYILFLVKYYSFRSQIQQWIIMDH

SEQ ID NO: 1175 - protein, 66 aa, Chryseobacterium sp.
MNITAKITKNAVVRTTTSGKELVSFGIGIRHTYKNKQGEKISMDTYLDCAYWRTTNIAPYLKKEKS

SEQ ID NO: 1176 - protein, 178 aa, Chryseobacterium sp.
MARYPIHIADASVYVGTYTKYNEGSLFGKWLNLNDFTSRGEFYEACAQVHRDEEDAEYMFQDYENIPENLIDESWISENVFEVLHELSLLSENDLEAFLLWCDNDHIDLSKENIIDLITDFRDHYIGTYDCEEDFAFELVEEREDLSDFAKQYFDYRAYANDLFCSDYWYRDGHVFYN

SEQ ID NO: 1177 - protein, 82 aa, Chryseobacterium sp.
MTQTELKDKFRDLLSLNPPLKEMEELFFKAVKSGALDYKNEDPHTYRTAKVIYHVIHSTMAESWKPLSESNRQEVENLKAFL

SEQ ID NO: 1178 - protein, 60 aa, Chryseobacterium sp.
MKITDLNGLEITVTNLDKAIRQAEFFKDLHHVPPAASDKQRQMYWNDIYNKLLELKSKIS

SEQ ID NO: 1179 - protein, 80 aa, Chryseobacterium sp.
MSNLADKTEYQALKIIARMVKDFERLHCLNMTASDDWDATKARNLLQGQSNGYQINYGRRGRVTISCSVKMTNNNTSLIL

SEQ ID NO: 1180 - protein, 126 aa, Chryseobacterium sp.
MDNYKKFTDYLFDQFVTLERCIGKSRSHDYLPIFFNYIEKGFYYRNSKKAKRYAQIVFSSISYAVLNWKTHLLDLKNDPKDAQKNFTAYLKRLEVLQYSPDQIANMLIERYRLNHPTDILDPENPL

SEQ ID NO: 1181 - protein, 824 aa, Chryseobacterium sp.
MSNAKVNEATLEAMISKIMSQVFPTFHKVGLVHQKSFSVKVGHHSIVVKAKTPNRNSVRAISDILFTIGNQNVIMLELKNENVQLSDADRDQGISYARLLDQMPPITLISNGKDNVFYDTFTKEKIDRQQIDWDFIQECIGNAFEIATKDLRDAVDLLLNRDPALFAGLINGMSGEKFASHRGNISDPTAMICDDFQVERSILKEIDDIFSTGQTLVGVKGAAFSGKTTLLYQFYQKVTSENSFVYYIDCNELNMSIFRQLANSFTSCAKNSVNPEQVRNWLSTSLFDESSGKFYLLLDNFNKNISEGIMEEILELINLFEGSQHRILYSIDEFNYKQISEVPHRIHQTALGHKSTVLKLNDFDDEEYHQAREIMFRSFKVTIERGGYFTEEYREPRILRYLLTGRDSSGLKANEVIKIVAVPDFELLQDIARNGIFSKRVHQLYEKIANCFVEELETRRTVPRLSIAAIGSGAVLTTTFKTKYQDDYQELIQSSLILIRDLPQTDQTIIYPKLPELVAYHCIRPILAVFAKKSQGMDRSEMTRYFLRLVEAAPQWDIVGAAVLIGLSQKDPVLFTSLLSGLRAIKPRTETIKKGTEAQLHMEDIGHLNIIFDSDFDPAESSFLADYNAYSILSQFAGYPIERISQDPEQHEGSPFEIHLELICQIASDPHLFIRPNKKSFLQMKYYELYDWDGVGQIINGKEGIIEAIVQSIQKSFMHITGSMKALYEYGFRSKNVILLYRFYLALQNLIYSTDSTLAQEAQTFVRLFHQFFEDFMANYLSKGVENTDDQEALYQILKKMNFAEHLDDLLLEEKDEGLEEGIS

SEQ ID NO: 1182 - protein, 452 aa, Chryseobacterium sp.
MKTSSLHYMKIVILLCFVVSCKCPMLPAPAIKVSHTNVYDGTSLQLLVPHLKNAEVYWEGPTEIQEGETWQMDSVNKMMSGKYSVWYRSTKRKRCYSAEAVYNLKIDSFSGFPKPEIIQYQNSLISEGNSIVLSVQDIKDANVHWKTPKNDFTGNPLIIRNSTVLDSGLYSVNYVHNFIPNVSSESSTKTIFIYQRQFVTSYKDKKYFLDFAFFDKSIQIWLREDQLKNDIVKDKMLAEINFGTTTRKDFSEFFCEHVGYLEKSKFLAGCAVTAGASGCLLGAGEGLPLVPSCVVLLKLLEPAGAACLEGVLGEVTKVLGIPAAADMGGLGAAIAKEEFADAITGLLKMALCKTAGKELVFNLDGSVILKPKALSASGKPTTNSSGSQDWPGGHDGSQGQGGKGSNSGETGGGKPNSGNGGGDKPNSRNGGPKGDGGLGPMPFQKSSKKQQK

SEQ ID NO: 1183 - protein, 516 aa, Chryseobacterium sp.
MKKFYISALTLCAVVVTSAQEVVWQKDIKSSTQDFLSQINPTIDGQYLITGSSIQAKSHSQAANSQKQNNGYDFHLIKLNQQGEEVWEKYFSGSNHDYLSASVTTQDGGSLLAGTSYSGKGLDKKEDSKGGSDIWLIRINEFGDELWQKTLGSTSDEEARAVIQTTDLGFFVAGNIQNASKGFGSKDVLITRLDKDGKELSQLVLGGKGLDEVEKMIPTRDGGALIGIYSRSSVGGSKKAENFGEGDYWIIKLDKNGKVEWEKNFGGKGDDHLRTLALTSNGFIIGGESRSERSGNKTAGLEEGSDVWLISLNERGEEQWQKSYNFGNRDILMSMSVLHSADDKSSKGILLGGYTQAEGRVETDDETFWMLYLDHNGTEQWRKHVKGESKKKEERLSDLRLNKDGSIVLAGTSAEELGKENWKIVKLGDKQVDQLIEKYDIKIYPNPVSDYAYVEIGYDFKEADIILYDMSGRQLQSIKTKNRVTKINTQALVQGAYLVTIKTESNKTANAKLIKK

SEQ ID NO: 1184 - protein, 1174 aa, Chryseobacterium sp.
MNIKLKHLLVAFYFMQSGVSYAQSELLYTNLFSQSPVSKSFGFQGLYPVNLYRGLPDISVPIFEKKVSNTNFNISLNYDVSTVKPEAVHSWVGLGWSTNVGGAITRVVNGQYDELYTSHLNEHDKLSYLDHYNTLDKPDWDSQASLSAFYYDAENSLRFTSFYNYSMQSGNTNTLNFGGGLDNYTDKWMLIPDPDEFILNVLGINGRFYMNEKGKWIGRTRDGKTFSIQHVYKENHTIKPNSYISYNLRRILYGFTVTMDDGTQYIFGQDDNAVEFTEERPPCANCNFNEQIVASSWLINEVKFPDGKKIKYTYERAPKPNYIASQVGYDIVLKAPNIDLFESYGSTALNWQYNTYLKKVESDEFSVEINTSQVKPLNYQVLNEQLRGQMGSYLGSGDSSLLFNTWFKIDSIIVKDKDNHTVNTTTFHYNSVDTTKRMHLEAVIKNNEEKYSFDYNPKTLPLYLDSKYDKWGYYAPSTHSTPDLEYTKAETLEWINHPTGGVTHFIYELNDFSKYGNKNPFYTSANTLELIDTVSPNEIAGGLRIKRIEACSEHSTGCVIKNYSYNGDNGKSSGILPYQFNFTRAGEVQDMYKFSHKSSSSYQSLKGENNMIGYSKVTVTDTNNGKTENYFTNFDTPNCNDQRGPIIMGPPDQFTGLYKSVPFTSFSLMRGKPLKEITSSASGVVQTKEYEYGYNNHLIKAYGLVEENIHYMLNLLTVTAYNVNFNSSFLKGIKTTLNGVETKESYDYEYNYNTLKSQKIIDSNGDEFQTNFTYAFDKPNNFLVGKYMVGFPLKSEEMKNGKVVSKTETLYPLSQTEADNKTSGLPLPTSQVSYQLQSNSPVTEATYDKFDSKGNLLQYTTKNGVSTSIIWGYKNNTLPIVKIQGAKLSDIPQAYVDQIINASKIDAQQATDASEQDFVNALDQFKNRPELAGYLITTYSYDPLIGVKSIGQPSGIREFYKYNAANELERIVDQSGNIVKEFAYKYNIKKFYNSERSQTYTKNNCNSLQVGGTYTYIVPANKYVSLISSTDAEQQAANDLAANGQNAANTNAQCYNAQCYASSINGFQVGPHAEISQNVLGHFKVDIQVKVPNSLTNPDGSQWWQKGVANIPNPCRPNTNLAPDIFNNNVKELTTNTWWKVQITSAGDLIFIPNGYVAPGTQLYFVFEYDKVPN

SEQ ID NO: 1185 - protein, 1240 aa, Chryseobacterium sp.
MKRIYTIAILVWTVIEAQGQTQLPSGLTGTIDENYVYTRTYLEPKTQSDSNAKQIQAIQYFDGLGRAKQTINIKGSPKGRDIVTPFTYDYYGKPIRDYLPVPQSGTQNGKIYSQNSLAVDFPVGDPEGIYTGERPFMEKVLEKSPLDRVIQQIQVGNDWASKPVTFKYETNKNGELKKYTATFSYTSLVAKLILSGSYGPGQLFKNTTTDEDGNQTIEFKNSQGQIVLVRKVISATENADTYYVYNDYNQLAFVIPPKAAIQPDANTVLNELCYQYKYDERNRLVEKKLPGKGWEYMVYNNADQLILTQDTVLKDKGQWLFTKYDQFGRIAYTGITNNAASRVSMQNSANNNTNLYETRTSTTGFTLNGLPVYYTKLSTPTALSILLSVNYYDSYPTYSFNPALPVNTPDMTVLTGTPTADGKSTKGLPVMSFVKNIEDDNWTKNYTYYDQKGRVIGSHSINHLGGYTRIESELDFTGMPQKTVTTHKRLAGEPGVTITEHFEYDNQYRLLVHKHQVDDKPEQILTENSYNELSQLNNKKVGNNLQSIDYTYNIRGWLTGINKAQMAIPDLGGKLFSYIVKYNQINGIENPDSALFNGKNVKPRYNGNIAEVDWRAVESLGANPPIAPKRYGYVYDALNRLTAGYYQNPVNPYSKEHTESLAYDLNGNIANLYRTSAIEGNNTTATVIDELEYTYGSNNLTNQASVIKDYKNNPSGYEGGGGNIQYDLNGNMWQMPDKNITKITYNHLNLPNKIEYGNLGLSGLHNYLYSADGVRLQKKLPKIECGIINCYTVTEITDYLDGFQYYRNESDNNGGGGIEELSMITDKLKYAYEQQAYSTESGITMAQAAPLGITTVKTPQLMFFPTAEGFYDYGKDQYIYQYKDHLGNARISYARNSAGSLEITDANDYYPFGMNHLKTGNAFFGSGSYKNYKYNGKELQETGMYDYGARFYMADIGRWGVLDNYSENYFPISPYSYVANNPTKFIDINGEWIYINDQNGTQYRYHNGATQHQVDGKWTNVDASTQLSDYVVQTIAGLNHLDKNTSIGKTMIGYFDQAQGKDGKIRDIYFNSTSDVSHIKYGISNIIELNPSDKGVWTTLGNDSKYTPLYTTIAHEMGHIYENYALGITSQSDTRFGPNSTTAEIYGTHVENIVRAESGLPLRTHYGSTCGGSTCIPNDDGRLIDNAGSSIYYNKSGGQISPTPSVESILKINGKILQNRYNYIGTAGYYKLQKFKNRPR

SEQ ID NO: 1186 - protein, 243 aa, Chryseobacterium sp.
MKNFLLLFSIMLFSSCNSQGKITMRQMNENLLKDKNSITYRDPKTIKMLTDAYKVFRLLGVKSCDIDPDKKYSQIYIEDGFHDEEGFYNGIFIINNKNICEVTTSPYKLHQDSVSYTKVKEKDISYGEMVFYTKKLSIEDFKNKYPDEYFRYELVRQNKVNAFEKCLEIDQYTPKSIVYARSHYFTGGKMQTYHLPIKYSDIKNGIEELPYFKESKKKEFTECINELNILKIHNSSIKTSSFQ

SEQ ID NO: 1187 - protein, 35 aa, Chryseobacterium sp.
MFEHNMANENADYYQRMNWFLNLPQSREVPVEKKS

SEQ ID NO: 1188 - protein, 107 aa, Chryseobacterium sp.
MGYTFEEIPKILRNIEDRLEKIEKLLSARMQNEPEEEVFIGAREASQLLKLSLPTLYSKICHREVPYYKKGNRLHFSKAELLDWIQEGKKKTMDEISGMGKDILRRR

SEQ ID NO: 1189 - protein, 227 aa, Chryseobacterium sp.
MTLNVPKYTLSAFELPQKDIMSSNMKIKKVCEHCGLGFIARTTVTKYCGDHCAKRAYKAKVRDQKIKDSQVKAEAPSDLVIRRENENDKSYFALKTVDYLTVSEAAALLKCGRRTIYRMIKAGKIPSANLSIRRIRLLKKDIDELFHVTLPVDLINQQDEKLSEEKILKDFLSIGEIQQRYNISETSLKTLINRHKIPKYPRGRFVYVPRKIIEFLLQKIETGKYSG

SEQ ID NO: 1190 - protein, 277 aa, Chryseobacterium sp.
MIVNTGIKVLSSLIILTCFSLKNKKFESRSESLFQKHSDTVTQEEADKYFQEQQKYFDSTCKAETIKAEADIKKNKLVYFHYFGMVKSYRSNDEMNILLKRHNIEVDSALYYCTVPQALQNCYAKVMSKEIRRKFGPKFIDSLRQVADIQYVEKNSDKLYDFEECDTISRYPGSKSYRSFFKDYKRGFWKNVQYPDQFEYRKDKDFYSSISAEFTLHKDGTVSDIDIDLTFHNKKNYKYASYFINETKNFIKKTKWIPAKTMGITVNSRVPLTLFFK

SEQ ID NO: 1191 - protein, 143 aa, Chryseobacterium sp.
MKKIITATLLSVFGAIYAQKGHAKPQANQIDNKLVGLWKGSEKDQQIAGMEKRWVMERKADGTFMLIFTTIQDCEVDQFIERGQWWIEKGEFHELHFNSGKTDIYTYKVLDPSHVKFDSKEQALDIATDTYSFVDTKIDEDNQ

SEQ ID NO: 1192 - protein, 83 aa, Chryseobacterium sp.
MSDIFIYKDIIVIGCLAFPSTGGVAKIQRIFDGGGSMRKASHDIICTNLKTLLKHNTNAHAFSERLKIRDESADGRPDLYNKP

SEQ ID NO: 1193 - protein, 149 aa, Chryseobacterium sp.
MKKGIILCFFLLGINAFSQSNEAKLKELITLTRSDKMLSIAFQQFMDYYNNKYKDLPESFWDEFKKDMSPEKIFALYIPVYKKYFTDSDVDELIKFYKTPAGQKMIENMPNLMKDAREIGTSYAEVLDKRVNDKLNKHYHFQNPPPPAP

SEQ ID NO: 1194 - protein, 254 aa, Chryseobacterium sp.
MKKLSMLVLAVCSTMAFAQKVSDYKYVAIPEKLETFKKDSFGLENILKMSLSSKKYVVLPMNKEEWPSDAKENSCNVLIADILDSSSLFVNKVTLQFKNCKDKIVFESKESSNIKEFEEGYPDALKKSFIKIPVSNPVALLPASDNIAQRTFPETVVPSTTTTTTTTTTTPEANNYSNGKLDLQKIQLDPNQFILAKSGSSVPFAVFKATSKNSVFLVKLSDGSTTIGYFENGNIVIDIPQTDGKYAKEVFAAK

SEQ ID NO: 1195 - protein, 198 aa, Chryseobacterium sp.
MRSLKNLKITESIQTEKLVYEESSYDKFDTISIYFGFSALAIASLLLLKKVDFSLSNSFECAILISLFTFSIYVLYCKYTEKHLKEIKFEIPKEEAKSRIIEYGKKYHYRISKISGNLIFLNEPTDLYSLGKDYEQTTIVFFKSNAILYTLIKEGSRSNFPVLISQHLTKKDFKKILHPDYIEPIKRITYFNSFFHGL

SEQ ID NO: 1196 - protein, 120 aa, Chryseobacterium sp.
MGEIKDYKSFETFLIGPISFLGGGLFEFLVWTANIWFFIAVIFCYKKYFLISMILAAIAFLIAGTFFFWKEILAAENGRMGRIYSLEKGYFLWIASITFLIIGSLYLFIKSKFKNHKLSY

SEQ ID NO: 1197 - protein, 86 aa, Chryseobacterium sp.
MTEFQKYIQRYLDQIPSGDWLNELQISADKTIGIYSNLTEEQSTFAYAEGKWTLKGLLLHLSDTERVFQYRILAFARGEKKQSAGI

SEQ ID NO: 1198 - protein, 212 aa, Chryseobacterium sp.
MMKIKIFTALYLIFMISFFYGQKLELKDKNFEKAVLGNFDLNKNGSLEVSEAEMVMNLFLTQKGITSAEDLPLFKNVKMVVLDDNIIPDITIRKLDQLELFSCTGCKISSFKAENLKNLRSLYLDNNLLESISLMEIPKIDQLTLSLNQLKTIDVTRLKVLRKLNLEHNKLQKIDITGNEVLQTLNITGNTINEADIKKGIKTDVTIFRDGE

SEQ ID NO: 1199 - protein, 221 aa, Chryseobacterium sp.
MVNKSVLRKLSNQELEGYLKEGNRFVPEAVQIAFEILEERGRVFNEQEKTAIQQLIQCKKEQEETKHTEEFEIWKDHITEDPDAIRLYSRMTIFVSSVLFSTIPGAILLALNLIKLKKYFHAFLSVVFGFLFFIFQKYVLVSHFNFGTTSRYSPEIGVIAAGALSLLIISVLATPKKLPYRAESYIFPMILCAGTAVLIYFYFQEWFSFYPLARVINIFRQ

SEQ ID NO: 1200 - protein, 354 aa, Chryseobacterium sp.
MNVLKQVVGIDVAKDELVASFGRLMEDLSTEIKDYKVFSNSEKGFESLLKWVYSKKTLNMDVIFVMEATGVYHERFAHFIYAKEEKTVIMLPNKISNFIRTLDIKTITDKSCSIAITQFGLSRKLELWQPANIVYKELQQLSREKNQVIQERVRCMNQLHAEKTQALPNSRTIKRLTERISLLKKQEKEINEDMVAQVKKSPEATRGVNLLSSIPGIGKSTAIAVLAETNGFELIRNKKQLVSYAGLDIREKQSGTSIKGKPRISKKGNKNIRKTLHFPAMTAVKMNKNHQDLFQRITEKTGIKMKGLVAVQRKLLELMYILFKNKTFYQTDFEESRVKIKDLHPTQANSRSLL

SEQ ID NO: 1201 - protein, 129 aa, Chryseobacterium sp.
MKDQVLKREKRTQKDYSIAFKLRIVSQVENGDYTYKQAQKEYGIQGRSTVLVWLRRYGNLEWSKPKLHTMSNSKETPAQKIKRLEKELADEKLKTKVLNTMIDISDKQYGTQIRKKFSSQQSSNSIDKE

SEQ ID NO: 1202 - protein, 241 aa, Chryseobacterium sp.
MKLPKLGTRKLYHLLKEQLIQEDVKLGRDALFAYLKRENMLIRRQKKYIKTTFSKHWLRKHPNLLKDLKIEKAEQVFVSDITYLKTKESTCYLSLVTDAYSRKIMGYSLSSNMNTENVAKALKMAIKNRGSSGPLIHHSDRGLQYCSGYYQKILNKNEIKPSMTDGYDCYQNALAERVNGILKQEFLFYKTKNMQDLNSLVKESIYLYNTKRPHLSLNMQTPDKVHKKSEEIKYLSGLNIV
